United States Patent 9,254,311 (MODIFIED POLYNUCLEOTIDES FOR THE PRODUCTION OF PROTEINS) - sequence listing, part 19

SEQ ID NO: 39547 - DNA, 5250 bp, Artificial Sequence
  Description of Artificial Sequence: Synthetic coding sequence
atgcaggccatggaccctgctgctgctgacctgtatgaggaggatggcaaggacctggacttctatgactttgagcccctgcccaccctgcctgaagatgaagaaaatgtgtccctggccgacatcctgagcctgcgggaccggggcctgtctgagcaggaggcctgggccgtgtgcctggagtgcagcctgtccatgaggtctgtggcccacgccgccatcttccagagcctgtgcatcaccccagacaccctggccttcaacaccagcggaaatgtgtgcttcatggagcagctgagtgatgatcctgagggcgcctttgtgcccccagagtttgatgtgactggaaacacctttgaggcccacatctacagcctgggcgccaccctgaaggccgccctggagtatgtggccgagcccaccctggagccccggctgagccaggacctggaggccctgctgagcaggatgcaggccgaggaccccggggacagaccagacctggagagcatcatcgccctgtgtgaggagaagctgcagctgaccagcagctgccgggtgtgccgcagcctgtctgctgtgggccggcgggtgctgagcattgagagctttggagccctgcaggatgtgtctgagagctcctggagggagaggcctgcccctggaaatgccggccccaggaggcctcctggggaccccagcacagatcctgaggtgctgcccaccccagagggccctgagagcgagaccagccggggcccccgggccagccccaccaaggccctgctgagcacccctgtgagaaatggagagagccacagccgggagggcctggccggcctggtgctggatgctgagaggaccctgggggagctggacagagatgccctgcggcgcagccggctgaggaaggtgcagaccttcccccggctgctgagtgacagccctgaggccaccctgtgcctgcccctgacccggggcaagagccagctgcccatcagcgagctgttctccccagaccccaggaaggccttcctggacaggaagaatggcctgagcagcttccaggcccagcccaagtgccgcctgtggccagagcaggagcctgagcaccagctgggccgggtgccctgtgccggccgcagcacagaccggggccctggggtgcccggcagccctggccagcctgagaccagccaccccagccagggccctgctgaggccccagctgaccccagagatgccagcggggaggcccagaccccaagagatgatgagcgcatccctgagggcgcccggcagctggagagcgctgctgctgagcagtgggtgtccctgcaggacctgctgagccagctgggccggcccttccgggagtatgagctgtgggccctgtgcctggcctgcctgcgggccctgcagaccaggcctgagcacccagcctacctgtgcctggacagcgtgctggtggccgaggatggagctgtgctcttccagcccccaccagccaacggcagctatgacagcttcttcctggcccctgagctggccgaggagcggctggtgacagagaaggcctctgtgtactgtgtggccgctgtgctgtggacagctgccaagttctctgtgcccaggaaccacaagctggccctgccccggcggctgaagaccctgctgctggacatggcccggcgcagcgcccctgagcggcccagcgctgctgaggccatcaaggtgtgtggcagctacctgctgcagaggggcatggacagcaggaagatcctggcccacctgcgggccagcatctgccaggtgtaccaggaggaggagaccatcagcctgcagaatgccttctctgtggtggagctgaagcccagcgtggccccagcccctgagcccagccctggcttcctgcctgtgaacagcgacaccggcctggtggccgtgcccggccctgtgcccggccagcacccctgtggggaggaggccacccagctgcctgctgccttcaccagcgaggccacccacttcaagcccatcgtgctggcccagaatgcctctgtggcccgggaccagcctgccctggcccaggaggagagcgaggagcggggcggccagcgggagggggagggggaggagaagctgagcctggaggcccatgctggcagccccagcctgaagaccccagatggccctgtgcccggccctggcccccagggcgccgcccctgagcccctgggcgcctctgtgcagagggacagcgcccagggccggccctgccccccaccccaggccccagccaaccagcctgagggcgccagcagcgctgcccctggcagccctgtgcctgccccacccaccaaggccagcgccctgcctgtggagcagggccctgctgagcccatccccccaggagtggccagcggcggcctgcggccagatgccctgggccccaccacagcccaccacggccccaggcacccccccaagcccccaagaagcaaggccacagagcggcccggccaggagcctgagggccctggggccaccccagctggggagagagatgaccagagcccagacagcgtgcctgagcggcccaggcctgctgaccggcggctgtgcctgccctgtgtggatgccagccccctgcccggccgcacagcctgccccagcctgcaggaggccaccaggctcatccaggaggagtttgcctttgatggctacctggacaatggcctggaggccctgatcatgggagagtacatctttgccctgaaggacctgacctttgccaccttctgtggggccatcagcgagaagttctgtgacctgtactgggatgagaagctgctgcagaacctcttcaaggtggtgaatggccaggccagccccagccccagcacagctgaggaggccggcagccagctggagggcagccagagccccaggagccccagcagcaagaggcccagcctgcaccggctgggcaaggagaagccagccatggcccggaccagcagccgggccccctgcagccccacctctgtgtctgatgtggacagtgatgccctgagccggggcaactttgaggtgggcttccggccccagaggtctgtgaaggccgagcgggcccagcagcctgaggccggggaggaccggcggcctgctggaggagccagtgatgtggaggccgtgacccggctggcccggagcaaaggagtgggccctgccctgagccctggccctgctggcttccagagctgcagccctggctggtgcagcgccttctatgaggccgactgctttggagcagatgtgcacaactacgtgaaggacctgggccggcagcaggctgatggagccctgcctgatgcccagagccctgagctggagcagcagctgatgatggagaagaggaactacaggaagaccctgaagttctaccagaagctgctgcagaaggagaagaggaacaagggcagtgatgtgaagaccatgctgagcaagctgaagggccagctggaggagatgaagagccgggtgcagttcctgagcctggtgaagaagtacctgcaggtgatgtatgcagagcgctggggcctggagccctgcaccctgcccgtcatcgtgaacattgctgctgccccctgtgacaccctggacttcagccccctggatgagagcagcagcctcatcttctacaacgtgaacaagcaccctgggggccggcagaaggcccgcatcctgcaggccggcacccccctgggcctgatggcctacctgtacagcagtgatgccttcctggagggctacgtgcagcagttcctgtacaccttccgctacttctgcacccctcatgacttcctgcacttcctgctggaccgcatcaacagcaccctgacccgggcccaccaggaccccaccagcaccttcaccaagatctacagaagaagcctgtgtgtgctgcaggcctgggtggaggactgctatgctgtggacttccccagaaattctggcctgctgggcaagctggaggacttcatcagcagcaagatcctgcccctggatggcagcgccaagcacctgctgggcctgctggaggtgggcatggacagaagagctgagggcaacccccggggcacagacctggagaacccccgggaggccgaggaggatgcccggcccttcaatgccctgtgcaagaggctgtctgaagatggcatcagcaggaagagcttcccctggaggctgcccagaggaaatggcctggtgctgcccccccacaaggagcggccctacaccatcgccgccgccctgcccaagccctgcttcctggaggacttctacggcccctgtgccaagaccagcgagaagggcccctacttcctgacagagtacagcacccaccagctgttcagccagctgaccctgctgcagcaggagctgttccagaagtgccaccctgtgcacttcctgaacagccgggccctgggcgtgatggacaagagcacagccatccccaaggccagcagcagcgagagcctgagcgccaagacctgcagcctcttcctgcccaactacgtgcaggacaagtacctgctgcagctgctgagaaatgctgatgatgtgtccacctgggtggccgctgagatcgtgaccagccacaccagcaagctgcaggtgaacctgctgagcaagttcctgctgattgccaagagctgctatgagcagaggaactttgccacagccatgcagatcctgagcggcctggagcacctggccgtgcggcagagccctgcctggaggatcctgcctgccaagattgctgaggtgatggaggagctgaaggctgtggaggtgttcctgaagagtgacagcctgtgcctgatggagggccgccgcttccgggcccagcccaccctgcccagcgcccacctgctggccatgcacatccagcagctggagactggaggcttcaccatgaccaacggggcccaccgctggagcaagctgagaaatattgccaaggtggtgtcccaggtgcacgccttccaggagaacccctacaccttctccccagaccccaagctgcagagctacctgaagcagagaattgcccgcttcagcggggctgacatcagcaccctggccgctgacagccgggccaacttccaccaggtgagcagcgagaagcacagcaggaagatccaggacaagctgcggaggatgaaggccaccttccagtag

SEQ ID NO: 39548 - DNA, 5256 bp, Artificial Sequence
  Description of Artificial Sequence: Synthetic coding sequence
atgcaggccatggaccctgctgctgctgacctgtatgaggaggatggcaaggacctggacttctatgactttgagcccctgcccaccctgcctgaagatgaagaaaatgtgtccctggccgacatcctgagcctgcgggaccggggcctgtctgagcaggaggcctgggccgtgtgcctggagtgcagcctgtccatgaggtctgtggcccacgccgccatcttccagagcctgtgcatcaccccagacaccctggccttcaacaccagcggaaatgtgtgcttcatggagcagctgagtgatgatcctgagggcgcctttgtgcccccagagtttgatgtgactggaaacacctttgaggcccacatctacagcctgggcgccaccctgaaggccgccctggagtatgtggccgagcccaccctggagccccggctgagccaggacctggaggccctgctgagcaggatgcaggccgaggaccccggggacagaccagacctggagagcatcatcgccctgtgtgaggagaagctgcagctgaccagcagctgccgggtgtgccgcagcctgtctgctgtgggccggcgggtgctgagcattgagagctttggagccctgcaggatgtgtctgagagctcctggagggagaggcctgcccctggaaatgccggccccaggaggcctcctggggaccccagcacagatcctgaggtgctgcccaccccagagggccctgagagcgagaccagccggggcccccgggccagccccaccaaggccctgctgagcacccctgtgagaaatggagagagccacagccgggagggcctggccggcctggtgctggatgctgagaggaccctgggggagctggacagagatgccctgcggcgcagccggctgaggaaggtgcagaccttcccccggctgctgagtgacagccctgaggccaccctgtgcctgcccctgacccggggcaagagccagctgcccatcagcgagctgttctccccagaccccaggaaggccttcctggacaggaagaatggcctgagcagcttccaggcccagcccaagtgccgcctgtggccagagcaggagcctgagcaccagctgggccgggtgccctgtgccggccgcagcacagaccggggccctggggtgcccggcagccctggccagcctgagaccagccaccccagccagggccctgctgaggccccagctgaccccagagatgccagcggggaggcccagaccccaagagatgatgagcgcatccctgagggcgcccggcagctggagagcgctgctgctgagcagtgggtgtccctgcaggacctgctgagccagctgggccggcccttccgggagtatgagctgtgggccctgtgcctggcctgcctgcgggccctgcagaccaggcctgagcacccagcctacctgtgcctggacagcgtgctggtggccgaggatggagctgtgctcttccagcccccaccagccaacggcagctatgacagcttcttcctggcccctgagctggccgaggagcggctggtgacagagaaggcctctgtgtactgtgtggccgctgtgctgtggacagctgccaagttctctgtgcccaggaaccacaagctggccctgccccggcggctgaagaccctgctgctggacatggcccggcgcagcgcccctgagcggcccagcgctgctgaggccatcaaggtgtgtggcagctacctgctgcagaggggcatggacagcaggaagatcctggcccacctgcgggccagcatctgccaggtgtaccaggaggaggagaccatcagcctgcagaatgccttctctgtggtggagctgaagcccagcgtggccccagcccctgagcccagccctggcttcctgcctgtgaacagcgacaccggcctggtggccgtgcccggccctgtgcccggccagcacccctgtggggaggaggccacccagctgcctgctgccttcaccagcgaggccacccacttcaagcccatcgtgctggcccagaatgcctctgtggcccgggaccagcctgccctggcccaggaggagagcgaggagcggggcggccagcgggagggggagggggaggagaagctgagcctggaggcccatgctggcagccccagcctgaagaccccagatggccctgtgcccggccctggcccccagggcgccgcccctgagcccctgggcgcctctgtgcagagggacagcgcccagggccggccctgccccccaccccaggccccagccaaccagcctgagggcgccagcagcgctgcccctggcagccctgtgcctgccccacccaccaaggccagcgccctgcctgtggagcagggccctgctgagcccatccccccaggagtggccagcggcggcctgcggccagatgccctgggccccaccacagcccaccacggccccaggcacccccccaagcccccaagaagcaaggccacagagcggcccggccaggagcctgagggccctggggccaccccagctggggagagagatgaccagagcccagacagcgtgcctgagcggcccaggcctgctgaccggcggctgtgcctgccctgtgtggatgccagccccctgcccggccgcacagcctgccccagcctgcaggaggccaccaggctcatccaggaggagtttgcctttgatggctacctggacaatggcctggaggccctgatcatggagcctggagagtacatctttgccctgaaggacctgacctttgccaccttctgtggggccatcagcgagaagttctgtgacctgtactgggatgagaagctgctgcagaacctcttcaaggtggtgaatggccaggccagccccagccccagcacagctgaggaggccggcagccagctggagggcagccagagccccaggagccccagcagcaagaggcccagcctgcaccggctgggcaaggagaagccagccatggcccggaccagcagccgggccccctgcagccccacctctgtgtctgatgtggacagtgatgccctgagccggggcaactttgaggtgggcttccggccccagaggtctgtgaaggccgagcgggcccagcagcctgaggccggggaggaccggcggcctgctggaggagccagtgatgtggaggccgtgacccggctggcccggagcaaaggagtgggccctgccctgagccctggccctgctggcttccagagctgcagccctggctggtgcagcgccttctatgaggccgactgctttggagcagatgtgcacaactacgtgaaggacctgggccggcagcaggctgatggagccctgcctgatgcccagagccctgagctggagcagcagctgatgatggagaagaggaactacaggaagaccctgaagttctaccagaagctgctgcagaaggagaagaggaacaagggcagtgatgtgaagaccatgctgagcaagctgaagggccagctggaggagatgaagagccgggtgcagttcctgagcctggtgaagaagtacctgcaggtgatgtatgcagagcgctggggcctggagccctgcaccctgcccgtcatcgtgaacattgctgctgccccctgtgacaccctggacttcagccccctggatgagagcagcagcctcatcttctacaacgtgaacaagcaccctgggggccggcagaaggcccgcatcctgcaggccggcacccccctgggcctgatggcctacctgtacagcagtgatgccttcctggagggctacgtgcagcagttcctgtacaccttccgctacttctgcacccctcatgacttcctgcacttcctgctggaccgcatcaacagcaccctgacccgggcccaccaggaccccaccagcaccttcaccaagatctacagaagaagcctgtgtgtgctgcaggcctgggtggaggactgctatgctgtggacttccccagaaattctggcctgctgggcaagctggaggacttcatcagcagcaagatcctgcccctggatggcagcgccaagcacctgctgggcctgctggaggtgggcatggacagaagagctgagggcaacccccggggcacagacctggagaacccccgggaggccgaggaggatgcccggcccttcaatgccctgtgcaagaggctgtctgaagatggcatcagcaggaagagcttcccctggaggctgcccagaggaaatggcctggtgctgcccccccacaaggagcggccctacaccatcgccgccgccctgcccaagccctgcttcctggaggacttctacggcccctgtgccaagaccagcgagaagggcccctacttcctgacagagtacagcacccaccagctgttcagccagctgaccctgctgcagcaggagctgttccagaagtgccaccctgtgcacttcctgaacagccgggccctgggcgtgatggacaagagcacagccatccccaaggccagcagcagcgagagcctgagcgccaagacctgcagcctcttcctgcccaactacgtgcaggacaagtacctgctgcagctgctgagaaatgctgatgatgtgtccacctgggtggccgctgagatcgtgaccagccacaccagcaagctgcaggtgaacctgctgagcaagttcctgctgattgccaagagctgctatgagcagaggaactttgccacagccatgcagatcctgagcggcctggagcacctggccgtgcggcagagccctgcctggaggatcctgcctgccaagattgctgaggtgatggaggagctgaaggctgtggaggtgttcctgaagagtgacagcctgtgcctgatggagggccgccgcttccgggcccagcccaccctgcccagcgcccacctgctggccatgcacatccagcagctggagactggaggcttcaccatgaccaacggggcccaccgctggagcaagctgagaaatattgccaaggtggtgtcccaggtgcacgccttccaggagaacccctacaccttctccccagaccccaagctgcagagctacctgaagcagagaattgcccgcttcagcggggctgacatcagcaccctggccgctgacagccgggccaacttccaccaggtgagcagcgagaagcacagcaggaagatccaggacaagctgcggaggatgaaggccaccttccagtag

SEQ ID NO: 39549 - DNA, 561 bp, Artificial Sequence
  Description of Artificial Sequence: Synthetic coding sequence
tgagacctgagcaagagccgggagaacctgtctgctgtgatgctgtacaaccctggcctcttccccatcaagggccccatctgcctgcggctggagtttgagcggcagcagcgggaggagctggagaagctggagagcaagaggaagctgattgaggagatggaggagaagcagaagagtgacaaggccgagctggagaggatgcagcaggaggtggagacccagaggaaggagacagaaattgtgcagctgcagatcaggaagcaggaggagagcctgaagagaagaagcttccacatcgagaacaagctgaaggacctgctggccgagaaggagaagtttgaggaggagcggctgcgggagcagcaggagattgagctgcagaagaagaggcaggaggaggagaccttcctgcgggtgcaggaggagctgcagaggctgaaggagctgaacaacaatgagaaggccgagaagttccagatcttccaggagctggaccagctgcagaaggagaaggatgagcagtatgccaagctggagctggagaagaagaggctgtag

SEQ ID NO: 39550 - DNA, 2874 bp, Artificial Sequence
  Description of Artificial Sequence: Synthetic coding sequence
atggctgaccctgctgagtgcagcatcaaggtgatgtgccgcttccggcccctgaatgaagctgagatcctgcggggggacaagttcatccccaagttcaagggagatgagaccgtggtgattggccagggcaagccctacgtgtttgacagagtgctgccccccaacaccacccaggagcaggtgtacaatgcctgtgccaagcagatcgtgaaggatgtgctggagggctacaacggcaccatctttgcctacggccagaccagcagcggcaagacccacaccatggagggcaagctgcatgacccccagctgatgggcatcatcccccgcatcgcccatgacatctttgaccacatctacagcatggatgagaacctggagttccacatcaaggtgtcctactttgagatctacctggacaagatccgggacctgctggatgtgtccaagaccaacctggccgtgcatgaggacaagaacagagtgccctacgtgaagggctgcacagaaagatttgtgagcagccctgaggaggtgatggatgtgattgatgagggcaaggccaacagacatgtggccgtgaccaacatgaatgagcacagcagccgcagccacagcatcttcctgatcaacatcaagcaggagaatgtggagacagagaagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcaccaagacccacgtgccctacagagacagcaagatgacccgcatcctgcaggacagcctgggcggcaactgcaggaccaccatcgtcatctgctgcagccccagcgtcttcaatgaggccgagaccaagagcaccctgatgtttggccagagggccaagaccatcaagaacacagtgtctgtgaacctggagctgacagctgaggagtggaagaagaagtatgagaaggagaaggagaagaacaagaccctgaagaatgtcatccagcacctggagatggagctgaaccgctggagaaatggagaggccgtgcctgaagatgagcagatcagcgccaaggaccagaagaacctggagccctgtgacaacacccccatcatcgacaacatcgcccctgtggtggccggcatcagcacagaggagaaggagaagtatgatgaggagatcagcagcctgtaccggcagctggatgacaaggatgatgagatcaaccagcagagccagctggccgagaagctgaagcagcagatgctggaccaggatgagctgctggccagcacccggcgggactatgagaagatccaggaggagctgacccggctgcagattgaaaatgaagctgccaaggatgaggtgaaggaggtgctgcaggccctggaggagctggccgtgaactatgaccagaagagccaggaggtggaggacaagacccgggccaatgagcagctgacagatgagctggcccagaagaccaccaccctgaccaccacccagcgggagctgagccagctgcaggagctgagcaaccaccagaagaagagggccacagagatcctgaacctgctgctgaaggacctgggggagattggaggcatcatcggcaccaatgatgtgaagaccctggctgatgtgaatggagtcatcgaggaggagttcaccatggcccggctgtacatcagcaagatgaagtctgaggtgaagagcctggtgaacagaagcaagcagctggagagcgcccagatggacagcaacaggaagatgaatgccagcgagcgggagctggccgcctgccagctgctgatcagccagcacgaggccaagatcaagagcctgacagactacatgcagaacatggagcagaagaggcggcagctggaggagagccaggacagcctgtctgaggagctggccaagctgcgggcccaggagaagatgcatgaggtgtccttccaggacaaggagaaggagcacctgacccggctgcaggatgctgaggagatgaagaaggccctggagcagcagatggagagccaccgggaggcccaccagaagcagctgagccggctgagagatgaaattgaggagaagcagaagatcattgatgagatccgggacctgaaccagaagctgcagctggagcaggagaagctgagcagtgactacaacaagctgaagattgaggaccaggagcgggagatgaagctggagaagctgctgctgctgaatgacaagcgggagcaggcccgggaggacctgaagggcctggaggagaccgtgtcccgggagctgcagaccctgcacaacctgaggaagctgtttgtgcaggacctgaccaccagggtgaagaagtctgtggagctggacaatgatgatggcggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccatgagggacaggaagcgctaccagcaggaggtggaccgcatcaaggaggccgtgcgggccaagaacatggcccggcgggcccacagcgcccagatcgccaagcccatccggcccggccactacccagccagcagccccacagctgtgcacgccatccggggcggcggcggcagcagcagcaacagcacccactaccagaagtag

SEQ ID NO: 39551 - DNA, 2064 bp, Artificial Sequence
  Description of Artificial Sequence: Synthetic coding sequence
atggtggagaatgaaaggctgcggcaggagatgaggcgctgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgagagcgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtacagaagagagctgcagctgaggaagaagtgccacaatgagctggtgcggctgaagggcaacatccgggtcatcgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagctgagaaccctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagtctggagctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagccggcccggcagcatccggaggaagctgcagcccagcgcctag

SEQ ID NO: 39552 - DNA, 2556 bp, Artificial Sequence
  Description of Artificial Sequence: Synthetic coding sequence
atggcccaggtgctgcacgtgcctgcccccttccctggcaccccaggccctgccagccccccagccttccctgccaaggaccctgaccccccctacagcgtggagaccccctacggctaccgcctggacctggacttcctgaagtatgtggatgacatcgagaagggccacaccctgcggcgggtggccgtgcagaggcggccccggctgagcagcctgccccggggccctggctcctggtggaccagcacagagagcctgtgcagcaatgccagcggggacagccgccacagcgcctacagctactgcggccggggcttctacccccagtatggagccctggagacccggggcggcttcaacccccgggtggagaggaccctgctggatgcccggcggcggctggaggaccaggccgccacccccaccggcctgggcagcctgaccccatctgctgctggcagcacagccagcctggtgggcgtgggcctgcccccacccacccccaggagcagcggcctgagcacccctgtgcccccatctgctggccacctggcccacgtgcgggagcagatggccggggccctgaggaagctgcggcagctggaggagcaggtgaagctgatccctgtgctgcaggtgaagctgtctgtgctgcaggaggagaagaggcagctgactgtgcagctgaagagccagaagttcctgggccaccccacagctggccggggccgctctgagctgtgcctggacctgcctgaccccccagaagatcctgtggccctggagaccaggtctgtgggcacctgggtgcgggagcgggacctgggcatgccagatggagaggccgccctggccgccaaggtggccgtgctggagacccagctgaagaaggccctgcaggagctgcaggccgcccaggcccggcaggccgacccccagccccaggcctggcccccaccagacagccctgtgcgggtggacacagtgcgggtggtggagggcccccgggaggtggaggtggtggccagcacagctgctggggccccagcccagagggcccagagcctggagccctacggcaccggcctgcgggccctggccatgcctggccggcctgagagcccccctgtgttccgcagccaggaggtggtggagaccatgtgccctgtgcctgctgctgccaccagcaatgtgcacatggtgaagaagatcagcatcacagagaggagctgtgatggagctgctggcctgcctgaggtgcctgctgagagcagcagcagccccccaggcagcgaggtggccagcctgacccagcctgagaagagcacaggccgggtgcccacccaggagcccacccaccgggagcccacccggcaggccgccagccaggagagcgaggaggccggcggcaccggcggccccccagctggggtgcgcagcatcatgaagaggaaggaggaggtggccgaccccacagcccaccggcgcagcctgcagtttgtgggcgtgaatggaggctatgagagcagcagcgaggacagcagcacagctgagaacatcagtgacaatgacagcacagaaaatgaggcccctgagccccgggagcgggtgcccagcgtggccgaggccccccagctgcggcctgctggaacagctgctgccaagaccagccggcaggagtgccagctgagccgggagagccagcacatccccacagctgagggcgccagcggcagcaacacagaggaggagatccgcatggagctgagcccagacctgatcagcgcctgcctggccctggagaagtacctggacaaccccaatgccctgacagagcgggagctgaaggtggcctacaccaccgtgctgcaggagtggctgcggctggcctgccgcagtgatgcccaccctgagctggtgcggcggcacctggtgaccttccgggccatgtctgcccggctgctggactatgtggtgaacattgctgacagcaatggaaacacagccctgcactacagcgtgtcccatgccaacttccctgtggtgcagcagctgctggacagcggcgtgtgcaaggtggacaagcagaacagagctggctacagccccatcatgctgacagccctggccaccctgaagacccaggatgacattgaaacagtgctgcagctgttccggctgggcaacatcaatgccaaggccagccaggccggccagacagccctgatgctggccgtgagccacggccgggtggatgtggtgaaggccctgctggcctgtgaggctgatgtgaatgtgcaggatgatgatggcagcacagccctgatgtgtgcctgtgagcacggccacaaggagattgctggcctgctgctggccgtgcccagctgtgacatcagcctgacagacagagatggcagcacagccctgatggtggccctggatgctggccagagcgagatcgcctccatgctgtacagcaggatgaacatcaagtgcagctttgcccccatgtctgatgatgagagccccaccagcagcagcgctgaggagtag

SEQ ID NO: 39553 - DNA, 2580 bp, Artificial Sequence
  Description of Artificial Sequence: Synthetic coding sequence
atggcccaggtgctgcacgtgcctgcccccttccctggcaccccaggccctgccagccccccagccttccctgccaaggaccctgaccccccctacagcgtggagaccccctacggctaccgcctggacctggacttcctgaagtatgtggatgacatcgagaagggccacaccctgcggcgggtggccgtgcagaggcggccccggctgagcagcctgccccggggccctggctcctggtggaccagcacagagagcctgtgcagcaatgccagcggggacagccgccacagcgcctacagctactgcggccggggcttctacccccagtatggagccctggagacccggggcggcttcaacccccgggtggagaggaccctgctggatgcccggcggcggctggaggaccaggccgccacccccaccggcctgggcagcctgaccccatctgctgctggcagcacagccagcctggtgggcgtgggcctgcccccacccacccccaggagcagcggcctgagcacccctgtgcccccatctgctggccacctggcccacgtgcgggagcagatggccggggccctgaggaagctgcggcagctggaggagcaggtgaagctgatccctgtgctgcaggtgaagctgtctgtgctgcaggaggagaagaggcagctgactgtgcagctgaagagccagaagttcctgggccaccccacagctggccggggccgctctgagctgtgcctggacctgcctgaccccccagaagatcctgtggccctggagaccaggtctgtgggcacctgggtgcgggagcgggacctgggcatgccagatggagaggccgccctggccgccaaggtggccgtgctggagacccagctgaagaaggccctgcaggagctgcaggccgcccaggcccggcaggccgacccccagccccaggcctggcccccaccagacagccctgtgcgggtggacacagtgcgggtggtggagggcccccgggaggtggaggtggtggccagcacagctgctggggccccagcccagagggcccagagcctggagccctacggcaccggcctgcgggccctggccatgcctggccggcctgagagcccccctgtgttccgcagccaggaggtggtggagaccatgtgccctgtgcctgctgctgccaccagcaatgtgcacatggtgaagaagatcagcatcacagagaggagctgtgatggagctgctggcctgcctgaggtgcctgctgagagcagcagcagccccccaggcagcgaggtggccagcctgacccagcctgagaagagcacaggccgggtgcccacccaggagcccacccaccgggagcccacccggcaggccgccagccaggagagcgaggaggccggcggcacagccccacccctgagcagccccccaggcggccccccagctggggtgcgcagcatcatgaagaggaaggaggaggtggccgaccccacagcccaccggcgcagcctgcagtttgtgggcgtgaatggaggctatgagagcagcagcgaggacagcagcacagctgagaacatcagtgacaatgacagcacagaaaatgaggcccctgagccccgggagcgggtgcccagcgtggccgaggccccccagctgcggcctgctggaacagctgctgccaagaccagccggcaggagtgccagctgagccgggagagccagcacatccccacagctgagggcgccagcggcagcaacacagaggaggagatccgcatggagctgagcccagacctgatcagcgcctgcctggccctggagaagtacctggacaaccccaatgccctgacagagcgggagctgaaggtggcctacaccaccgtgctgcaggagtggctgcggctggcctgccgcagtgatgcccaccctgagctggtgcggcggcacctggtgaccttccgggccatgtctgcccggctgctggactatgtggtgaacattgctgacagcaatggaaacacagccctgcactacagcgtgtcccatgccaacttccctgtggtgcagcagctgctggacagcggcgtgtgcaaggtggacaagcagaacagagctggctacagccccatcatgctgacagccctggccaccctgaagacccaggatgacattgaaacagtgctgcagctgttccggctgggcaacatcaatgccaaggccagccaggccggccagacagccctgatgctggccgtgagccacggccgggtggatgtggtgaaggccctgctggcctgtgaggctgatgtgaatgtgcaggatgatgatggcagcacagccctgatgtgtgcctgtgagcacggccacaaggagattgctggcctgctgctggccgtgcccagctgtgacatcagcctgacagacagagatggcagcacagccctgatggtggccctggatgctggccagagcgagatcgcctccatgctgtacagcaggatgaacatcaagtgcagctttgcccccatgtctgatgatgagagccccaccagcagcagcgctgaggagtag

SEQ ID NO: 39554 - DNA, 2556 bp, Artificial Sequence; identical to SEQ ID NO: 39552
  Description of Artificial Sequence: Synthetic coding sequence

SEQ ID NO: 39555 - DNA, 2466 bp, Artificial Sequence
  Description of Artificial Sequence: Synthetic coding sequence
atggccaagtttgccctgaaccagaacctgcctgacctgggcggcccccggctgtgccctgtgcctgctgctgggggcgcccggagccccagcagcccctacagcgtggagaccccctacggcttccacctggacctggacttcctgaagtacatcgaggagctggagcggggccctgctgcccggcgggcccctggcccccccaccagcagaagaccccgggccccccggcccggcctggccggggcccggagccctggggcctggaccagcagcgagagcctggccagtgatgatggaggagcccctggcatcctgagccagggcgcccccagcggcctgctgatgcagcccctgagcccccgggcccctgtgaggaacccccgggtggagcacaccctgcgggagaccagccggcggctggagctggcccagacccatgagcgggcccccagccctggccggggcgtgcccaggagcccccggggcagcggccgcagcagccctgcccccaacctggccccagccagccctggccctgcccagctgcagctggtgcgggagcagatggccgccgccctgcggcggctgcgggagctggaggaccaggcccggaccctgcctgagctgcaggagcaggtgcgggccctgcgggcagagaaggcccggctgctggccggccgggcccagcctgagccagatggagaggccgagaccaggccagacaagctggcccagctgcggcggctgacagagcggctggccaccagcgagcggggcggccgggcccgggccagccccagggctgacagcccagatggcctggccgccggccgctctgagggcgccctgcaggtgctggatggagaggtgggcagcctggatggcaccccccagacccgggaggtggccgctgaggccgtgcctgagacccgggaggccggggcccaggccgtgcctgagacccgggaggccggcgtggaggccgcccctgagaccgtggaggctgatgcctgggtgacagaggccctgctgggcctgcctgctgctgctgagcgggagctggagctgctgcgggccagcctggagcaccagaggggcgtgtctgagctgctgcggggccgcctgcgggagctggaggaggcccgggaggccgctgaggaggccgctgctggggcccgggcccagctgcgggaggccaccacccagaccccctggagctgtgccgagaaggccgcccagacagagagccctgctgaggcccccagcctgacccaggagagcagccctggctccatggatggagacagagctgtggccccagctggcatcctgaagagcatcatgaagaagagagatggcacccctggggcccagcccagcagcggccccaagagcctgcagtttgtgggcgtgctgaatggagaatatgagagcagcagcagtgaagatgccagtgacagtgatggagacagtgaaaatggaggagctgagcccccaggcagcagcagcggcagcggagatgacagcggcggcggcagtgacagcggcaccccaggccccccatctggaggagacatccgggaccctgagcctgaggccgaggccgagccccagcaggtggcccagggccgctgtgagctgagcccccggctgcgggaggcctgtgtggccctgcagaggcagctgagccggccccggggcgtggccagtgatggcggcgctgtgcggctggtggcccaggagtggttccgggtgagcagccagaggaggagccaggccgagcctgtggccaggatgctggagggcgtgcggcggctgggccctgagctgctggcccacgtggtgaacctggctgatggaaatggaaacacagccctgcactacagcgtgagccacggcaacctggccatcgccagcctgctgctggacacaggagcctgtgaggtgaaccggcagaacagagctggctacagcgccctgatgctggccgccctgacctctgtgcggcaggaggaggaggacatggctgtggtgcagaggctcttctgcatgggagatgtgaatgccaaggccagccagacaggccagacagccctgatgctggccatcagccacggccggcaggacatggtggccaccctgctggcctgtggggctgatgtgaatgcccaggatgctgatggagccacagccctgatgtgtgcctctgaatatggccgcctggacacagtgcggctgctgctgacccagcccggctgtgaccctgccatcctggacaatgaaggcaccagcgccctggccatcgccctggaggccgagcaggatgaggtggccgccctgctgcacgcccacctgagcagcggccagcctgacacccagagcgagagccccccaggcagccagacagccaccccaggagagggggagtgtggggacaacggggagaacccccaggtgcagtag

SEQ ID NO: 39556 - DNA, 633 bp, Artificial Sequence
  Description of Artificial Sequence: Synthetic coding sequence
atggccacagccaggacagtggcccccagcccccgggtggccccccgggcccctggcatgacagctgctggggaccccacccgggcccccctggccctgcctgctgctggcaccagcggcaccctgagcccccggcggcggcagagcctgagccgctggcaccggggcggggagaggaggagcctggtggtgtggaggggcggcggctgccccccacctggaagacgctgccccaggagcatcctgagcctgtcctggccacccctgcaggtgcgggcagagcccgccagcgagggcggcgtgcgctctgctgctgctgctgctgagcccgcccccaggagcagtgatggcggcgctgtgcggctggtggcccaggagtggttccgggtgagcagccagaggaggagccaggccgagcctgtggccaggatgctggagggcgtgcggcggctgggccctgagctgctggcccacgtggtgaacctggctgatggaaatggaaacacagccctgcactacagcgtgagccacggcaacctggccatcgccagcctgctgctggacaccggccagagccagggccgggtgggccaccaggagatgggcggcggccggggccagggcctgacctag

SEQ ID NO: 39557 - DNA, 402 bp, Artificial Sequence
  Description of Artificial Sequence: Synthetic coding sequence
atgatcacccccctggccagcgctgagaccaatgaagacatggctgtggtgtggaagctgctgcgggagggcaatgtgaacatccaggccacccagggcggccagacagccctgatgctgggcgtgtcccatgaccgggaggacatggtgcaggccctgctgagctgccaggctgatgtgaacctgcaggaccatgatggcagcagcgccctgatggtggcctgccaccacggcaatgtggacctggtgcggctgctgctggcccacccagcctgtgacagcagcctgacagacaaggccggccgcacagccctgagcatcgccctgaagagccccacccacatggagattgctggcctgctgcgggcccatgctgagcagggccgcagcctgggcctgtag

SEQ ID NO: 39558 - DNA, 1104 bp, Artificial Sequence
  Description of Artificial Sequence: Synthetic coding sequence
atggagaagacagatgagatcagccccagcaccagcctgaagagcatcatgaagaagaaggactatggcttccgggccggcggcaatggcaccaagaagaacctgcagtttgtgggcgtgaatggaggctatgagaccaccagcagcgaggagaccagcggggaggacagcaccccagaggacctgagtgacagcgaggccgagaagaagtgtgatggccctgaccacaagcacgtgaaggatgcccacctgacctgtgaggccggccagggcatccctgagggcacctgccacgccgcccaggagagcggccctggagaggaggtgccccacagcaaggccgagcgctacaagcccagcgaggagttcctgaatgcctgccgggccctgagccagcacctgcctgagaccggcaccaccacagaccagctgctgcggcagagcctgaacaccatcagccaggagtggttccgggtgagcagcaggaagagcagcagccctgctgtggtggccagctacctgcacgaggtgcagccccacagcccccacttcctgaagctgctggtgaacctggccgaccacaatggaaacacagccctgcactacagcgtgagccacagcaacttcagcatcgtgaagctgctgctggagaccggggtgtgcaatgtggaccaccagaacaaggccggctacacagctgtgatgatcacccccctggccagcgctgagaccaatgaagacatggctgtggtgtggaagctgctgcgggagggcaatgtgaacatccaggccacccagggcggccagacagccctgatgctgggcgtgtcccatgaccgggaggacatggtgcaggccctgctgagctgccaggctgatgtgaacctgcaggaccatgatggcagcagcgccctgatggtggcctgccaccacggcaatgtggacctggtgcggctgctgctggcccacccagcctgtgacagcagcctgacagacaaggccggccgcacagccctgagcatcgccctgaagagccccacccacatggagattgctggcctgctgcgggcccatgctgagcagggccgcagcctgggcctgtag

SEQ ID NO: 39559 - DNA, 1056 bp, Artificial Sequence
  Description of Artificial Sequence: Synthetic coding sequence
atgaagaagaaggactatggcttccgggccggcggcaatggcaccaagaagaacctgcagtttgtgggcgtgaatggaggctatgagaccaccagcagcgaggagaccagcggggaggacagcaccccagaggacctgagtgacagcgaggccgagaagaagtgtgatggccctgaccacaagcacgtgaaggatgcccacctgacctgtgaggccggccagggcatccctgagggcacctgccacgccgcccaggagagcggccctggagaggaggtgccccacagcaaggccgagcgctacaagcccagcgaggagttcctgaatgcctgccgggccctgagccagcacctgcctgagaccggcaccaccacagaccagctgctgcggcagagcctgaacaccatcagccaggagtggttccgggtgagcagcaggaagagcagcagccctgctgtggtggccagctacctgcacgaggtgcagccccacagcccccacttcctgaagctgctggtgaacctggccgaccacaatggaaacacagccctgcactacagcgtgagccacagcaacttcagcatcgtgaagctgctgctggagaccggggtgtgcaatgtggaccaccagaacaaggccggctacacagctgtgatgatcacccccctggccagcgctgagaccaatgaagacatggctgtggtgtggaagctgctgcgggagggcaatgtgaacatccaggccacccagggcggccagacagccctgatgctgggcgtgtcccatgaccgggaggacatggtgcaggccctgctgagctgccaggctgatgtgaacctgcaggaccatgatggcagcagcgccctgatggtggcctgccaccacggcaatgtggacctggtgcggctgctgctggcccacccagcctgtgacagcagcctgacagacaaggccggccgcacagccctgagcatcgccctgaagagccccacccacatggagattgctggcctgctgcgggcccatgctgagcagggccgcagcctgggcctgtag

SEQ ID NO: 39560 - DNA, 2988 bp, Artificial Sequence
  Description of Artificial Sequence: Synthetic coding sequence
atggagaagacagatgccaaggaccagagcagccagggagatgaggagaaggacccccccaagagccacccctacagcgtggagaccccctacggcttccacctggacctggacttcctgaagtatgtggatgacatcgagaagggcaacaccatcaagaggatccccatccacagaagagccaagcaggccaagttcagcaccctgcccaggaacttcagcctgcctgacagcggggcccggcccccagctgccccacccctgcagaactggagccctgtggtgccccgggaggccagcctgggcacccaggagcagaaccagagcccccccctgggcaatgccccccaggccagcaccagccgctctgaggtgtcctaccacaggaaggccctgctggccgaggccacccggcagctggaggccgctgagccagaagatgctgagctgaccttcggcagcggccggccccagctgctgcgggccagctccatgcctgccaccctgctgcacagccgggccagcgaggagcccggcctgagcctgggccccccagcccccccagccctgccccccctgcagggcgagggctctgtgtgtgatggcacctttgagcctgctgagggcctggccggcttccacagcagcagcccccgggccagcacccgcatccctgagctggtgcaggagggcgctgagcccccagagggcgtggtgaaggtgcccaaccacctgcccctgcccggcccccccttctccttccagaatgtgctggtggtgctggaggacaaggaggatgagcacaatgcccgggaggccgaggtgctcttcaccccaggcagccccacccccagccccccacccctgcccagccccatcccagaaaatgagctgctgctggaggagattgagctgaacatcagcgagatccccccacctcctcctgtggaggtggacatgaggagcatcggcatccgggtgacagaggagagcctgggcctggcccgggtggaccccggcagcatcagcagcctgaagcagcaggtgtctgccctggagggggagctgagcggccgcacagaggagctggcccaggtgaggacagccctgcagcagcaggaggaggagatcaaggcccgggagcagaggatccgggagctggagttcaccgtggcccagctggagggccagttccaccaggagaatgccaaggacacccagggccagacagatgtgatggtgaacacagatcctgtgcacggcctgctgacccgggagagctgtgacaagggcatcgaggtgaacctgctgggctccatggagagcgagagctggggccacagaggagaagaaaatggcctgctgtggggcccagatggccacaagcagggcaaccagagccctgctgagcgggtgctgctgccccagctgagcctgccccagggccctgagcaggtgctgaccagctctgtgcacagcttcctgagcacagagctgagaattgaggaggccggcacagagcaggagggcggcccccagggcggcaccagaggagctgggggcttcctgtggggcagtgacaggaagaccccacctgctggccgggaggagaccagcagcaacctgcccgggaaggagcaccctggccggccccccagcagccccacagatgccaccatcggccagtatgtgaagaagatccaggagctgctgcaggagcagtggaactgcctggagcacggctacccagagctggccagcgccatcaagcagcctgccagcaagctgagcagcatccagagccagctgctgagcagcctgaacctgctgctgagcgcctacagcgcccaggcccacccccccaaggagcccccagccagcagcagcagcccccctgtggagatcagccccagcaccagcctgaagagcatcatgaagaagaaggactatggcttccgggccggcggcaatggcaccaagaagaacctgcagtttgtgggcgtgaatggaggctatgagaccaccagcagcgaggagaccagcggggaggacagcaccccagaggacctgagtgacagcgaggccgagaagaagtgtgatggccctgaccacaagcacgtgaaggatgcccacctgacctgtgaggccggccagggcatccctgagggcacctgccacgccgcccaggagagcggccctggagaggaggtgccccacagcaaggccgagcgctacaagcccagcgaggagttcctgaatgcctgccgggccctgagccagcacctgcctgagaccggcaccaccacagaccagctgctgcggcagagcctgaacaccatcagccaggagtggttccgggtgagcagcaggaagagcagcagccctgctgtggtggccagctacctgcacgaggtgcagccccacagcccccacttcctgaagctgctggtgaacctggccgaccacaatggaaacacagccctgcactacagcgtgagccacagcaacttcagcatcgtgaagctgctgctggagaccggggtgtgcaatgtggaccaccagaacaaggccggctacacagctgtgatgatcacccccctggccagcgctgagaccaatgaagacatggctgtggtgtggaagctgctgcgggagggcaatgtgaacatccaggccacccagggcggccagacagccctgatgctgggcgtgtcccatgaccgggaggacatggtgcaggccctgctgagctgccaggctgatgtgaacctgcaggaccatgatggcagcagcgccctgatggtggcctgccaccacggcaatgtggacctggtgcggctgctgctggcccacccagcctgtgacagcagcctgacagacaaggccggccgcacagccctgagcatcgccctgaagagccccacccacatggagattgctggcctgctgcgggcccatgctgagcagggccgcagcctgggcctgtag

SEQ ID NO: 39561 - DNA, 387 bp, Artificial Sequence
  Description of Artificial Sequence: Synthetic coding sequence
atgatgacagctgtgtccctgaccacccggccccaggagagcgtggcctttgaagatgtggccgtgtacttcaccaccaaggagtgggccatcatggtgcctgctgagcgggccctgtacagagatgtgatgctggagaactatgaggccgtggcctttgtggtgccccccaccagcaagccagccctggtgagccacctggagcagggcaaggagagctgcttcacccagccccagggcgtgctgagcagaaatgactggagggctggctggattggctacctggagctgcggcgctacacctacctggccaaggctgtgctgcggagaattgtgtccaagatcttcaggaaccggcagtgctgggaggacaggaggaaggcctag

SEQ ID NO: 39562 - DNA, 387 bp, Artificial Sequence; identical to SEQ ID NO: 39561
  Description of Artificial Sequence: Synthetic coding sequence

SEQ ID NO: 39563 - DNA, 387 bp, Artificial Sequence; identical to SEQ ID NO: 39561
  Description of Artificial Sequence: Synthetic coding sequence

SEQ ID NO: 39564 - DNA, 3090 bp, Artificial Sequence
  Description of Artificial Sequence: Synthetic coding sequence
atgagagaaaattatgagaccctggtgtctgtgggcacagctgagctgctgcccctgagcgccttcctgagccccagcgagcccggccgggctgtgggcggcggcagccatgctgatgagggccaggagcctgctggctgtggggacccccagggcggccagcccaggcacagcctgcacctgacagccctggtgcagctggtgaaggagatccctgagttcctgtttggagaggtgaagggggccatggacagccctgagagcgagagcagaggagccagcctggatggagagcgggccagccctgaggccgccgccgcccgggagccctgccccctgcggggcctgctgagctgcctgcctgatggccccaccagccagccccacctggccaccacccccacagacagcagctgcagcagcggccccactggagatggagtgcagggcagccccctgcccatcaagacagctgacaagccctggcccaccaggaaggagggccctggggccctgggcggggagcccagcccccccacccacagccccagcaggaggaagagccaccggggccaggagcggggcaccagcgaggccggcatcagccctggcaacagccccctgcagggcctcatcaactgcctgaaggagatcctggtgcccggccccaggcaccctgagaccagccccagcttcctgccccccctgcccagcctgggcaccagccggctgaccagggctgacctgggccctggcagccccccctgggccgtgaagacagaggccgtgtctggggactgccccctgcagggcctgctgcactgcctgaaggagctgcctgaggcccaggacagacaccccagccccagcggcgtgggcaacagaaggctgcaggagaaccctggggcctggaagaggggcagcggcggccctggctacctgctgaccccaccaccccacccagacctgggcgccggcggcctgctgtctgtgaagatggagaacagctgggtgcagagccccccaggccctgccagctgccagcccggccggcagcccctgagccccagcgccactggagacacccggggcgtgccccagcccagctggggccctgaggcccaggccgccagcgccagcagcagccccctggaggccctggaggcctgcctgaagggcatccccccaaatggcagcagccccagccagctgccccccaccagctgcagccagaacccccagcccggggacagccgcagccagaagccagagctgcagccccacaggagccacagcgaggaggccacccgggagcctgtgctgcccctgggcctgcagagctgtgtgagagatggccccagccggcccctggccccccggggcacccccaccagcttcagcagcagcagcagcacagactgggacctggactttggcagccctgtgggcaaccagggccagcaccctgggaagggcagccccccaggcagcagccccctgcagggcctggagaactgcctgaaggagatccctgtgcctgtgctgcggcctgcctggccctgcagcagcgctgctgaccggggcccccggcgggcagagcccaggaactggacagctgacaaggagggcctgcgggcagaggcctgtgagagccggctgggccagggccgcggggaggcccccaccaggagcctgcacctggtgagcccccaggtgttcaccagcagctgtgtgcctgcctgccaccagaggggcttcaaggaccccggggccaccaggcctggggtgtggcgctggctgcctgagggcagcgcccccaagcccagccccctgcactgcctggagagcgccctgcggggcatcctgcctgtgcggcccctgcgctttgcctgtgtgggcggccccagccccagccccagccctggcagcagcagcagcttcagcggctctgaaggagaggaccccaggcctgagccagacctgtggaagcccctgccccaggagcgggaccggctgcccagctgcaagccccctgtgcccctgagcccctgccctgggggcaccccagctggcagcagcggcggcagccctggagaggaccccaggagaacagagccccgctactgcagcggcctgggcgccggcacagcccaggacccctgccctgtgtcccagctggagaagaggccccgggtgtctgaggccagccggggcctggagctgggccacggccggccccgggtggccgccaagacccatgagcggctgctgccccagggccccccagagctgcccagcgagagccccccacctgagctgcccccacctgaggccgcccctcctgtgctgcctgccagcagcctgcagcccccctgccactgtgggaagcccctgcagcaggagctgcacagcctgggcgccgccctggccgagaagctggaccggctggccacagccctggccggcctggcccaggaggtggccaccatgaggacccaggtgaaccggctgggcagaagaccccagggccctggccccatgggccaggcctcctggatgtggaccctgccccggggcccccgctgggcccacggccctggccaccgccacctgccctactggaggcagaagggccccacccggcccaagcccaagatcctgcggggccagggcgagagctgccgggccggggacctgcagggcctgagccggggcacagcccggcgggcccggcccctgcccccagatgcccccccagctgagcccccaggcctgcactgcagcagcagccagcagctgctgagcagcacccccagctgccacgccgcccccccagcccaccccctgctggcccacactggaggccaccagagccccctgccccccctggtgcctgctgccctgcccctgcagggcgccagccccccagctgccagcgcagatgctgatgtgcccaccagcggcgtggccccagatggcatccctgagcggcccaaggagcccagcagcctgctgggcggcgtgcagagggccctgcaggaggagctgtggggcggggagcaccgggacccccgctggggcgcccactag

SEQ ID NO: 39565 - DNA, 2910 bp, Artificial Sequence
  Description of Artificial Sequence: Synthetic coding sequence
atgagagaaaattatgagaccctggtgtctgtgggcacagctgagctgctgcccctgagcgccttcctgagccccagcgagcccggccgggctgtgggcggcggcagccatgctgatgagggccaggagcctgctggctgtggggacccccagggcggccagcccaggcacagcctgcacctgacagccctggtgcagctggtgaaggagatccctgagttcctgtttggagaggtgaagggggccatggacagccctgagagcgagagcagaggagccagcctggatggagagcgggccagccctgaggccgccgccgcccgggagccctgccccctgcggggcctgctgagctgcctgcctgatggccccaccagccagccccacctggccaccacccccacagacagcagctgcagcagcggccccactggagatggagtgcagggcagccccctgcccatcaagacagctgacaagccctggcccaccaggaaggagggccctggggccctgggcggggagcccagcccccccacccacagccccagcaggaggaagagccaccggggccaggagcggggcaccagcgaggccggcatcagccctggcaacagccccctgcagggcctcatcaactgcctgaaggagatcctggtgcccggccccaggcaccctgagaccagccccagcttcctgccccccctgcccagcctgggcaccagccggctgaccagggctgacctgggccctggcagccccccctgggccgtgaagacagaggccgtgtctggggactgccccctgcagggcctgctgcactgcctgaaggagctgcctgaggcccaggacagacaccccagccccagcggcgtgggcaacagaaggctgcaggagaaccctggggcctggaagaggggcagcggcggccctggctacctgctgaccccaccaccccacccagacctgggcgccggcggcctgctgtctgtgaagatggagaacagctgggtgcagagccccccaggccctgccagctgccagcccggccggcagcccctgagccccagcgccactggagacacccggggcgtgccccagcccagctggggccctgaggcccaggccgccagcgccagcagcagccccctggaggccctggaggcctgcctgaagggcatccccccaaatggcagcagccccagccagctgccccccaccagctgcagccagaacccccagcccggggacagccgcagccagaagccagagctgcagccccacaggagccacagcgaggaggccacccgggagcctgtgctgcccctgggcctgcagagctgtgtgagagatggccccagccggcccctggccccccggggcacccccaccagcttcagcagcagcagcagcacagactgggacctggactttggcagccctgtgggcaaccagggccagcaccctgggaagggcagccccccaggcagcagccccctgcagggcctggagaactgcctgaaggagatccctgtgcctgtgctgcggcctgcctggccctgcagcagcgctgctgaccggggcccccggcgggcagagcccaggaactggacagctgacaaggagggcagcgcccccaagcccagccccctgcactgcctggagagcgccctgcggggcatcctgcctgtgcggcccctgcgctttgcctgtgtgggcggccccagccccagccccagccctggcagcagcagcagcttcagcggctctgaaggagaggaccccaggcctgagccagacctgtggaagcccctgccccaggagcgggaccggctgcccagctgcaagccccctgtgcccctgagcccctgccctgggggcaccccagctggcagcagcggcggcagccctggagaggaccccaggagaacagagccccgctactgcagcggcctgggcgccggcacagcccaggacccctgccctgtgtcccagctggagaagaggccccgggtgtctgaggccagccggggcctggagctgggccacggccggccccgggtggccgccaagacccatgagcggctgctgccccagggccccccagagctgcccagcgagagccccccacctgagctgcccccacctgaggccgcccctcctgtgctgcctgccagcagcctgcagcccccctgccactgtgggaagcccctgcagcaggagctgcacagcctgggcgccgccctggccgagaagctggaccggctggccacagccctggccggcctggcccaggaggtggccaccatgaggacccaggtgaaccggctgggcagaagaccccagggccctggccccatgggccaggcctcctggatgtggaccctgccccggggcccccgctgggcccacggccctggccaccgccacctgccctactggaggcagaagggccccacccggcccaagcccaagatcctgcggggccagggcgagagctgccgggccggggacctgcagggcctgagccggggcacagcccggcgggcccggcccctgcccccagatgcccccccagctgagcccccaggcctgcactgcagcagcagccagcagctgctgagcagcacccccagctgccacgccgcccccccagcccaccccctgctggcccacactggaggccaccagagccccctgccccccctggtgcctgctgccctgcccctgcagggcgccagccccccagctgccagcgcagatgctgatgtgcccaccagcggcgtggccccagatggcatccctgagcggcccaaggagcccagcagcctgctgggcggcgtgcagagggccctgcaggaggagctgtggggcggggagcaccgggacccccgctggggcgcccactag

SEQ ID NO: 39566 - DNA, 312 bp, Artificial Sequence
  Description of Artificial Sequence: Synthetic coding sequence
atgagagaaaattatgagaccctggtgtctgtgggcacagctgagctgctgcccctgagcgccttcctgagccccagcgagcccggccgggctgtgggcggcggcagccatgctgatgagggccaggagcctgctggctgtggggacccccagggcggccagcccaggcacagcctgcacctgacagccctggtgcagctggtgaaggagatccctgagttcctgtttggagaggtgaagggggccatggacagccctgagagcgagagcagaggagccagcctggatggagagcgggccagccctgagtag

SEQ ID NO: 39567 - DNA, 1479 bp, Artificial Sequence
  Description of Artificial Sequence: Synthetic coding sequence
atgcccagcttcctggtgcccagcctggtgagcagccctgtgctgctgaagctgctcttcagccctggccccaagaccatctggagcctgtggcagcagcccatgctgttccaggaggccacagcctttgagaacatgaccaaggactggaactacctggagggcagccagaaggactgctacagagacaccatgctggacagctatgagaacacagtgccccagggcagcttcctgcagctgtccatgatgccccagagagctggaaatgaccccccaggagtgtccaatgccagcgagatggagatggagatcagcaacatgagggagaagttcctgatgtctgtgaccaagctggtggagagcaagagctacaacagcaaggtgttcagcaaggagaagtacttccagaccatcaaggaggtgaaggaggccaaggagaagggcaagaagagcagccgggactacagaagagctgccaagtatgatgtgatctctgtgcagggcacagagaagctgattgaggccacccacggggagcgggaccgcatccgctactacgtgcacaaggaggagctgtttgacatcctgcatgacacccacctgagcatcggccacggcggccgcaccaggatgctgaaggagctgcagggcaagtatggaaatgtgaccaaggaggtgattgtgctgtacctgaccctgtgcaagcagtgccaccagaagaaccctgtgcccaagaggggcctggcccccaagcccatgaccttcaaggacatcgacagcacctgccaggtggagatcctggacatgcagagcagcgcagatggagagttcaagttcatcctgtactaccaggaccacagcaccaagttcatcatcctgcggcccctgcggaccaagcaggcccacgaggtggtgtctgtgctgctggacatcttcaccatcctgggcacccccagcgtgctggacagcgacagcggcgtggagttcaccaaccaggtggtgcatgagctgaatgagctgtggccagacctgaagatcgtgtctgggaagtaccaccctggccagagccagggcagcctggagggcgccagcagagatgtgaagaacatgatcagcacctggatgcagagcaaccacagctgccactgggccaagggcctgcgcttcatgcagatggtgaggaaccaggcctttgatgtgtccctgcagcagagcccctttgaggccatgtttggctacaaggccaagtttggcctgtacagcagcaacctgccccgggagaccgtggccaccctgcagacagaggaggagctggagattgctgaggagcagctggagaacagcctgtggatccggcaggaggagcgggcagagatcggggctgacagaagtgacatggatgatgacatggaccccaccccagaggccagcgagcccagcaccagccagggcaccagcggcctgctgtgctggtag

SEQ ID NO: 39568 - DNA, 1233 bp, Artificial Sequence
  Description of Artificial Sequence: Synthetic coding sequence
atgatgccccagagagctggaaatgaccccccaggagtgtccaatgccagcgagatggagatggagatcagcaacatgagggagaagttcctgatgtctgtgaccaagctggtggagagcaagagctacaacagcaaggtgttcagcaaggagaagtacttccagaccatcaaggaggtgaaggaggccaaggagaagggcaagaagagcagccgggactacagaagagctgccaagtatgatgtgatctctgtgcagggcacagagaagctgattgaggccacccacggggagcgggaccgcatccgctactacgtgcacaaggaggagctgtttgacatcctgcatgacacccacctgagcatcggccacggcggccgcaccaggatgctgaaggagctgcagggcaagtatggaaatgtgaccaaggaggtgattgtgctgtacctgaccctgtgcaagcagtgccaccagaagaaccctgtgcccaagaggggcctggcccccaagcccatgaccttcaaggacatcgacagcacctgccaggtggagatcctggacatgcagagcagcgcagatggagagttcaagttcatcctgtactaccaggaccacagcaccaagttcatcatcctgcggcccctgcggaccaagcaggcccacgaggtggtgtctgtgctgctggacatcttcaccatcctgggcacccccagcgtgctggacagcgacagcggcgtggagttcaccaaccaggtggtgcatgagctgaatgagctgtggccagacctgaagatcgtgtctgggaagtaccaccctggccagagccagggcagcctggagggcgccagcagagatgtgaagaacatgatcagcacctggatgcagagcaaccacagctgccactgggccaagggcctgcgcttcatgcagatggtgaggaaccaggcctttgatgtgtccctgcagcagagcccctttgaggccatgtttggctacaaggccaagtttggcctgtacagcagcaacctgccccgggagaccgtggccaccctgcagacagaggaggagctggagattgctgaggagcagctggagaacagcctgtggatccggcaggaggagcgggcagagatcggggctgacagaagtgacatggatgatgacatggaccccaccccagaggccagcgagcccagcaccagccagggcaccagcggcctgctgtgctggtag

SEQ ID NO: 39569 - DNA, 2130 bp, Artificial Sequence
  Description of Artificial Sequence: Synthetic coding sequence
atgggccacaggacagccatgcctgagccccggggcagcagccagctgcgggtgaatgctgcctttgctgcccgctacaaccgctaccgggagcgggaggagctgcagaggctgaaggaccgctacggggaccgggacagcagcagtgacagcagcagcgagagtgacagcagtgatgagcgggtggagtttgacccccagcaggagcgggacttctacaagaccctgagcctgctgaagaagaaggacccccgcatctaccagaaggatgccaccttctacaacagaacagccagcagcagtgacagtgaagaagatcctgaggccctggagaagcagaagaaggtgcggcccatgtacctgaaggactatgaaaggaaggtgatcctggagaaggccggcaagtatgtggatgaggagaacagtgatggagagaccagcaaccaccggctgcaggagaccagcagccagagctatgtggaggagcagaagcagctgaaggagagcttccgggcctttgtggaggacagtgaagatgaagatggagctggggagggcggcagcagcctgctgcagaagagggccaagacccggcaggagaaggcccaggaggaggccgactacatcgagtggctgaagggccagaaggagatcagaaatccagacagcctgaaggagctgacccacctgaaggagtactggaatgaccctgagctggatgaaggagagcgcttcctgcgggactacatcctgaacaagagatatgaggaggaggaggaggaggaggaggatgaggaggagatggaggaggaggagggcgtgcacggcccccctgtgcagctggccgtggatgacagcagtgatgaaggagagctgttcctgaagaagcaggaggactttgagcagaagtacaacttccgctttgaggagccagattctgcctctgtgaagacctaccccaggagcatcgccagctctgtgcggaggaaggatgaaagaaggaaggagaagcgggaggagacccgggagaggaagaagcgggagaaggccaagaagcaggaggagctgaagcagctgaagaacctgaagaggaaggagatcctggccaagctggagaagctgaggaaggtgactggaaatgagatgctgggcctggaggagggggacctggaggatgactttgatcctgcccagcacgaccagctgatgcagaagtgctttggagatgagtactacggggctgtggaggaggagaagccccagtttgaggaggaggagggcctggaggatgactggaactgggacacctgggatggccctgagcaggagggggactggagccagcaggagctgcactgtgaggaccccaacttcaacatggatgctgactatgaccccagccagcccaggaagaagaagcgggaggcccccctgaccgggaagaagaagaggaagagcccctttgctgctgctgtgggccaggagaagcctgtgtttgagcccggggacaagacctttgaggagtacctggatgagtactaccgcctggactatgaggacatcattgatgacctgccctgccgcttcaagtacagaacagtggtgccctgtgactttggcctgagcacagaggagatcctggccgcagatgacaaggagctgaaccgctggtgcagcctgaagaagacctgcatgtacagaagtgagcaggaggagctgcgggacaagagggcctacagccagaaggcccagaacagctggaagaagaggcaggtgttcaagagcctgtgccgggaggaggccgagaccccagctgaggccaccgggaagccccagagagatgaggccggcccccagaggcagctgcctgccctggatggcagcctgatgggccctgagagccccccagcccaggaggaggaggcccctgtgagcccccacaagaagccagccccccagaagagaagaagagccaagaaggcccggctgctgggccccaccgtgatgctgggcggctgtgagttcagccggcagaggctgcaggccttcggcctgaaccccaagaggctgcacttccggcagctgggccggcagaggaggaagcagcagggccccaagaacagcagctag

SEQ ID NO: 39570 - DNA, 1749 bp, Artificial Sequence
  Description of Artificial Sequence: Synthetic coding sequence
atgggccacaggacagccatgcctgagccccggggcagcagccagctgcgggtgaatgctgcctttgctgcccgctacaaccgctaccgggagcgggaggagctgcagaggctgaaggaccgctacggggaccgggacagcagcagtgacagcagcagcgagagtgacagcagtgatgagcgggtggagtttgacccccagcaggagcgggacttctacaagaccctgagcctgctgaagaagaaggacccccgcatctaccagaaggatgccaccttctacaacagaacagccagcagcagtgacagtgaagaagatcctgaggccctggagaagcagaagaaggtgcggcccatgtacctgaaggactatgaaaggaaggtgatcctggagaaggccggcaagtatgtggatgaggagaacagtgatggagagaccagcaaccaccggctgcaggagaccagcagccagagctatgtggaggagcagaagcagctgaaggagagcttccgggcctttgtggaggacagtgaagatgaagatggagctggggagggcggcagcagcctgctgcagaagagggccaagacccggcaggagaaggcccaggaggaggccgactacatcgagtggctgaagggccagaaggagatcagaaatccagacagcctgaaggagctgacccacctgaaggagtactggaatgaccctgagctggatgaaggagagcgcttcctgcgggactacatcctgaacaagagatatgaggaggaggaggaggaggaggaggatgaggaggagatggaggaggaggagggcgtgcacggcccccctgtgcagctggccgtggatgacagcagtgatgaaggagagctgttcctgaagaagcaggaggactttgagcagaagtacaacttccgctttgaggagccagattctgcctctgtgaagacctaccccaggagcatcgccagctctgtgcggaggaaggatgaaagaaggaaggagaagcgggaggagacccgggagaggaagaagcgggagaaggccaagaagcaggaggagctgaagcagctgaagaacctgaagaggaaggagatcctggccaagctggagaagctgaggaaggtgactggaaatgagatgctgggcctggaggagggggacctggaggatgactttgatcctgcccagcacgaccagctgatgcagaagtgctttggagatgagtactacggggctgtggaggaggagaagccccagtttgaggaggaggagggcctggaggatgactggaactgggacacctgggatggccctgagcaggagggggactggagccagcaggagctgcactgtgaggaccccaacttcaacatggatgctgactatgaccccagccagcccaggaagaagaagcgggaggcccccctgaccgggaagaagaagaggaagagcccctttgctgctgctgtgggccaggagaagcctgtgtttgagcctggagaggcccaggtgggccggccctgggtgggccggggccacagaggagcctggcacagccctgctgcctggctgtgcctggagcagggcaccaggaggagccgcagcacctggatgagcatcaccggctggaccaccaggaccagcagcaccacctgccctgtggccagcagcacagcccagtggtgccctgtgaccctggccagcgccctgcggcgcagcagcctgctgaccatccgctcctag

SEQ ID NO: 39571 - DNA, 1065 bp, Artificial Sequence
  Description of Artificial Sequence: Synthetic coding sequence
atgcccctggtggtgttctgtggcctgccctacagcggcaagagccggcgggcagaggagctgcgggtggccctggccgctgagggccgggctgtgtatgtggtggatgatgctgctgtgctgggcgctgaggaccctgctgtgtatggagacagcgcccgggagaaggccctgcggggggccctgcgggcctctgtggagcggcggctgagcagacatgatgtggtgatcctggacagcctgaactacatcaagggcttccgctatgagctgtactgcctggcccgggccgcccggacccccctgtgcctggtgtactgtgtgcggcctgggggccccatcgccggcccccaggtggccggggccaatgaaaatcctggaagaaatgtgtctgtgtcctggaggcccagggctgaggaggatggccgggcccaggccgccggcagctctgtgctgcgggagctgcacacagctgacagcgtggtgaatggaagtgcccaggctgatgtgcccaaggagctggagcgggaggagagcggggctgctgagagccctgccctggtgaccccagacagcgagaagagcgccaagcacggcagcggggccttctacagccctgagctgctggaggccctgaccctgcgctttgaggccccagacagcaggaaccgctgggaccggcccctcttcaccctggtgggcctggaggagcccctgcccctggccggcatccgcagcgccctgtttgagaacagagcccccccaccccaccagagcacccagagccagcccctggccagcggcagcttcctgcaccagctggaccaggtgaccagccaggtgctggccggcctgatggaggcccagaagtctgctgtgcctggggacctgctgaccctgcccggcaccacagagcacctgcgcttcacccggcccctgaccatggccgagctgagccggctgcggcggcagttcatctcctacaccaagatgcaccccaacaatgaaaacctgccccagctggccaacatgttcctgcagtacctgagccagagcctgcactag

SEQ ID NO: 39572 - DNA, 162 bp, Artificial Sequence
  Description of Artificial Sequence: Synthetic coding sequence
atggaggccgccggcggcttccaggtgcacttccaccccagcaatggagatggccgcttcatcgagaccagcagcgctgctgacctggaggtgatctcctacagcagcaaggtgtctgtgacagagcgctgcttcatcaaggtgtgcaccgtgctcttctag

SEQ ID NO: 39573 - DNA, 162 bp, Artificial Sequence; identical to SEQ ID NO: 39572
  Description of Artificial Sequence: Synthetic coding sequence

SEQ ID NO: 39574 - DNA, 1041 bp, Artificial Sequence
  Description of Artificial Sequence: Synthetic coding sequence
atggacatgctggaccccggcctggaccctgctgccagcgccacagctgctgctgctgccagccatgacaagggccctgaggccgaggagggcgtggagctgcaggagggcggagatggccctggagctgaggagcagacagctgtggccatcacctctgtgcagcaggccgcctttggagaccacaacatccagtaccagttcagaacagagaccaatggaggccaggtgacctacagagtggtgcaggtgacagatggccagctggatggccagggcgacacagctggagctgtgtctgtggtgtccacagctgcctttgctgggggccagcaggccgtgacccaggtgggcgtggatggagctgcccagaggcctggccctgctgctgcctctgtgcccccaggccctgctgcccccttccccctggccgtcatccagaaccccttcagcaatggaggcagccctgctgctgaggccgtgtctggagaggccaggtttgcctacttccctgccagctctgtgggggacaccacagctgtgtctgtgcagaccacagaccagagcctgcaggccggcggccagttctacgtgatgatgaccccccaggatgtgctgcagacaggcacccagaggaccatcgcccccaggacccacccctacagccccaagattgatggcaccaggaccccaagagatgaaagaagaagagcccagcacaatgaggtggagaggagaagaagagacaagatcaacaactggatcgtgcagctgagcaagatcatcccagactgcaatgctgacaacagcaagacaggagccagcaagggcggcatcctgagcaaggcctgtgactacatccgggagctgcggcagaccaaccagaggatgcaggagaccttcaaggaggccgagcggctgcagatggacaatgagctgctgcggcagcagatcgaggagctgaagaatgaaaatgccctgctgcgggcccagctgcagcagcacaacctggagatggtgggggagggcacccggcagtag

SEQ ID NO: 39575 - DNA, 531 bp, Artificial Sequence
  Description of Artificial Sequence: Synthetic coding sequence
atggacctgcctgacagcgccagcagggtcttctgtggccgcatcctgtccatggtgaacacagatgatgtgaatgccatcatcctggcccagaagaacatgctggacagatttgagaagaccaatgagatgctgctgaacttcaacaacctgagcagcgcccggctgcagcagatgtctgagcgcttcctgcaccacaccaggaccctggtggagatgaagagggacctggacagcatcttccgccgcatccgcaccctgaagggcaagctggcccggcagcaccctgaggccttcagccacatccctgaggccagcttcctggaggaggaggatgaggaccccatcccccccagcaccaccaccaccatcgccaccagcgagcagagcacaggcagctgtgacaccagcccagacacagtgagccccagcctgagccctggctttgaggacctgagccacgtgcagcccggcagccctgccatcaatggccgcagccagacagatgatgaggagatgaccggggagtag

SEQ ID NO: 39576 - DNA, 531 bp, Artificial Sequence; identical to SEQ ID NO: 39575
  Description of Artificial Sequence: Synthetic coding sequence

SEQ ID NO: 39577 - DNA, 432 bp, Artificial Sequence
  Description of Artificial Sequence: Synthetic coding sequence
atgagagatgctgatgctgatgctgggggcggcgcagatggaggagatggccggggcggccacagctgccggggcggcgtggacacagctgctgccccagctgggggcgcccccccagcccacgcccctggccctggaagagatgctgccagcgctgcccggggcagcaggatgaggccccacatcttcaccctgtctgtgcccttccccacccccctggaggccgagatcgcccacggcagcctggccccagatgctgagccccaccagagggtggtgggcaaggacctgactgtgtctggccgcatcctggtggtgcgctggaaggccgaggactgccgcctgctgcgcatcagcgtcatcaacttcctggaccagctgagcctggtggtgaggaccatgcagagatttggacctcctgtgtccaggtag

SEQ ID NO: 39578 - DNA, 3747 bp, Artificial Sequence
  Description of Artificial Sequence: Synthetic coding sequence
atggtggtggccctgcgctacgtgtggcccctgctgctgtgcagcccctgcctgctgatccagatccctgaggagctgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcactggaaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccacccagcgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggccttcggggcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacattgaatttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgaaacagtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaaaggacctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaacggggtgctgaccggctacgtgctgagctaccaccccctggatgagggcggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaacggcaccggccgggtgcggctgcccccagctggctttgccacagagggctggttcatcggctttgtgtctgccatcatcctgctgctgctggtgctgctgatcctgtgcttcatcaagaggagcaagggcggcaagtacagcgtgaaggacaaggaggacacccaggtggacagcgaggcccggcccatgaaggatgagaccttcggggagtacagcgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 39579 - DNA, 3774 bp, Artificial Sequence
  Description of Artificial Sequence: Synthetic coding sequence
atggtggtggccctgcgctacgtgtggcccctgctgctgtgcagcccctgcctgctgatccagatccctgaggagtatgagggccaccacgtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggcctttggagcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacatcgagtttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgagaccgtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaagggccctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaatggagtgctgaccggctacgtgctgagctaccaccccctggatgaaggaggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaatggaacaggccgggtgcggctgcccccagctggctttgccacagagggctggttcatcggctttgtgtctgccatcatcctgctgctgctggtgctgctgatcctgtgcttcatcaagaggagcaaaggaggcaagtacagcgtgaaggacaaggaggacacccaggtggacagcgaggcccggcccatgaaggatgagacctttggagagtaccgcagcctggagagtgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 39580 - DNA, 1338 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgagggcaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagaacagagtgaagccccagttccgcagcagcggcggcagcgagcacagcacagagggctctgtgtccctgggagatggccagctgaaccgctacagcagcaggaacttccctgctgagcggcacaaccccaccgtgacaggccaccaggagcagacctacctgcagaaggagaccagcaccctgcaggtggagcagaatggagactatggccggggccgctag

SEQ ID NO: 39581 - DNA, 2568 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagaggggctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcaccggggtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagagagcgcccccaacagccccagaattggcagccccctgagccccaagaagaacagcgagaccagcatcctgcaggccatgagccggggcctgagcaccagcctgcctgacctggacagcgagccctggattgaggtgaagaagaggcaccagcctgcccctgtgaagctgcgggagagcgtgtctgtgcctgagggcagcctgaaccagctgtgcagcagcgaggagcctgagcaggaggagctggacttcctgtttgatgaggagattgagcagattggaaggaagaacaccttcacagactggagcgacaatgacagcgactatgaaattgatgaccaggacctgaacaagatcctgattgtgacccagaccccaccctacgtgaagaagcaccctggaggagacagaacaggcacccacatgagccgggccaagatcaccagcgagctggccaaggtgatcaatgatggcctgtactactatgagcaggacctgtggatggaggaggatgagaacaagcacacagccatcaagcaggaggtggagaacttcaagaagctgaacctgatcagcaaggagcagtttgagaacctgaccccagagctgccctttgagcccaaccaggaggtgcctgtggcccccagccagagccggcaggacctgacagatgagctggcccagaagctgtttgatgtgtctgagatcaccagcgctgccatggtgcacagcctgcccacagctgtgcctgagagcccccgcatccaccccaccaggacccccaagacccccaggaccccccggctgcaggaccccaacaagaccccccgcttctaccctgtggtgaaggagcccaaggccattgatgtgaagagccccaggaagaggaagaccaggcacagcaccaacccccccctggagtgccacgtgggctgggtgatggacagccgggaccggggccctggcaccagctctgtgtccaccagcaatgccagccccagcgagggcgcccccctggccggcagctatggctgcaccccccacagcttccccaagttccagcaccccagccatgagctgctgaaggaaaatggcttcacccagcaggtgtaccacaagtacagaagacgctgcctgtctgagaggaagaggctgggcatcggccagagccaggagatgaacaccctcttccgcttctggagcttcttcctgcgggaccacttcaacaagaagatgtatgaggagttccggcagctggcctgggaggatgccaaggagaactaccgctatggcctggagtgcctcttccgcttctacagctatggcctggagaagaagttccggcgggagatcttccaggacttccaggaggagaccaagaaggactatgaaagtggccagctgtatggcctggagaagttctgggcctacctgaagtacagccagagcaagacccagagcattgaccccaagctgcaggagtacctgtgcagcttcaagaggctggaggacttccgggtggacccccccatcagtgatgaatttggaaggaagaggcacagcagcaccagcggggaggagagcaacagacaccggctgccccccaacagcagcaccaagcccccaaatgctgccaagcccaccagcaccagcgagctgcaggtgcccatcaacagccccaggaggaacatcagccctgagagcagtgacaacagccactag

SEQ ID NO: 39582 - DNA, 2745 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagagggccaacaagcacaagtgggtgcccctgcacctggatgtggtgcgctctgagagccaggagcggcccggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcactggagtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagaaagtgcccccaacagcccccgcatcggcagccccctgagccccaagaagaacagcgagaccagcatcctgcaggccatgagccggggcctgagcaccagcctgcctgacctggacagcgagccctggattgaggtgaagaagaggcaccagcctgcccctgtgaagctgcgggagagcgtgtctgtgcctgagggcagcctgaaccagctgtgcagcagcgaggagcctgagcaggaggagctggacttcctgtttgatgaggagattgagcagatcggcaggaagaacaccttcacagactggagcgacaatgacagcgactatgaaattgatgaccaggacctgaacaagatcctgattgtgacccagaccccaccctacgtgaagaagcaccctggaggagacagaacaggcacccacatgagccgggccaagatcaccagcgagctggccaaggtgatcaatgatggcctgtactactatgagcaggacctgtggatggaggaggatgagaacaagcacacagccatcaagcaggaggtggagaacttcaagaagctgaacctgatcagcaaggagcagtttgagaacctgaccccagagctgccctttgagcccaaccaggaggtgcctgtggcccccagccagagccggcagggcggcgtgcagggcgtgctgcacatccccaagaaggacctgacagatgagctggcccagaagctgtttgatgtgtctgagatcaccagcgctgccatggtgcacagcctgcccacagctgtgcctgagagcccccgcatccaccccaccaggacccccaagacccccaggaccccccggctgcaggaccccaacaagaccccccgcttctaccctgtggtgaaggagcccaaggccattgatgtgaagagccccaggaagaggaagaccaggcacagcaccaacccccccctggagtgccacgtgggctgggtgatggacagccgggaccggggccctggcaccagctctgtgtccaccagcaatgccagccccagcgagggcgcccccctggccggcagctatggctgcaccccccacagcttccccaagttccagcaccccagccatgagctgctgaaggaaaatggcttcacccagcaggtgtaccacaagtacagaagacgctgcctgtctgagaggaagaggctgggcatcggccagagccaggagatgaacaccctcttccgcttctggagcttcttcctgcgggaccacttcaacaagaagatgtatgaggagttccggcagctggcctgggaggatgccaaggagaactaccgctatggcctggagtgcctcttccgcttctacagctatggcctggagaagaagttcagaagagagatcttccaggacttccaggaggagaccaagaaggactatgagagcggccagctgtatggcctggagaagttctgggcctacctgaagtacagccagagcaagacccagagcattgaccccaagctgcaggagtacctgtgcagcttcaagaggctggaggacttccgggtggacccccccatcagtgatgaatttggaaggaagaggcacagcagcaccagcggggaggagagcaacagacaccggctgccccccaacagcagcaccaagcccccaaatgctgccaagcccaccagcaccagcgagctgcaggtgcccatcaacagccccaggaggaacatcagccctgagagcagtgacaacagccactag

SEQ ID NO: 39583 - DNA, 846 bp, Artificial Sequence
  Description of Artificial Sequence: Synthetic coding sequence
atggtgcacagcctgcccacagctgtgcctgagagcccccgcatccaccccaccaggacccccaagacccccaggaccccccggctgcaggaccccaacaagaccccccgcttctaccctgtggtgaaggagcccaaggccattgatgtgaagagccccaggaagaggaagaccaggcacagcaccaacccccccctggagtgccacgtgggctgggtgatggacagccgggaccggggccctggcaccagctctgtgtccaccagcaatgccagccccagcgagggcgcccccctggccggcagctatggctgcaccccccacagcttccccaagttccagcaccccagccatgagctgctgaaggaaaatggcttcacccagcaggtgtaccacaagtacagaagacgctgcctgtctgagaggaagaggctgggcatcggccagagccaggagatgaacaccctcttccgcttctggagcttcttcctgcgggaccacttcaacaagaagatgtatgaggagttccggcagctggcctgggaggatgccaaggagaactaccgctatggcctggagtgcctcttccgcttctacagctatggcctggagaagaagttccggcgggagatcttccaggacttccaggaggagaccaagaaggactatgaaagtggccagctgtatggcctggagaagttctgggcctacctgaagtacagccagagcaagacccagagcattgaccccaagctgcaggagtacctgtgcagcttcaagaggctggaggacttccgggtggacaaccaccacgaccggctgctgctgctgatcatcaacatctag

SEQ ID NO: 39584 - DNA, 1008 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagagggccaacaagcacaagtgggtgcccctgcacctggatgtggtgcgctctgagagccaggagcggcccggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcactggagtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagtgcgggtgatgatcttctag

SEQ ID NO: 39585 - DNA, 1569 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagagggccaacaagcacaagtgggtgcccctgcacctggatgtggtgcgctctgagagccaggagcggcccggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcactggagtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagaaagtgcccccaacagcccccgcatcggcagccccctgagccccaagaagaacagcgagaccagcatcctgcaggccatgagccggggcctgagcaccagcctgcctgacctggacagcgagccctggattgaggtgaagaagaggcaccagcctgcccctgtgaagctgcgggagagcgtgtctgtgcctgagggcagcctgaaccagctgtgcagcagcgaggagcctgagcaggaggagctggacttcctgtttgatgaggagattgagcagatcggcaggaagaacaccttcacagactggagcgacaatgacagcgactatgaaattgatgaccaggacctgaacaagatcctgattgtgacccagaccccaccctacgtgaagaagcaccctggaggagacagaacaggcacccacatgagccgggccaagatcaccagcgagctggccaaggtgatcaatgatggcctgtactactatgagcaggacctgtggatggaggaggatgagaacaagcacacagccatcaaggtgattgtgtctggccagcacctgagcacagatgccctcttctag

SEQ ID NO: 39586 - DNA, 1077 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagagggccaacaagcacaagtgggtgcccctgcacctggatgtggtgcgctctgagagccaggagcggcccggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcactggagtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacactggaaacatcttcagcagccgggccaatgatgtgacagtgggctacctggtgcagttcacctacctgttcatctacttccagttcatctag

SEQ ID NO: 39587 - DNA, 2364 bp, Artificial Sequence
  Description of Artificial Sequence: Synthetic coding sequence
atggagaactggcccacccccagcgagctggtgaacacaggcttccagagcgtgctgagccagggcaacaagaagccccagaacaggaaggagaaggaggagaaggtggagaagaggagcaacagcgacagcaaggagaaccgggagaccaagctgaatggacctggagaaaatgtgtctgaagatgaggcccagagcagcaaccagaggaagagggccaacaagcacaagtgggtgcccctgcacctggatgtggtgcgctctgagagccaggagcggcccggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcactggagtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagaaagtgcccccaacagcccccgcatcggcagccccctgagccccaagaagaacagcgagaccagcatcctgcaggccatgagccggggcctgagcaccagcctgcctgacctggacagcgagccctggattgaggtgaagaagaggcaccagcctgcccctgtgaagctgcgggagagcgtgtctgtgcctgagggcagcctgaaccagctgtgcagcagcgaggagcctgagcaggaggagctggacttcctgtttgatgaggagattgagcagatcggcaggaagaacaccttcacagactggagcgacaatgacagcgactatgaaattgatgaccaggacctgaacaagatcctgattgtgacccagaccccaccctacgtgaagaagcaccctggaggagacagaacaggcacccacatgagccgggccaagatcaccagcgagctggccaaggtgatcaatgatggcctgtactactatgagcaggacctgtggatggaggaggatgagaacaagcacacagccatcaagcaggaggtggagaacttcaagaagctgaacctgatcagcaaggagcagtttgagaacctgaccccagagctgccctttgagcccaaccaggaggtgcctgtggcccccagccagagccggcagggcggcgtgcagggcgtgctgcacatccccaagaaggacctgacagatgagctggcccagaagctgtttgatgtgtctgagatcaccagcgctgccatggtgcacagcctgcccacagctgtgcctgagagcccccgcatccaccccaccaggacccccaagacccccaggaccccccggctgcaggaccccaacaagaccccccgcttctaccctgtggtgaaggagcccaaggccattgatgtgaagagccccaggaagaggaagaccaggcacagcaccaacccccccctggagtgccacgtgggctgggtgatggacagccgggaccggggccctggcaccagctctgtgtccaccagcaatgccagccccagcgagggcgcccccctggccggcagctatggctgcaccccccacagcttccccaagttccagcaccccagccatgagctgctgaaggaaaatggcttcacccagcaggtgtaccacaagtacagaagacgctgcctgtctgagaggaagaggctgggcatcggccagagccaggagatgaacaccctcttccgcttctggagcttcttcctgcgggaccacttcaacaagaagatgtatgaggagttccggcagctggcctgggaggatgccaaggagaactacagatctgctgtgtggaccaggaaggtgctgggcctgtttgagatcttcagcatctag

SEQ ID NO: 39588 - DNA, 1476 bp, Artificial Sequence
  Description of Artificial Sequence: Synthetic coding sequence
tgagaagagaaggtggagaagaggagcaacagcgacagcaaagaaaatcgggagaccaagctgaatggacctggagaaaatgtgtctgaagatgaggcccagagcagcaaccagaggaagagggccaacaagcacaagtgggtgcccctgcacctggatgtggtgcgctctgagagccaggagaggcctggcagcaggaacagcagccgctgccagcctgaggccaacaagcccacccacaacaacagaagaaatgacaccaggtcctggaagagggaccgggagaagagagatgaccaggatgatgtgtcctctgtgcgctctgagggcggcaacatccggggcagcttccggggccggggccggggccggggccggggccggggccggggccggggcaacccccggctgaactttgactacagctatggctaccaggagcacggggagaggacagaccagcccttccagacagagctgaacacctccatgatgtactactatgatgatggcaccggggtgcaggtgtaccctgtggaggaggccctgctgaaggagtacatcaagaggcagatcgagtactacttctctgtggagaacctggagcgggacttcttcctgcggggcaagatggatgagcagggcttcctgcccatcagcctgattgctggcttccagagggtgcaggccctgaccaccaacctgaacctgatcctggaggccctgaaggacagcacagaggtggagatcgtggatgagaagatgaggaagaagattgagcctgagaagtggcccatccctggccccccacccaggtctgtgcccccaacagacttcagccagctgattgactgcccagagtttgtgcccggccaggccttctgcagccacacagagagcgcccccaacagccccagaattggcagccccctgagccccaagaagaacagcgagaccagcatcctgcaggccatgagccggggcctgagcaccagcctgcctgacctggacagcgagccctggattgaggtgaagaagaggcaccagcctgcccctgtgaagctgcgggagagcgtgtctgtgcctgagggcagcctgaaccagctgtgcagcagcgaggagcctgagcaggaggagctggacttcctgtttgatgaggagattgagcagattggaaggaagaacaccttcacagactggagcgacaatgacagcgactatgaaattgatgaccaggacctgaacaagatcctgattgtgacccagaccccaccctacgtgaagaagcaccctggaggagacagaacaggcacccacatgagccgggccaagatcaccagcgagctggccaaggtgatcaatgatggcctgtactactatgagcaggacctgtggatggaggaggatgagaacaagcacacagccatcaaggtgattgtgtctggccagcacctgagcacagatgccctcttctag

SEQ ID NO: 39589 - DNA, 1962 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgagggcaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagaacagaaggaccctcttccggggcagaagaagaagagaagatgaccgcatcagccggccccaccccagcacagctgagagcaaggcccccacccccaagtttgacctgctggccagcaacttcccccccctgcccggcagcagcagcaggatgcctggagagctggtgctggagaacaggatgtctgatgtggtgaagggcgtgtacaaggagaaggacaatgaggagctgaccatcagctgccctgtgcctgcagatgagcagacagagtgcaccagcgcccagcagctgaacatgagcaccagcagcccctgtgccgctgagctgacagccctgagcaccacccagcaggagaaggacctgattgaggacagctctgtgcagaaggatggcctgaaccagaccaccatccctgtgtccccacccagcaccaccaagcccagccgggccagcacagccagcccctgcaacaacaacatcaatgctgccacagctgtggccctgcaggagcccaggaagctgtcctatgcagaggtgtgccagaagccacccaaggagcccagctctgtgctggtgcagcccctgcgggagctgcggagcaatgtggtgagccccaccaagaatgaagataatggagccccagaaaattctgtggagaagccccatgagaagccagaggcccgggccagcaaggactacagcggcttccggggcaacatcatccccagaggagctgctgggaagatccgggagcagaggcggcagttcagccaccgggccatcccccagggcgtgaccaggagaaatggcaaggagcagtatgtgccccccaggagccccaagtag

SEQ ID NO: 39590 - DNA, 1962 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgagggcaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccccttccccaacggcagctttgtgaatggcttcaacagccctggcagctacaagaccaatgctgctgccatgaacatgggccggcccttccagaagaacagagtgaagccccagttccgcagcagcggcggcagcgagcacagcacagagggctctgtgtccctgggagatggccagctgaaccgctacagcagcaggaacttccctgctgagcggcacaaccccaccgtgacaggccaccaggagcagacctacctgcagaaggagaccagcaccctgcaggtggagcagaatggagactatggccggggccgccgcaccctcttccggggcagaagaagaagagaagatgaccgcatcagccggccccaccccagcacagctgagagcaaggcccccacccccaagtttgacctgctggccagcaacttcccccccctgcccggcagcagcagcaggatgcctggagagctggtgctggagaacaggatgtctgatgtggtgaagggcgtgtacaaggagaaggacaatgaggagctgaccatcagctgccctgtgcctgcagatgagcagacagagtgcaccagcgcccagcagctgaacatgagcaccagcagcccctgtgccgctgagctgacagccctgagcaccacccagcaggagaaggacctgattgaggacagctctgtgcagaaggatggcctgaaccagaccaccatccctgtgtccccacccagcaccaccaagcccagccgggccagcacagccagcccctgcaacaacaacatcaatgctgccacagctgtggccctgcaggagcccaggaagctgtcctatgcagaggtgtgccagaagccacccaaggagcccagctctgtgctggtgcagcccctgcgggagctgcggagcaatgtggtgagccccaccaagaatgaagataatggagccccagaaaattctgtggagaagccccatgagaagccagaggcccgggccagcaaggactacagcggcttccggggcaacatcatccccagaggagctgctgggaagatccgggagcagaggcggcagttcagccaccgggccatcccccagggcgtgaccaggagaaatggcaaggagcagtatgtgccccccaggagccccaagtag

SEQ ID NO: 39591 - DNA, 1125 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgagggcaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagatcgtgtag

SEQ ID NO: 39592 - DNA, 2175 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgagggcaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagaacagagtgaagccccagttccgcagcagcggcggcagcgagcacagcacagagggctctgtgtccctgggagatggccagctgaaccgctacagcagcaggaacttccctgctgagcggcacaaccccaccgtgacaggccaccaggagcagacctacctgcagaaggagaccagcaccctgcaggtggagcagaatggagactatggccggggccgccgcaccctcttccggggcagaagaagaagagaagatgaccgcatcagccggccccaccccagcacagctgagagcaaggcccccacccccaagtttgacctgctggccagcaacttcccccccctgcccggcagcagcagcaggatgcctggagagctggtgctggagaacaggatgtctgatgtggtgaagggcgtgtacaaggagaaggacaatgaggagctgaccatcagctgccctgtgcctgcagatgagcagacagaatgtaccagcgcccagcagctgaacatgagcaccagcagcccctgtgccgctgagctgacagccctgagcaccacccagcaggagaaggacctgattgaggacagctctgtgcagaaggatggcctgaaccagaccaccatccctgtgagcccccccagcaccaccaagcccagccgggccagcacagccagcccctgcaacaacaacatcaatgctgccacagctgtggccctgcaggagcccaggaagctgtcctatgcagaggtgtgccagaagccacccaaggagcccagctctgtgctggtgcagcccctgcgggagctgcggagcaatgtggtgagccccaccaagaatgaagacaacggggcccctgagaacagcgtggagaagccccatgagaagccagaggcccgggccagcaaggactacagcggcttccggggcaacatcatccccagaggagctgctgggaagatccgggagcagaggcggcagttcagccaccgggccatcccccagggcgtgaccaggagaaatggcaaggagcagtatgtgcccccaagaagccccaagtag

SEQ ID NO: 39593 - DNA, 2193 bp, Artificial Sequence
  Description of Artificial Sequence: Synthetic coding sequence
atgctgctgtttgtggagcaggtggccagcaaaggaacaggcctgaaccccaatgccaaggtgtggcaggagatcgcccctggcaacacagatgccacccctgtgacccatggaacagagagctcctggcatgaaattgctgccaccagcggggcccaccctgaggtgtctgtgttcaacacaggaaatgctgagctgtctgaggacatctgcaaggagtatgaggtgatgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagaacagagtgaagccccagttccgcagcagcggcggcagcgagcacagcacagagggctctgtgtccctgggagatggccagctgaaccgctacagcagcaggaacttccctgctgagcggcacaaccccaccgtgacaggccaccaggagcagacctacctgcagaaggagaccagcaccctgcaggtggagcagaatggagactatggccggggccgccgcaccctcttccggggcagaagaagaagagaagatgaccgcatcagccggccccaccccagcacagctgagagcaaggcccccacccccaagtttgacctgctggccagcaacttcccccccctgcccggcagcagcagcaggatgcctggagagctggtgctggagaacaggatgtctgatgtggtgaagggcgtgtacaaggagaaggacaatgaggagctgaccatcagctgccctgtgcctgcagatgagcagacagaatgtaccagcgcccagcagctgaacatgagcaccagcagcccctgtgccgctgagctgacagccctgagcaccacccagcaggagaaggacctgattgaggacagctctgtgcagaaggatggcctgaaccagaccaccatccctgtgagcccccccagcaccaccaagcccagccgggccagcacagccagcccctgcaacaacaacatcaatgctgccacagctgtggccctgcaggagcccaggaagctgtcctatgcagaggtgtgccagaagccacccaaggagcccagctctgtgctggtgcagcccctgcgggagctgcggagcaatgtggtgagccccaccaagaatgaagacaacggggcccctgagaacagcgtggagaagccccatgagaagccagaggcccgggccagcaaggactacagcggcttccggggcaacatcatccccagaggagctgctgggaagatccgggagcagaggcggcagttcagccaccgggccatcccccagggcgtgaccaggagaaatggcaaggagcagtatgtgcccccaagaagccccaagtag

SEQ ID NO: 39594 - DNA, 567 bp, Artificial Sequence
  Description of Artificial Sequence: Synthetic coding sequence
atgtacagcagcagctgtgagaccaccaggaacaccactggaattgaggagagcacagatggcatgatcctgggccctgaggacctgagctaccagatctatgatgtgtctggagagagcaacagcgctgtgtccacagaggacctgaaggaatgtctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcatcctgaagaggaggagctag

SEQ ID NO: 39595 - DNA, 2172 bp, Artificial Sequence
  Description of Artificial Sequence: Synthetic coding sequence
atgctgctgtttgtggaggtggccagcaagggcaccggcctgaaccccaatgccaaggtgtggcaggagatcgcccctggcaacacagatgccacccctgtgacccacggcacagagagctcctggcatgaaattgctgccaccagcggggcccaccctgagggcaatgctgagctgtctgaggacatctgcaaggagtatgaggtgatgtacagcagcagctgtgagaccaccaggaacaccaccggcatcgaggagagcacagatggcatgatcctgggccctgaggacctgagctaccagatctatgatgtgtctggagagagcaacagcgctgtgtccacagaggacctgaaggagtgcctgaagaagcagctggagttctgcttcagccgggagaacctgagcaaggacctgtacctgatcagccagatggacagcgaccagttcatccccatctggacagtggccaacatggaggagatcaagaagctgaccacagatcctgacctgatcctggaggtgctgcggagcagccccatggtgcaggtggatgagaagggggagaaggtgcggcccagccacaagcgctgcatcgtcatcctgcgggagatccctgagaccacccccatcgaggaggtgaagggcctcttcaagtctgagaactgccccaaggtgatcagctgtgaatttgcccacaacagcaactggtacatcaccttccagagcgacacagatgcccagcaggccttcaagtacctgcgggaggaggtgaagaccttccagggcaagcccatcatggcccgcatcaaggccatcaacaccttctttgccaagaatggctaccgcctgatggacagcagcatctacagccaccccatccagacccaggcccagtatgccagccctgtgttcatgcagcctgtgtacaacccccaccagcagtacagcgtgtacagcatcgtgccccagagctggagccccaaccccaccccctactttgagacccccctggcccccttccccaacggcagctttgtgaatggcttcaacagccctggcagctacaagaccaatgctgctgccatgaacatgggccggcccttccagaagaacagagtgaagccccagttccgcagcagcggcggcagcgagcacagcacagagggctctgtgtccctgggagatggccagctgaaccgctacagcagcaggaacttccctgctgagcggcacaaccccaccgtgacaggccaccaggagcagacctacctgcagaaggagaccagcaccctgcaggtggagcagaatggagactatggccggggccgccgcaccctcttccggggcagaagaagaagagaagatgaccgcatcagccggccccaccccagcacagctgagagcaaggcccccacccccaagtttgacctgctggccagcaacttcccccccctgcccggcagcagcagcaggatgcctggagagctggtgctggagaacaggatgtctgatgtggtgaagggcgtgtacaaggagaaggacaatgaggagctgaccatcagctgccctgtgcctgcagatgagcagacagagtgcaccagcgcccagcagctgaacatgagcaccagcagcccctgtgccgctgagctgacagccctgagcaccacccagcaggagaaggacctgattgaggacagctctgtgcagaaggatggcctgaaccagaccaccatccctgtgtccccacccagcaccaccaagcccagccgggccagcacagccagcccctgcaacaacaacatcaatgctgccacagctgtggccctgcaggagcccaggaagctgtcctatgcagaggtgtgccagaagccacccaaggagcccagctctgtgctggtgcagcccctgcgggagctgcggagcaatgtggtgagccccaccaagaatgaagataatggagccccagaaaattctgtggagaagccccatgagaagccagaggcccgggccagcaaggactacagcggcttccggggcaacatcatccccagaggagctgctgggaagatccgggagcagaggcggcagttcagccaccgggccatcccccagggcgtgaccaggagaaatggcaaggagcagtatgtgccccccaggagccccaagtag

SEQ ID NO: 39596 - DNA, 2217 bp, Artificial Sequence
  Description of Artificial Sequence: Synthetic coding sequence
atgaccagtgaccaggatgccaaggtggtggccgagccccagacccagagggtgcaggagggcaaggacagcgcccacctgatgaatggccccatcagccagaccaccagccagaccagcagcatcccccccctgagccaggtgcctgccaccaaggtgtctgagctgaaccccaatgctgaggtgtggggcgcccctgtgctgcacctggaggccagcagcgctgctgatggagtgtctgctgcctgggaggaggtggccggccaccacgccgaccggggcccccagggcagtgatgccaatggagatggagaccagggccatgaaaatgctgccctgcctgacccccaggagagtgaccctgctgacatgaatgccctggccctgggccccagtgaatatgacagcctgcctgaaaattctgaaacaggaggaaatgaaagccagcctgacagccaggaggacccccgggaggtgctgaagaagaccctggagttctgcctgagccgggagaacctggccagtgacatgtacctgatcagccagatggacagcgaccagtatgtgcccatcaccaccgtggccaacctggaccacatcaagaagctgagcacagatgtggacctgattgtggaggtgctgcggagcctgcccctggtgcaggtggatgagaagggggagaaggtgcggcccaaccagaaccgctgcatcgtcatcctgcgggagatcagcgagagcacccctgtggaggaggtggaggccctcttcaagggggacaacctgcccaagttcatcaactgtgaatttgcctacaatgacaactggttcatcacctttgaaacagaagcagatgcccagcaggcctacaagtacctgcgggaggaggtgaagaccttccagggcaagcccatcaaggcccgcatcaaggccaaggccatcgccatcaacaccttcctgcccaagaatggcttccggcccctggatgtgtccctgtatgcccagcagagatatgccaccagcttctacttcccccccatgtacagcccccagcagcagttccccctgtacagcctcatcaccccccagacctggagcgccacccacagctacctggacccccccctggtgacccccttccccaacacaggcttcatcaatggcttcaccagccctgccttcaagccagctgccagccccctgaccagcctgcggcagtacccacccaggagcaggaaccccagcaagagccacctgcggcatgccatccccagcgctgagcggggccctggcctgctggagagccccagcatcttcaacttcaccgctgacaggctcatcaatggagtgcgcagcccccagacccggcaggccggccagaccaggacccgcatccagaaccccagcgcctatgccaagcgggaggccggccctggccgggtggagcccggcagcctggagagcagccctggcctgggccggggcaggaagaacagctttggctacaggaagaagcgggaggagaagttcaccagcagccagacccagagccccaccccacccaagccacccagccccagctttgagctgggcctgagcagcttcccccccctgcccggggctgctggcaacctgaagacagaggacctgtttgaaaatcggctgagcagcctcatcatcggccccagcaaggagaggaccctgtctgcagatgcctctgtgaacaccctgcctgtggtggtgtcccgggagcccagcgtgcctgccagctgtgctgtgtctgccacctatgaaagaagccccagccctgcccacctgcctgatgaccccaaggtggccgagaagcagcgggagacccacagcgtggaccggctgcccagcgccctgacagccacagcctgcaagtctgtgcaggtgaatggagctgccacagagctgaggaagcccagctatgcagagatctgccagaggaccagcaaggagccccccagcagccccctgcagccccagaaggagcagaagcccaacacagtgggctgcggcaaggaggagaagaagctggccgagcctgctgagcgctaccgggagcccccagccctgaagagcacccctggggccccccgggaccagaggaggcctgctgggggccggcccagccccagcgccatgggcaagaggctgagccgggagcagagcaccccacccaagagcccccagtag

SEQ ID NO: 39597 - DNA, 396 bp, Artificial Sequence
  Description of Artificial Sequence: Synthetic coding sequence
atgaccagtgaccaggatgccaaggtggtggccgagccccagacccagagggtgcaggagggcaaggacagcgcccacctgatgaatggccccatcagccagaccaccagccagaccagcagcatcccccccctgagccaggtgcctgccaccaaggtgtctgagctgaaccccaatgctgaggtgtggggcgcccctgtgctgcacctggaggccagcagcgctgctgatggagtgtctgctgcctgggaggaggtggccggccaccacgccgaccggggcccccagggcagtgatgccaatggagatggagaccagggccatgaaaatgctgccctgcctgacccccaggagagtgaccctgctgacatgaatgccctggccctgggcccctag

SEQ ID NO: 39598 - DNA, 174 bp, Artificial Sequence
  Description of Artificial Sequence: Synthetic coding sequence
atgaccagtgaccaggatgccaaggtggtggccgagccccagacccagagggtgcaggagggcaaggacagcgcccacctgatgaatggccccatcagccagaccaccagccagaccagcagcatcccccccctgagccaggtgcctgccaccaaggtgtctgagctgaactag

SEQ ID NO: 39599 - DNA, 552 bp, Artificial Sequence
  Description of Artificial Sequence: Synthetic coding sequence
tgaagctttgagctgggcctgagcagcttcccccccctgcccggggctgctggcaacctgaagacagaggacctgtttgaaaatcggctgagcagcctcatcatcggccccagcaaggagaggaccctgtctgcagatgcctctgtgaacaccctgcctgtggtggtgtcccgggagcccagcgtgcctgccagctgtgctgtgtctgccacctatgaaagaagccccagccctgcccacctgcctgatgaccccaaggtggccgagaagcagcgggagacccacagcgtggaccggctgcccagcgccctgacagccacagcctgcaagtctgtgcaggtgaatggagctgccaccgtgaggaccagctgcctgcccagctgcaccacagctgcccggctgtggtgtgagcagaccctgcggaccccagccccagcccgcttcctgatcaccagcaacctggtgggcttctacctgcggctgtctgtgctgtgcttcctgtacaagatccccctcatctttgccaacaacttccccctgaccaccctgtag

SEQ ID NO: 39600 - DNA, 1020 bp, Artificial Sequence
  Description of Artificial Sequence: Synthetic coding sequence
tgaagcatcttcaacttcaccgctgacaggctcatcaatggagtgcgcagcccccagacccggcaggccggccagaccaggacccgcatccagaaccccagcgcctatgccaagcgggaggccggccctggccgggtggagcccggcagcctggagagcagccctggcctgggccggggcaggaagaacagctttggctacaggaagaagcgggaggagaagttcaccagcagccagacccagagccccaccccacccaagccacccagccccagctttgagctgggcctgagcagcttcccccccctgcccggggctgctggcaacctgaagacagaggacctgtttgaaaatcggctgagcagcctcatcatcggccccagcaaggagaggaccctgtctgcagatgcctctgtgaacaccctgcctgtggtggtgtcccgggagcccagcgtgcctgccagctgtgctgtgtctgccacctatgaaagaagccccagccctgcccacctgcctgatgaccccaaggtggccgagaagcagcgggagacccacagcgtggaccggctgcccagcgccctgacagccacagcctgcaagtctgtgcaggtgaatggagctgccaccgtgaggaccagctgcctgcccagctgcaccacagctgcccggctgtggtgtgagcagaccctgcggaccccagccccagcccgcttcctgatcaccagcaacctggagctgaggaagcccagctatgcagagatctgccagaggaccagcaaggagccccccagcagccccctgcagccccagaaggagcagaagcccaacacagtgggctgtgggaaggaggagaagaagctggccgagcctgctgagcgctaccgggagcccccagccctgaagagcacccctggggccccccgggaccagaggaggcctgctgggggccggcccagccccagcgccatgggcaagaggctgagccgggagcagagcaccccacccaagagcccccagtag

SEQ ID NO: 39601 - DNA, 1293 bp, Artificial Sequence
  Description of Artificial Sequence: Synthetic coding sequence
atggccgaggccgtgctgattgacctgtttggcctgaagctgaacagccagaagaactgccaccagaccctgctgaagaccctgaatgctgtgcagtaccaccacgccgccaaggccaagttcctgtgcatcatgtgctgcagcaacatctcctatgaaagagatggagagcaggacaactgtgaaattgagaccagcaatggcctgagcgccctgctggaggagtttgagatcgtgtcctgccccagcatggccgccaccctgtacaccatcaagcagaagattgatgagaagaacctgagcagcatcaaggtgattgtgcccaggcacaggaagaccctgatgaaggccttcatcgaccagctgttcacagatgtgtacaactttgaatttgaggacctgcaggtgaccttccggggcggcctcttcaagcagagcattgagatcaacgtcatcacagcccaggagctgcggggcatccagaatgaaattgagaccttcctgcggagcctgcctgccctgcggggcaagctgaccatcatcaccagcagcctcatcccagacatcttcatccacggcttcaccaccaggactggaggcatctcctacatccccaccctgagcagcttcaacctcttcagcagcagcaagaggcgggaccccaaggtggtggtgcaggagaacctgcggcggctggccaatgctgctggcttcaacgtggagaagttctaccgcatcaagacccaccacagcaatgacatctggatcatgggcaggaaggagccagacagctatgatggcatcaccaccaaccagaggggcgtgaccatcgccgccctgggcgctgactgcatccccatcgtgtttgctgaccctgtgaagaaggcctgtggggtggcccacgccggctggaagggcaccctgctgggcgtggccatggccaccgtgaatgccatgattgctgaatatggctgcagcctggaggacatcgtggtggtgctgggccccagcgtgggcccctgctgcttcaccctgccccgggagagcgctgaggccttccacaacctgcacccagcctgtgtgcagctgtttgacagccccaacccctgcatcgacatcaggaaggccacccgcatcctgctggagcagggcggcatcctgccccagaacatccaggaccagaaccaggacctgaacctgtgcaccagctgccacccagacaagttcttcagccacgtgagagatggcctgaactttggcacccagatcggcttcatcagcatcaaggagtag

SEQ ID NO: 39602 - DNA, 495 bp, Artificial Sequence
  Description of Artificial Sequence: Synthetic coding sequence
atggccgaggccgtgctgattgacctgtttggcctgaagctgaacagccagaagaactgccaccagaccctgctgaagaccctgaatgctgtgcagtaccaccacgccgccaaggccaagttcctgtgcatcatgtgctgcagcaacatctcctatgaaagagatggagagcaggacaactgtgaaattgagaccagcaatggcctgagcgccctgctggaggagtttgagatcgtgtcctgccccagcatggccgccaccctgtacaccatcaagcagaagattgatgagaagaacctgagcagcatcaaggtgattgtgcccaggcacaggaagaccctgatgaaggccttcatcgaccagctgttcacagatgtgtacaactttgaatttgaggacctgcaggtgaccttccggggcggcctcttcaagcagagcattgagatcaacgtcatcacagcccaggagctgcggggcatccagaatgagatctag

SEQ ID NO: 39603 - DNA, 1293 bp, Artificial Sequence; identical to SEQ ID NO: 39601
  Description of Artificial Sequence: Synthetic coding sequence

SEQ ID NO: 39604 - DNA, 5472 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggcatggactgccccaccatcagctgtgacaagtgtgtgtgggacctgacagatgacctgcggctggccgccctgagcattgaggagggcaagagcggcgtgctgtctgtgtcctctggagctgctgcccaccgccacgtgaatgagatcaatgccaccatctacctgctgaagaccaagctgtctgaaagagagaaccagtatgccctgaggaagatccagatcaacaatgctgagaacaccatgaagagcctgctgagtgatgtggaggagctggtggagaaggagaaccaggccagcaggaagggccagctggtgcagaaggagagcatggacaccatcaaccacgccagccagctggtggagcaggcccatgacatgagggacaagatccaggagatcaacaacaagatgctgtactatggagaggagcacgagctgagccccaaggagatcagcgagaagctggtgctggcccagaagatgctggaggagatccgcagccggcagcccttcttcacccagcgggagctggtggatgaggaggctgatgaggcctatgagctgctgagccaggccgagagctggcagaggctgcacaatgagaccaggaccctcttccctgtggtgctggagcagctggatgactacaatgccaagctgagtgacctgcaggaggccctggaccaggccctgaactacgtgagagatgctgaggacatgaacagagccacagctgcccggcagagggaccacgagaagcagcaggagcgggtgcgggagcagatggaggtggtgaacatgagcctgagcaccagcgctgacagcctgaccaccccccggctgaccctgtctgagctggatgacatcatcaagaatgccagcggcatctatgcagaaattgatggagccaagtctgagctgcaggtgaagctgagcaacctgagcaacctgagccatgacctggtgcaggaggccatcgaccacgcccaggacctgcagcaggaggccaatgagctgagcaggaagctgcacagcagtgacatgaatggcctggtgcagaaggccctggatgccagcaatgtgtatgagaacatcgtgaactacgtgtctgaggccaatgaaacagctgagtttgccctgaacaccacagaccgcatctatgatgctgtgtctggcatcgacacccagatcatctaccacaaggatgaaagtgagaacctgctgaaccaggcccgggagctgcaggccaaggccgagagcagcagtgatgaggccgtggccgacaccagccggcgggtgggcggggccctggccaggaagagcgccctgaagacccggctgagtgatgctgtgaagcagctgcaggccgctgagagaggagatgcccagcagaggctgggccagagccgcctcatcacagaggaggccaacagaaccaccatggaggtgcagcaggccacagcccccatggccaacaacctgaccaactggagccagaacctgcagcactttgacagcagcgcctacaacacagctgtgaacagcgccagagatgctgtgaggaacctgacagaggtggtgccccagctgctggaccagctgaggacagtggagcagaagaggcctgccagcaatgtgtctgccagcatccagaggatccgggagctgattgcccagaccaggtctgtggccagcaagatccaggtgtccatgatgtttgatggccagagcgctgtggaggtgcacagcaggacctccatggatgacctgaaggccttcaccagcctgagcctgtacatgaagccccctgtgaagaggcctgagctgacagaaacagctgaccagttcatcctgtacctgggcagcaagaatgccaagaaggagtacatgggcctggccatcaagaatgacaacctggtgtatgtgtacaacctgggcaccaaggatgtggagatccccctggacagcaagcctgtgtcctcctggccagcctacttcagcatcgtgaagattgaaagagtgggcaagcacggcaaggtgttcctgactgtgcccagcctgagcagcacagctgaggagaagttcatcaagaagggggagttctctggagatgacagcctgctggacctggaccctgaggacaccgtcttctacgtgggcggcgtgcccagcaacttcaagctgcccaccagcctgaacctgcccggctttgtgggctgcctggagctggccaccctgaacaatgatgtgatcagcctgtacaacttcaagcacatctacaacatggaccccagcacctctgtgccctgtgcccgggacaagctggccttcacccagagcagagctgccagctacttctttgatggcagcggctatgctgtggtgcgggacatcacccggcggggcaagtttggccaggtgaccaggtttgatattgaggtgaggaccccagctgacaatggcctcatcctgctgatggtgaatggctccatgttcttccggctggagatgagaaatggctacctgcacgtgttctatgactttggcttcagcggcggccctgtgcacctggaggacaccctgaagaaggcccagatcaatgatgccaagtaccacgagatcagcatcatctaccacaatgacaagaagatgatcctggtggtggacagaagacatgtgaagtccatggacaatgagaagatgaagatccccttcacagacatctacatcggcggggcccctcctgagatcctgcagagccgggccctgcgggcccacctgcccctggacatcaacttccggggctgcatgaagggcttccagttccagaagaaggacttcaacctgctggagcagacagagaccctgggcgtgggctacggctgcccagaggacagcctcatcagcagaagagcctacttcaacggccagagcttcatcgccagcatccagaagatctccttctttgatggctttgaaggaggcttcaacttccgcaccctgcagcccaacggcctgctcttctactatgccagcggcagtgatgtgttcagcatcagcctggacaatggcaccgtcatcatggatgtgaagggcatcaaggtgcagagcgtggacaagcagtacaatgatggcctgagccacttcgtcatcagctctgtgagccccaccaggtatgagctgattgtggacaagagccgggtgggcagcaagaaccccaccaagggcaagattgagcagacccaggccagcgagaagaagttctactttggaggcagccccatcagcgcccagtatgccaacttcaccggctgcatcagcaatgcctacttcaccagggtggacagagatgtggaggtggaggacttccagcgctacacagagaaggtgcacaccagcctgtatgaatgtcccatcgagagcagccccctcttcctgctgcacaagaagggcaagaacctgagcaagcccaaggccagccagaacaagaagggcggcaagagcaaggatgcccccagctgggaccctgtggccctgaagctgcctgagaggaacaccccaagaaacagccactgccacctgagcaacagcccccgggccatcgagcacgcctaccagtatggaggaacagccaacagccggcaggagtttgagcacctgaagggggactttggagccaagagccagttcagcatccggctgcggaccaggagcagccacggcatgatcttctacgtgtctgaccaggaggagaatgacttcatgaccctcttcctggcccacggccgcctggtgtacatgttcaacgtgggccacaagaagctgaagatccgcagccaggagaagtacaatgatggcctgtggcatgatgtgatcttcatccgggagaggagcagcggccgcctggtgattgatggcctgcgggtgctggaggagagcctgcccccaacagaggccacctggaagatcaagggccccatctacctgggcggcgtggcccctgggaaggctgtgaagaatgtgcagatcaacagcatctacagcttcagcggctgcctgagcaacctgcagctgaatggagccagcatcaccagcgccagccagaccttctctgtgaccccctgctttgagggccccatggagaccggcacctacttcagcacagaaggaggctacgtggtgctggatgagagcttcaacatcggcctgaagtttgagatcgcctttgaggtgcggcccaggagcagcagcggcaccctggtgcacggccacagcgtgaatggagagtacctgaatgtgcacatgaagaatggccaggtgattgtgaaggtgaacaacggcatccgggacttcagcacctctgtgacccccaagcagagcctgtgtgatggccgctggcaccgcatcaccgtcatccgggacagcaatgtggtgcagctggatgtggacagcgaggtgaaccacgtggtgggccccctgaaccccaagcccatcgaccaccgggagcctgtgtttgtgggcggcgtgcctgagagcctgctgaccccccggctggcccccagcaagcccttcaccggctgcatccgccactttgtgattgatggccaccctgtgtccttcagcaaggccgccctggtgtctggagctgtgtccatcaacagctgcccagctgcctag

SEQ ID NO: 39605 - DNA, 363 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgaggtgcagtgcccctgccactgccaccctgctggggccccagccccacccagggctgtgccccacagcagcttcagcctgagcccccccctgagcagcccccagtgcctggagagcttcacctgggcccggtctgtgaggaagctggagatcaagagcttccccctgtag

SEQ ID NO: 39606 - DNA, 1263 bp, Artificial Sequence
  Description of Artificial Sequence: Synthetic coding sequence
atggacaccaagcgctgctttgccaacagatttgatgactaccagggcagcctgctggccggccagtgtgaggaggccgtggcccccctggtgacagccaccatcgagcgcatcctgcaggagctgccccccctgggcggcggcgctgaggcccggggggccacagctggggccagcgcctgccagggcggcctgtatggaggagtggccggcgtggcctacatgctgtaccacgtgtcccagagccccctgtttgccacagcccgggagcgctacctgcggagcgccaagaggctgattgatgcctgtgcccgggcagaggagtggggcgagccagatgctgacacccgggccgccttcctgctgggcggggccggcgtgtatgctgtggccaccctggtgtaccacgccctgggccgcagtgactatgtgcagcccctgggcaagttccgggccctgtgtgctgtgtgtgcccctgtgtccttcctggagtgtggcagtgatgagctgtttgtgggccgggccggctacctgtgtgccgccctggtgctgaagcagaagctggcccaggaggtgctgaccccagcccagatcaagagcatctgccaggccatcctggacagcggcaagcagtatgccatcaagaagaggaagcccttccccctgatgtacagctactatggaacagagtacctgggcgccgcccacggcctgagcagcatcctgcagatgctgctgagctaccacgagcacctgaagcccagcgaccgggagctggtgtggcagagcgtggacttcctgatggagcaggagcagaactgcaactggcccccagagctgggggagaccatcgagagagaaaatgagctggtgcactggtgccacggggcccctggcatcgcctacctgtttgccaaggcctacctggtgtccaagaagccccagtacctggacacctgcatccgctgtggggagctgacctggcagaagggcctgctgaagaagggccctggcatctgccacggcgtggccggcagcgcctacgtgttcctgctgctgtaccgcctgactggaaacagcaagtacatctaccgggcccagagatttgcccagttcctgttcacagaggagttcaaggccggcagccgggtgctggagagcatctacagcctgtatgagggcttcagcggcaccgtgtgcttcctgattgacctgctgcagcccaaccaggccgagttccccctcttctctgtgtttgtgtag

SEQ ID NO: 39607 - DNA, 1167 bp, Artificial Sequence
  Description of Artificial Sequence: Synthetic coding sequence
atggacaccaagcgctgctttgccaacagatttgatgactaccagggcagcctgctggccggccagtgtgaggaggccgtggcccccctggtgacagccaccatcgagcgcatcctgcaggagctgccccccctgggcggcggcgctgaggcccggggggccacagctggggccagcgcctgccagggcggcctgtatggaggagtggccggcgtggcctacatgctgtaccacgtgtcccagagccccctgtttgccacagcccgggagcgctacctgcggagcgccaagaggctgattgatgcctgtgcccgggcagaggagtggggcgagccagatgctgacacccgggccgccttcctgctgggcggggccggcgtgtatgctgtggccaccctggtgtaccacgccctgggccgcagtgactatgtgcagcccctgggcaagttccgggccctgtgtgctgtgtgtgcccctgtgtccttcctggagtgtggcagtgatgagctgtttgtgggccgggccggctacctgtgtgccgccctggtgctgaagcagaagctggcccaggaggtgctgaccccagcccagatcaagagcatctgccaggccatcctggacagcggcaagcagtatgccatcaagaagaggaagcccttccccctgatgtacagctactatggaacagagtacctgggcgccgcccacggcctgagcagcatcctgcagatgctgctgagctaccacgagcacctgaagcccagcgaccgggagctggtgtggcagagcgtggacttcctgatggagcaggagcagaactgcaactggcccccagagctgggggagaccatcgagagagaaaatgagctggtgcactggtgccacggggcccctggcatcgcctacctgtttgccaaggcctacctggtgtccaagaagccccagtacctggacacctgcatccgctgtggggagctgacctggcagaagggcctgctgaagaagggccctggcatctgccacggcgtggccggcagcgcctacgtgttcctgctgctgtaccgcctgactggaaacagcaagtacatctaccgggcccagagcagcttccctgtgaacctgatcaagatggagcacctgctgtacacccggcagcactgcttctag

SEQ ID NO: 39608 - DNA, 243 bp, Artificial Sequence
  Description of Artificial Sequence: Synthetic coding sequence
atgagccagcagaagcagcagagctggaagcccccaaatgtgcccaagtgcagccccccccagaggagcaacccctgcctggccccctacagcaccccctgtggggccccccacagcgagggctgccacagcagcagccagaggcctgaggtgcagaagccccggcgggcccggcagaagctgcgctgcctgagccggggcaccacctaccactgcaaggaggaggagtgtgagggggactag

SEQ ID NO: 39609 - DNA, 4410 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagggcctgctgaacaatgcccgggacacctctgtgatggacaccctgcccctgaatggaaatcatggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggccgggaggatgatgccatcgtgctggatgatgccaccagcttcaaccacgaggagagcctgggcctggagctgatccacgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagaatctgtgaccaccagcacccagacagagcccccaccagccaagtgtggagatgctgaagatgtgtactacaagtccatgcccaacctgggcagcaggaaccacgtgcaccagctgcacacctactaccagctgggccggggcagcagtgatggcttcatcgtgccccccaacaaggatggcaccccacctgagggcagcagcaagggccctgcccacctggtgaccagcctgtag

SEQ ID NO: 39610 - DNA, 2013 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaaggagaagaagaagtacaacgtgtccaagatcagccagagcaagggccagaaggagatctctgtggagaagaagcacacctggaatgccagcctcttcaacagccagatccacatgattgcccagaggagagatgccatggcccaccgcatcctgagcgcccggctgcacaagatcaagggcctgaagaatgagctggccgacatgcaccacaagctggaggccatcctgacagagaaccagttcctgaagcagctgcagctgcggcacctgaaggccatcggcaagtatgagaacagccagaacaacctgccccagatcatggccaagcaccagaatgaggtgaagaacctgcggcagctgctgaggaagagccaggagaaggagaggaccctgagcaggaagctgcgggagacagacagccagctgctgaagaccaaggacatcctgcaggccctgcagaagctgtctgaggacaagaacctggccgagcgggaggagctgacccacaagctgagcatcatcaccaccaagatggatgccaatgacaagaagatccagagcctggagaagcagctgcggctgaactgccgggccttcagccggcagctggccatcgagaccaggaagaccctggccgcccagacagccaccaagaccctgcaggtggaggtgaagcacctgcagcagaagctgaaggagaaggaccgggagctggagatcaagaacatctacagccaccgcatcctgaagaacctgcatgacacagaggactaccccaaggtgagcagcaccaagtctgtgcaggccgacaggaagatcctgcccttcacctccatgaggcaccagggcacccagaagagtgatgtgccccccctgaccaccaagggcaagaaggccactggaaacatcgaccacaaggagaagagcacagagatcaaccacgagatcccccactgtgtgaacaagctgcccaagcaggaggacagcaagaggaaatatgaggacctgagcggggaggagaagcacctggaggtgcagatcctgctggagaacacaggccggcagaaggacaagaaggaggaccaggagaagaagaacatctttgtgaaggaggagcaggagctgccccccaagatcattgaagtcatccaccctgagcgggagagcaaccaggaggatgtgctggtgcgggagaagttcaagaggtccatgcagagaaatggagtggatgacaccctgggcaagggcacagccccctacaccaagggccccctgcggcagaggaggcactacagcttcacagaggccacagagaacctgcaccacggcctgcctgccagcggcggccctgccaatgccggcaacatgagatacagccacagcacaggcaagcacctgagcaaccgggaggagatggagctggagcacagcgacagcggctatgagcccagctttgggaagagcagccgcatcaaggtgaaggacaccaccttccgggacaagaagagcagcctgatggaggagctgtttggaagtggctacgtgctgaagacagaccagagcagccctggggtggccaagggcagcgaggagcccctgcagagcaaggagagccaccccctgccccccagccaggccagcaccagccacgcctttggagacagcaaggtgacagtggtgaacagcatcaagcccagcagccccacagagggcaagaggaagatcatcatctag

SEQ ID NO: 39611 - DNA, 2013 bp, Artificial Sequence; identical to SEQ ID NO: 39610
  Description of Artificial Sequence: Synthetic coding sequence

SEQ ID NO: 39612 - DNA, 2013 bp, Artificial Sequence; identical to SEQ ID NO: 39610
  Description of Artificial Sequence: Synthetic coding sequence

SEQ ID NO: 39613 - DNA, 282 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaagtag

SEQ ID NO: 39614 - DNA, 210 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgagtag

SEQ ID NO: 39615 - DNA, 570 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaaggagaagaagaagtacaacgtgtccaagatcagccagagcaagggccagaaggagatctctgtggagaagaagcacacctggaatgccagcctcttcaacagccagatccacatgattgcccagaggagagatgccatggcccaccgcatcctgagcgcccggctgcacaagatcaagggcctgaagaatgagctggccgacatgcaccacaagctggaggccatcctgacagagaaccagttcctgaagcagctgcagctgcggcacctgaaggccatcggcaagtactag

SEQ ID NO: 39616 - DNA, 192 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagctag

SEQ ID NO: 39617 - DNA, 288 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaaggagaagtag

SEQ ID NO: 39618 - DNA, 285 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaaggagtag

SEQ ID NO: 39619 - DNA, 327 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagaggagccctggcactggagacttcagcaggaacagcaatgccagcaacaagtctgtggactacagccgcagccagtgcagctgtggcagcctgagcagccagtatgactacagcgaggacttcctgtgtgactgcagcgagaaggccatcaacagaaactacctgaagcagcctgtggtgaaggagaaggagaagaagaagtacaacgtgtccaagatcagccagagcaaaggatag

SEQ ID NO: 39620 - DNA, 33 bp, Artificial Sequence; identical to SEQ ID NO: 22088
  Description of Artificial Sequence: Synthetic coding sequence

SEQ ID NO: 39621 - DNA, 93 bp, Artificial Sequence
  Description of Artificial Sequence: Synthetic coding sequence
atgagcctggccgacctgaccaagaccaacattgatgagcacttcttcggcgtggccctggagaacaacagaagatctgctgcctgcaagtag

SEQ ID NO: 39622 - DNA, 429 bp, Artificial Sequence
  Description of Artificial Sequence: Synthetic coding sequence
atgtccttcctgactgtgccctacaagctgcctgtgtccctgtctgtgggcagctgtgtgatcatcaagggcaccctgattgacagcagcatcaatgagccccagctgcaggtggacttctacacagagatgaatgaagacagcgagatcgccttccacctgcgggtgcacctgggccggcgggtggtgatgaacagccgggagtttggcatctggatgctggaggagaacctgcactacgtgccctttgaagatggcaagccctttgacctgcgcatctacgtgtgcctgaatgaatatgaggtgaaggtgaatggagagtacatctatgcctttgtgcaccgcatccccccatcctatgtgaagatgatccaggtgtggagagatgtgtccctggacagcgtgctggtgaacaatggaagaagatag

SEQ ID NO: 39623 - DNA, 1071 bp, Artificial Sequence
  Description of Artificial Sequence: Synthetic coding sequence
atggccttcagcggcagccaggccccctacctgagccctgctgtgcccttcagcggcaccatccagggcggcctgcaggacggcttccagatcaccgtgaatggagctgtgctgagcagcagcggcaccaggtttgctgtggacttccagacaggcttctctggaaatgacatcgccttccacttcaaccccaggtttgaagatggcggctacgtggtgtgcaacacccggcagaagggccgctggggccctgaggagaggaagatgcacatgcccttccagaagggcatgccctttgacctgtgcttcctggtgcagagcagtgacttcaaggtgatggtgaatggcagcctgtttgtgcagtacttccaccgggtgcccttccaccgggtggacaccatctctgtgaatggatctgtgcagctgagctacatctccttccagaaccccaggacagtgcctgtgcagcctgccttcagcacagtgcccttcagccagcctgtgtgcttccccccccggccccggggccggcggcagaagcccccatctgtgcggcctgccaacccagcccccatcacccagaccgtcatccacacagtgcagagcgccagcggccagatgttcagccagaccccagccatcccccccatgatgtacccccacccagcctaccccatgcccttcatcaccaccatccctgggggcctgtaccccagcaagagcatcatcctgtctggaacagtgctgcccagcgcccagcgcttccacatcaacctgtgcagcggcagccacatcgccttccacatgaaccccaggtttgatgaaaatgctgtggtgaggaacacccagatcaacaacagctggggcagcgaggagaggagcctgcccaggaagatgccctttgtgcggggccagagcttctctgtgtggatcctgtgtgaggcccactgcctgaaggtggccgtggatggccagcacgtgtttgagtactaccaccggctgaggaacctgcccaccatcaacaagctggaggtgggcggggacatccagctgacccacgtgcagacctag

SEQ ID NO: 39624 - DNA, 1068 bp, Artificial Sequence
  Description of Artificial Sequence: Synthetic coding sequence
atggccttcagcggcagccaggccccctacctgagccctgctgtgcccttcagcggcaccatccagggcggcctgcaggacggcttccagatcaccgtgaatggagctgtgctgagcagcagcggcaccaggtttgctgtggacttccagacaggcttctctggaaatgacatcgccttccacttcaaccccaggtttgaagatggcggctacgtggtgtgcaacacccggcagaagggccgctggggccctgaggagaggaagatgcacatgcccttccagaagggcatgccctttgacctgtgcttcctggtgcagagcagtgacttcaaggtgatggtgaatggcagcctgtttgtgcagtacttccaccgggtgcccttccaccgggtggacaccatctctgtgaatggatctgtgcagctgagctacatctccttccagaaccccaggacagtgcctgtgcagcctgccttcagcacagtgcccttcagccagcctgtgtgcttccccccccggccccggggccggcggcagaagcccccatctgtgcggcctgccaacccagcccccatcacccagaccgtcatccacacagtgcagagcgccagcggccagatgttcagcaccccagccatcccccccatgatgtacccccacccagcctaccccatgcccttcatcaccaccatccctgggggcctgtaccccagcaagagcatcatcctgagcggcaccgtgctgcccagcgcccagcgcttccacatcaacctgtgcagcggcagccacatcgccttccacatgaaccccaggtttgatgaaaatgctgtggtgaggaacacccagatcaacaacagctggggcagcgaggagaggagcctgcccaggaagatgccctttgtgcggggccagagcttctctgtgtggatcctgtgtgaggcccactgcctgaaggtggccgtggatggccagcacgtgtttgagtactaccaccggctgaggaacctgcccaccatcaacaagctggaggtgggcggggacatccagctgacccacgtgcagacctag

SEQ ID NO: 39625 - DNA, 1071 bp, Artificial Sequence
  Description of Artificial Sequence: Synthetic coding sequence
atggccttcagcggctgccaggccccctacctgagccctgctgtgcccttcagcggcaccatccagggcggcctgcaggacggcttccagatcaccgtgaatggagctgtgctgagctgcagcggcaccaggtttgctgtggacttccagacaggcttctctggaaatgacatcgccttccacttcaaccccaggtttgaagatggcggctacgtggtgtgcaacacccggcagaagggcacctggggccctgaggagaggaagatgcacatgcccttccagaagggcatgccctttgacctgtgcttcctggtgcagagcagtgacttcaaggtgatggtgaatggcagcctgtttgtgcagtacttccaccgggtgcccttccaccgggtggacaccatctctgtgaatggatctgtgcagctgagctacatctccttccagaaccccagggctgtgcctgtgcagcctgccttcagcacagtgcccttcagccagcctgtgtgcttccccccccggccccggggccggcggcagaagcccccatctgtgcggcctgccaacccagcccccatcacccagaccgtcatccacacagtgcagagcgccagcggccagatgttcagccagaccccagccatcccccccatgatgtacccccacccagcctaccccatgcccttcatcaccaccatccctgggggcctgtaccccagcaagagcatcatcctgtctggaacagtgctgcccagcgcccagcgcttccacatcaacctgtgcagcggcagccacatcgccttccacatgaaccccaggtttgatgaaaatgctgtggtgaggaacacccagatcaacaacagctggggcagcgaggagaggagcctgcccaggaagatgccctttgtgcggggccagagcttctctgtgtggatcctgtgtgaggcccactgcctgaaggtggccgtggatggccagcacgtgtttgagtactaccaccggctgaggaacctgcccaccatcaacaagctggaggtgggcggggacatccagctgacccacgtgcagacctag

SEQ ID NO: 39626 - DNA, 807 bp, Artificial Sequence
  Description of Artificial Sequence: Synthetic coding sequence
atgcacatgcccttccagaagggcatgccctttgacctgtgcttcctggtgcagagcagtgacttcaaggtgatggtgaatggcagcctgtttgtgcagtacttccaccgggtgcccttccaccgggtggacaccatctctgtgaatggatctgtgcagctgagctacatctccttccagaaccccagggctgtgcctgtgcagcctgccttcagcacagtgcccttcagccagcctgtgtgcttccccccccggccccggggccggcggcagaagcccccatctgtgcggcctgccaacccagcccccatcacccagaccgtcatccacacagtgcagagcgccagcggccagatgttcagccagaccccagccatcccccccatgatgtacccccacccagcctaccccatgcccttcatcaccaccatccctgggggcctgtaccccagcaagagcatcatcctgtctggaacagtgctgcccagcgcccagcgcttccacatcaacctgtgcagcggcagccacatcgccttccacatgaaccccaggtttgatgaaaatgctgtggtgaggaacacccagatcaacaacagctggggcagcgaggagaggagcctgcccaggaagatgccctttgtgcggggccagagcttctctgtgtggatcctgtgtgaggcccactgcctgaaggtggccgtggatggccagcacgtgtttgagtactaccaccggctgaggaacctgcccaccatcaacaagctggaggtgggcggggacatccagctgacccacgtgcagacctag

SEQ ID NO: 39627 - DNA, 519 bp, Artificial Sequence
  Description of Artificial Sequence: Synthetic coding sequence
atggccggctctgtggccgacagtgatgctgtggtgaagctggatgatggccacctgaacaacagcctgagcagccctgtgcaggctgatgtgtacttcccccggctgattgtgcccttctgtggccacatcaagggcggcatgaggcctgggaagaaggtgctggtgatgggcatcgtggacctgaaccctgagagctttgccatcagcctgacctgtggggacagtgaagatcctccagcagatgtggccatcgagctgaaggctgtgttcacagaccggcagctgctgaggaacagctgcatctctggagagcggggggaggagcagagcgccatcccctacttccccttcatcccagaccagcccttccgggtggagatcctgtgtgagcacccccgcttccgggtgtttgtggatggccaccagctgtttgacttctaccaccgcatccagaccctgagcgccatcgacaccatcaagatcaatggagacctgcagatcaccaagctgggctag

SEQ ID NO: 39628 - DNA, 1497 bp, Artificial Sequence
  Description of Artificial Sequence: Synthetic coding sequence
atgagcaccttcggctacagaagaggcctgagcaaatatgagagcattgatgaagatgagctgctggccagcctgtctgctgaggagctgaaggagctggagcgggagctggaggacatcgagccagacaggaacctgcctgtgggcctgcggcagaagagcctgacagagaagacccccaccggcaccttcagccgggaggccctgatggcctactgggagaaggagagccagaagctgctggagaaggagcggctgggggagtgtgggaaggtggccgaggacaaggaggagagcgaggaggaggaggacagtgatgaggaggagaggaccatcgagacagccaagggcatcaatggaacagtgaactatgacagcgtgaacagcgacaacagcaagcccaagatcttcaagagccagatcgagaacatcaacctgaccaacggcagcaatggaagaaacacagagagccctgctgccatccacccctgtggcaaccccaccgtgattgaagatgccctggacaagatcaagagcaatgaccctgacaccacagaggtgaacctgaacaacatcgagaacatcaccacccagaccctgaccaggtttgctgaggccctgaaggacaacacagtggtgaagaccttcagcctggccaacacccatgctgatgacagcgctgccatggccatcgccgagatgctgaaggtgaatgagcacatcaccaacgtgaatgtggagagcaacttcatcaccgggaagggcatcctggccatcatgagggccctgcagcacaacacagtgctgacagagctgcgcttccacaaccagaggcacatcatgggcagccaggtggagatggagatcgtgaagctgctgaaggagaacaccaccctgctgcggctgggctaccactttgagctgcccggccccaggatgtccatgaccagcatcctgaccaggaacatggacaagcagaggcagaagaggctgcaggagcagaagcagcaggagggctatgatggcggccccaacctgcggaccaaggtgtggcagaggggcacccccagcagcagcccctacgtgagccccaggcacagcccctggagcagccccaagctgcccaagaaggtgcagacagtgcgcagccggcccctgagccctgtggccaccccacctcctcctcctcctccacccctgcctgagaagaagctgatcaccaggaacattgctgaggtgatcaagcagcaggagagcgcccagagggccctgcagaatggccagaagaagaagaagggcaagaaggtgaagaagcagcccaacagcatcctgaaggagatcaagaacagcctgcggtctgtgcaggagaagaagatggaggacagcagccggcccagcaccccccagaggtctgcccacgagaacctgatggaggccatccggggcagcagcatcaagcagctgaagagggtggaggtgcctgaggccctgaggtag

SEQ ID NO: 39629 - DNA, 1524 bp, Artificial Sequence
  Description of Artificial Sequence: Synthetic coding sequence
atgagcaccttcggctacagaagaggcctgagcaaatatgagagcattgatgaagatgagctgctggccagcctgtctgctgaggagctgaaggagctggagcgggagctggaggacatcgagccagacaggaacctgcctgtgggcctgcggcagaagagcctgacagagaagacccccaccggcaccttcagccgggaggccctgatggcctactgggagaaggagagccagaagctgctggagaaggagcggctgggggagtgtgggaaggtggccgaggacaaggaggagaggaccattgaaacagccaagggcatcaatggcaccgtgaactatgattctgtgaacagcgacaacagcaagcccaagatcttcaagagccagatcgagaacatcaacctgaccaacggcagcaatggaagaaacacagagagccctgctgccatccacccctgtggcaaccccaccgtgattgaagatgccctggacaagatcaagagcaatgaccctgacaccacagaggtgaacctgaacaacatcgagaacatcaccacccagaccctgaccaggtttgctgaggccctgaaggacaacacagtggtgaagaccttcagcctggccaacacccatgctgatgattctgctgccatggccatcgccgagatgctgaaggtgaatgagcacatcaccaacgtgaatgtggagagcaacttcatcaccgggaagggcatcctggccatcatgagggccctgcagcacaacacagtgctgacagagctgcgcttccacaaccagaggcacatcatgggcagccaggtggagatggagatcgtgaagctgctgaaggagaacaccaccctgctgcggctgggctaccactttgagctgcccggccccaggatgtccatgaccagcatcctgaccaggaacatggacaagcagaggcagaagaggctgcaggagcagaagcagcaggagggctatgatggcggccccaacctgcggaccaaggtgtggcagaggggcacccccagcagcagcccctacgtgagccccaggcacagcccctggagcagccccaagctgcccaagaaggtgcagacagtgcgcagccggcccctgagccctgtggccaccccacctcctcctcctcctcctcctcctcctcctccacccagcagccagaggctgcccccacctcctcctcctcctcctccacccctgcctgagaagaagctgatcaccagaaatattgctgaggtgatcaagcagcaggagagcgcccagagggccctgcagaatggccagaagaagaagaagggcaagaaggtgaagaagcagcccaacagcatcctgaaggagatcaagaacagcctgcggtctgtgcaggagaagaagatggaggacagcagccggcccagcaccccccagaggtctgcccacgagaacctgatggaggccatccggggcagcagcatcaagcagctgaagagggtggaggtgcctgaggccctgaggtag

SEQ ID NO: 39630 - DNA, 1644 bp, Artificial Sequence
  Description of Artificial Sequence: Synthetic coding sequence
atgagcaccttcggctacagaagaggcctgagcaaatatgagagcattgatgaagatgagctgctggccagcctgtctgctgaggagctgaaggagctggagcgggagctggaggacatcgagccagacaggaacctgcctgtgggcctgcggcagaagagcctgacagagaagacccccaccggcaccttcagccgggaggccctgatggcctactgggagaaggagagccagaagctgctggagaaggagcggctgggggagtgtgggaaggtggccgaggacaaggaggagagcgaggaggagctgatcttcacagagagcaacagcgaggtgtctgaggaggtgtacacagaggaggaggaggaggagagccaggaggaggaggaggaggaggacagtgatgaggaggagaggaccattgaaacagccaagggcatcaatggcaccgtgaactatgattctgtgaacagcgacaacagcaagcccaagatcttcaagagccagatcgagaacatcaacctgaccaacggcagcaatggaagaaacacagagagccctgctgccatccacccctgtggcaaccccaccgtgattgaagatgccctggacaagatcaagagcaatgaccctgacaccacagaggtgaacctgaacaacatcgagaacatcaccacccagaccctgaccaggtttgctgaggccctgaaggacaacacagtggtgaagaccttcagcctggccaacacccatgctgatgattctgctgccatggccatcgccgagatgctgaaggtgaatgagcacatcaccaacgtgaatgtggagagcaacttcatcaccgggaagggcatcctggccatcatgagggccctgcagcacaacacagtgctgacagagctgcgcttccacaaccagaggcacatcatgggcagccaggtggagatggagatcgtgaagctgctgaaggagaacaccaccctgctgcggctgggctaccactttgagctgcccggccccaggatgtccatgaccagcatcctgaccaggaacatggacaagcagaggcagaagaggctgcaggagcagaagcagcaggagggctatgatggcggccccaacctgcggaccaaggtgtggcagaggggcacccccagcagcagcccctacgtgagccccaggcacagcccctggagcagccccaagctgcccaagaaggtgcagacagtgcgcagccggcccctgagccctgtggccaccccacctcctcctcctcctcctcctcctcctcctccacccagcagccagaggctgcccccacctcctcctcctcctcctccacccctgcctgagaagaagctgatcaccagaaatattgctgaggtgatcaagcagcaggagagcgcccagagggccctgcagaatggccagaagaagaagaagggcaagaaggtgaagaagcagcccaacagcatcctgaaggagatcaagaacagcctgcggtctgtgcaggagaagaagatggaggacagcagccggcccagcaccccccagaggtctgcccacgagaacctgatggaggccatccggggcagcagcatcaagcagctgaagagggtggaggtgcctgaggccctgaggtag

SEQ ID NO: 39631 - DNA, 2208 bp, Artificial Sequence
  Description of Artificial Sequence: Synthetic coding sequence
atgctgcggctgctgcggcccctgctgctgctgctgctgctgcccccacctggcagccctgagcccccaggcctgacccagctgagccctggggccccaccccaggccccagacctgctgtatgcagatggcctgcgggcctatgctgctggggcctgggccccagctgtggccctgctgcgggaggccctgcggagccaggccgccctgggccgggtgcggctggactgtggggccagctgtgccgctgaccctggagctgccctgcctgctgtgctgctgggcgcccctgagccagattctggccctggccccacccagggctcctgggagcggcagctgctgcgggccgccctgcggcgggctgactgcctgacccagtgtgccgcccggcggctgggccctggaggagctgcccggcgggtgggcagcgccctgagagatgccttcagaagaagagagccctacaactacctgcagagggcctactaccagctgaagaagctggacctggccgctgctgctgcccacaccttctttgtggccaaccccatgcacctgcagatgagggaggacatggccaagtacagaaggatgtctggagtgcggccccagagcttccgggacctggagaccccaccccactgggccgcctatgacaccggcctggagctgctgggccggcaggaggccggcctggccctgccccggctggaggaggccctgcagggcagcctggcccagatggagagctgcagagctgactgtgagggccctgaggagcagcagggcgctgaggaggaggaggatggagctgccagccagggcggcctgtatgaggccatcgccggccactggatccaggtgctgcagtgccggcagagatgtgtgggggagacagccacccggcccggccgctccttccctgtgcctgacttcctgcccaaccagctgcggcggctgcacgaggcccacgcccaggtgggcaacctgagccaggccattgaaaatgtgctgtctgtgctgctcttctacccagaagatgaggccgccaagagggccctgaaccagtaccaggcccagctgggggagcccaggcctggcctgggcccccgggaggacatccagcgcttcatcctgcggagcctgggggagaagaggcagctgtactatgccatggagcacctgggcaccagcttcaaggaccctgacccctggaccccagctgccctgatccctgaggccctgcgggagaagctgcgggaggaccaggagaagaggccctgggaccacgagcctgtgaagcccaagcccctgacctactggaaggatgtgctgctgctggagggcgtgaccctgacccaggacagccggcagctgaatggaagtgaaagagctgtgctggatggcctgctgaccccagcagaatgtggggtgctgctgcagctggccaaggatgctgctggggccggggcccggagcggctaccggggcagaagaagcccccacacccctcatgaaagatttgagggcctgactgtgctgaaggccgcccagctggcccgggccggcaccgtgggcagccagggcgccaagctgctgctggaggtgtctgagcgggtgaggaccctgacccaggcctacttcagccctgagcggcccctgcacctgtccttcacccacctggtgtgccgcagcgccatcgagggggagcaggagcagaggatggacctgagccaccctgtgcacgccgacaactgtgtgctggaccctgacacaggagagtgctggagggagcccccagcctacacctacagagactacagcggcctgctgtacctgaatgatgacttccagggcggggacctcttcttcacagagcccaatgccctgactgtgacagcccgggtgcggccccgctgtggccgcctggtggccttcagcagtggagtggagaacccccatggagtgtgggccgtgacccggggccgccgctgtgccctggccctgtggcacacctgggcccctgagcaccgggagcaggagtggattgaggccaaggagctgctgcaggagagccaggaggaggaggaggaggaggaggaggagatgcccagcaaggaccccagccctgagccccccagccgccgccaccagagggtgcaggacaagacaggccgggccccccgggtgcgggaggagctgtag

SEQ ID NO: 39632 - DNA, 3015 bp, Artificial Sequence
  Description of Artificial Sequence: Synthetic coding sequence
atgcacggcagctgctgcctgggcggcggccagcccctgtctgtgtttgccagcctgcacatgggccctgagggcctggccctgaaggccggccggggctggtgccccaccttccagagcttccctgagcccacccccagctatggagcccctggggtggagttcatgggcctgcaccaggagaacaatgctgtgacccagatccacctgctgcccggccagtgccagctggtgaccctgctggatgacaacagcctgcacctgtggagcctgaaggtgaagggcggggccagcgagctgcaggaggatgagagcttcaccctgcggggccccccaggggccgcccccagcgccacccagatcaccgtggtgctgccccacagcagctgtgagctgctgtacctgggcacagaaagtggaaatgtgtttgtggtgcagctgcctgccttccgggccctggaggacaggaccatcagcagtgatgctgtgctgcagaggctgcctgaggaggcccggcaccggcgggtgtttgagatggtggaggccctgcaggagcacccccgggaccccaaccagatcctgattggctacagccggggcctggtggtgatctgggacctgcagggcagccgggtgctgtaccacttcctgagcagccagcagctggagaacatctggtggcagagagatggccgcctgctggtgtcctgccacagtgatggcagctactgccagtggcctgtgagcagcgaggcccagcagcctgagcccctgcggagcctggtgccctacggccccttcccctgcaaggccatcacccgcatcctgtggctgaccacccggcagggcctgcccttcaccatcttccagggcggcatgccccgggccagctatggagacagacactgcatcagcgtcatccatgatggccagcagacagcctttgacttcaccagcagggtcatcggcttcaccgtgctgacagaggccgaccctgctgccacctttgatgacccctatgccctggtggtgctggccgaggaggagctggtggtgattgacctgcagacagctggctggccccctgtgcagctgccctacctggccagcctgcactgcagcgccatcacctgcagccaccacgtgagcaacatccccctgaagctgtgggagcgcatcatcgccgccggcagccggcagaatgcccacttcagcaccatggagtggcccattgatggcggcaccagcctgaccccagccccaccccagagggacctgctgctgactggacatgaagatggcaccgtgcgcttctgggatgccagcggcgtgtgcctgcggctgctgtacaagctgagcacagtgcgggtcttcctgacagacacagaccccaatgaaaacttcagcgcccagggagaagatgagtggccacccctgaggaaggtgggcagctttgacccctacagtgatgacccccggctgggcatccagaagatcttcctgtgcaagtacagcggctacctggccgtggccggcacagctggccaggtgctggtgctggagctgaatgatgaggccgctgagcaggccgtggagcaggtggaggccgacctgctgcaggaccaggagggctaccgctggaagggccacgagcggctggccgcccggagcggccctgtgcgctttgagcccggcttccagccctttgtgctggtgcagtgccagcccccagctgtggtgaccagcctggccctgcacagcgagtggaggctggtggccttcggcaccagccacggcttcggcctgtttgaccaccagcagaggcggcaggtgtttgtgaagtgcaccctgcaccccagcgaccagctggccctggagggccccctgagccgggtgaagagcctgaagaagagcctgcggcagagcttccggaggatgagaagaagccgggtgagcagcaggaagaggcaccctgctggccccccaggagaggcccaggagggcagcgccaaggccgagaggcctggcctgcagaacatggagctggcccctgtgcagaggaagattgaggcccggtctgcagaagattccttcaccggctttgtgaggaccctgtactttgctgacacctacctgaaggacagcagccgccactgccccagcctgtgggccggcaccaatggaggcaccatctatgccttcagcctgcgggtgcccccagctgagaggaggatggatgagcctgtgcgggcagagcaggccaaggagatccagctgatgcaccgggcccctgtggtgggcatcctggtgctggatggccacagcgtgcccctgcctgagcccctggaggtggcccatgacctgagcaagagcccagacatgcagggcagccaccagctgctggtggtgtctgaggagcagttcaaggtgttcaccctgcccaaggtgtctgccaagctgaagctgaagctgacagccctggagggcagccgggtgagaagagtgtctgtggcccacttcggcagcagaagagctgaggactatggagagcaccacctggccgtgctgaccaacctgggggacatccaggtggtgtccctgcccctgctgaagccccaggtgcgctacagctgcatccggcgggaggatgtgtctggaattgccagctgtgtgttcaccaagtatggccagggcttctacctgatcagccccagcgagtttgagcgcttcagcctgagcaccaagtggctggtggagccccgctgcctggtggacagcgctgagaccaagaaccacaggcctggaaatggagctggccccaagaaggcccccagccgggccaggaacagcggcacccagagtgatggagaggagaagcagcccggcctggtgatggagcgggccctgctgagtgatgaaagagctgccactggagtgcacatcgagcccccctggggcgccgccagcgccatggccgagcagagcgagtggctgtctgtgcaggccgccaggtag

SEQ ID NO: 39633 - DNA, 2061 bp, Artificial Sequence
  Description of Artificial Sequence: Synthetic coding sequence
atgggccccaggagccgggagcggcgggccggggctgtgcagaacaccaatgacagcagcgccctgagcaagaggagcctggccgcccggggctacgtgcaggacccctttgctgccctgctggtgcctggagctgcccggcgggcccccctcatccaccggggctactacgtgcgggcccgggctgtgcgccactgtgtgcgggccttcctggagcagatcggggccccccaggccgccctgcgggcccagatcctgagcctgggcgccggctttgacagcctgtacttccggctgaagacagctggccgcctggcccgggctgctgtgtgggaggtggacttcccagatgtggcccggaggaaggccgagcgcatcggggagaccccagagctgtgtgccctgaccggcccctttgagcggggggagcccgccagcgccctgtgctttgagagcgctgactactgcatcctgggcctggacctgcggcagctgcagagggtggaggaggccctgggcgctgctggcctggatgctgccagccccaccctgctgctggccgaggccgtgctgacctacctggagcctgagagcgctgctgccctgattgcctgggccgcccagcgcttccccaatgccctgtttgtggtgtatgagcagatgaggccccaggatgccttcggccagttcatgctgcagcacttccggcagctgaacagccccctgcacggcctggagcgcttcccagatgtggaggcccagaggcggcgcttcctgcaggccggctggacagcctgtggggctgtggacatgaatgagttctaccactgcttcctgcctgctgaggagaggagaagagtggagaacatcgagccctttgatgaatttgaggagtggcacctgaagtgtgcccactacttcatcctggccgccagcagaggagacaccctgagccacaccctggtgttccccagcagcgaggccttcccccgggtgaacccagccagccccagcggggtcttccctgcctctgtggtgagcagcgagggccaggtgcccaacctgaagagatatggccacgccagcgtcttcctgagcccagatgtgatcctgtctgctgggggctttggagagcaggagggccgccactgccgggtgtcccagttccacctgctgagccgggactgtgacagcgagtggaagggcagccagatcggcagctgtggcaccggggtgcagtgggatggccgcctgtaccacaccatgacccggctgtctgagagccgggtgctggtgctgggcggccgcctgagccctgtgtccccagccctgggcgtgctgcagctgcacttcttcaagtctgaggacaacaacacagaggacctgaaggtgaccatcaccaaggccggcaggaaggatgacagcaccctgtgctgctggaggcacagcaccacagaggtgtcctgccagaaccaggagtacctgtttgtgtatggaggccgctctgtggtggagcctgtgctgagtgactggcacttcctgcacgtgggcaccatggcctgggtgcgcatccctgtggagggggaggtgcctgaggcccggcacagccacagcgcctgcacctggcagggcggggccctgattgctgggggcctgggcgccagcgaggagcccctgaacagcgtgctcttcctgcggcccatcagctgtggcttcctgtgggagagcgtggacatccagccccccatcaccccccgctacagccacacagcccacgtgctgaatggcaagctgctgctggtgggcggcatctggatccacagcagcagcttccctggggtgaccgtcatcaacctgaccaccggcctgagcagcgagtaccagattgacaccacctacgtgccctggcccctgatgctgcacaaccacaccagcatcctgctgcctgaggagcagcagctgctgctgctgggcggcggcggcaactgcttctcctttggcacctacttcaacccccacacagtgaccctggacctgagcagcctgtctgctggccagtag

SEQ ID NO: 39634 - DNA, 798 bp, Artificial Sequence
  Description of Artificial Sequence: Synthetic coding sequence
atgacccggctgtctgagagccgggtgctggtgctgggcggccgcctgagccctgtgtccccagccctgggcgtgctgcagctgcacttcttcaagtctgaggacaacaacacagaggacctgaaggtgaccatcaccaaggccggcaggaaggatgacagcaccctgtgctgctggaggcacagcaccacagaggtgtcctgccagaaccaggagtacctgtttgtgtatggaggccgctctgtggtggagcctgtgctgagtgactggcacttcctgcacgtgggcaccatggcctgggtgcgcatccctgtggagggggaggtgcctgaggcccggcacagccacagcgcctgcacctggcagggcggggccctgattgctgggggcctgggcgccagcgaggagcccctgaacagcgtgctcttcctgcggcccatcagctgtggcttcctgtgggagagcgtggacatccagccccccatcaccccccgctacagccacacagcccacgtgctgaatggcaagctgctgctggtgggcggcatctggatccacagcagcagcttccctggggtgaccgtcatcaacctgaccaccggcctgagcagcgagtaccagattgacaccacctacgtgccctggcccctgatgctgcacaaccacaccagcatcctgctgcctgaggagcagcagctgctgctgctgggcggcggcggcaactgcttctcctttggcacctacttcaacccccacacagtgaccctggacctgagcagcctgtctgctggccagtag

SEQ ID NO: 39635 - DNA, 399 bp, Artificial Sequence
  Description of Artificial Sequence: Synthetic coding sequence
atggaccaccacatccccatgcacgccctgcctgaggagatccagaagatgctgcctgaggagaaggtgtgcaagtactgcggcgtgtcctacctgatcctgcacgagttcaaggccatggaggagaaggtgaaggccatggagaaggagatgaagttctaccagggctctgtggaccgggagaagaggctgcaggagaagctgcacagcctgagccaggagctggagcagtacaagattgacaacaagagcaagacagagcgcatctatgatgtgggcatgcagctgaagagccagcagaatgagttccagaaggtgaagaagcagctgagccacctgcaggatgagctgaagatcaagtaccggcagagctacatcttccggctgtgcttctgctag

SEQ ID NO: 39636 - DNA, 879 bp, Artificial Sequence
  Description of Artificial Sequence: Synthetic coding sequence
atgggcattgctgagagcaccccagatgagctgcccagtgatgctgaggagcagctgcggagcggggaccagcagctggagctgtctggaagaaggctgcggcggctgcccagcgctgtgtgtgccctgagccggctgcagaagctgtatgtgtctggcaccggcctgcgggagctgcctgaggagattgaggagctgcgggagctgcgcatcctggccctggacttcaacaagctggagcggctgcctgatggcctgtgccgcctgccccggctgacccggctgtacctgggcggcaaccggctgctggccctgcctgctgactttgcccagctgcagagcctgcgctgcctgtggattgagggcaacttcctgcggcgcttcccccggcccctgctgcggctggtggccctgcagagcctgcagatgggagacaaccggctgcgggccctgcctgctgagctgcccaggatgacaggcctgcggggcctgtggctgtatggcaacagatttgaggagttccccccagccctgctgaggatgggccgcctgcacatcctggacctggacaggaaccggctgggcggcttcccagacctgcaccccctgcgggccctgcgggtcttctcctatgaccacaaccctgtgactggaccaccccgggtggccgacacagtgttcctggtgggggagggcgctgtggagaggatggccgagagagatgagcccaccccccggcccccaccccggcggcctgcccgggcctttgaagatgaggaggaggaggacctgctgattggaggagctggcagccgggccctgggcgcccctgggggcagcttccgggccctggaggccgcccctggcctgggcacctag

SEQ ID NO: 39637 - DNA, 1482 bp, Artificial Sequence
  Description of Artificial Sequence: Synthetic coding sequence
atgcacaccctggtgttcctgagcacccggcaggtgctgcagtgccagcctgctgcctgccaggccctgcccctgctgccccgggagctgttccccctgctcttcaaggtggccttcatggacaagaagacagtggtgctgcgggagctggtgcacacctggcccttccccctgctgtccttccagcagctgctgcaggagtgtgcccactgcagccgggccctgctgcaggagcggcccagcacagagagcatgcaggccgtcatcctgggcctgacagcccggctgcacaccagcgagcccggggccagcacccagcccctgtgcaggaagcacgccctgcgggtgctggacatgacaggcctgctggatgatggagtggagcaggaccccggcaccatgtccatgtgggactgcacagctgctgtggcccggacctgcatcgcccagcagcagggcggcgctgctgagcccggccctgcccccatccctgtggaggtgcgggtggacctgcgggtgaacagagccagctatgccttcctgcgggaggccctgcggagctctgtgggcagccccctgcggctgtgctgccgggacctgcgggcagaggacctgcccatgaggaacacagtggccctgctgcagctgctggatgctggctgcctgcggcgggtggacctgcgcttcaacaacctgggcctgcggggcctgagcgtcatcatcccccacgtggcccgcttccagcacctggccagcctgcggctgcactacgtgcatggagacagccggcagcccagcgtggatggagaggacaacttccgctacttcctggcccagatgggccgcttcacctgcctgcgggagctgtccatgggcagcagcctgctgagcggccgcctggaccagctgctgagcaccctgcagagccccctggagagcctggagctggccttctgtgccctgctgcctgaggacctgcgcttcctggcccggagcccccatgctgcccacctgaagaagctggacctgtctggaaatgacctgagcggcagccagctggcccccttccagggcctgctgcaggccagcgctgccaccctgctgcacctggagctgacagagtgccagctggccgacacccagctgctggccaccctgcccatcctgacccagtgtgccagcctgcgctacctgggcctgtatggcaaccccctgtccatggccggcctgaaggagctgctgcgggacagcgtggcccaggccgagctgaggacagtggtgcaccccttccctgtggactgctatgagggcctgccctggcccccaccagcctctgtgctgctggaggccagcatcaatgaggagaagtttgcccgggtggaggccgagctgcaccagctgctgctggccagcggccgggcccacgtgctgtggaccacagacatctacggccgcctggccgctgactacttcagcctgtag

SEQ ID NO: 39638 - DNA, 1545 bp, Artificial Sequence
  Description of Artificial Sequence: Synthetic coding sequence
atggacaccatgaggagcctgcgcttcatctctgctgaggccctggtgagccacccccaggtggcccggcagagcctggacagcgtggcccacaacctgtaccccctgctcttcaaggccagctacctgctggagcaggccgaggtgaccagggctgtgctgggccgctggcccctggaggagttccggctgggcgccctgctgggccctggagctgaccacccccaggacctgcgggacaggacctgccgggcctgcctggaggccctggtgcggggcctggccgaccacgtgctgcaggacaggagcagaagaaggctgcgggtggccgacctgaccggcatcagagatgtgcaggtgcagcgctgcccctgtggccgggccctgggccgctggggccgcacccagctgctggcccggacctgctgtgagctgcaggccgagcccctggccgccggccggcctgtggaggtgctggccgacctgtttgtgacagagggcaactttgaagctgtggtgcaggccctgcggcctgctggccctgcccccctgcgggtgcactgccccagcttccgggctgacagcctgagccccagccagctgctgcacgtgctgcggctggccggccctggggccctgaggaagctggaggtggtgcacaacgtgcggctgcacgccggccacgtgcagcagctgctggcccaggtgggcttcccccggctggccagcctgaccctgcccaccaaggcctttgatgccccacccacctacgccagcaccccagatggagaggaccccctgctggccagcatcgcccgggagctgagcaagatggcccagctgacagagctgtctgtggccttcagcaccctgaccgggaagatccccaccctgctgggccccctgcagacccccctgcgggtgctggacctggccaactgtgccctgaaccacacagacatggccttcctggccgactgtgcccacgccgcccacctggaggtgctggacctgagcggccacaacctggtgtccctgtaccccagcaccttcttccggctgctgagccaggccagcaggaccctgcgcatcctgaccctggaggagtgtggcatcgtggacagccacgtgggcatgctgatcctgggcctgagcccctgccaccggctgcggcagctgaagttcctgggcaaccccctgagcgcccgggccctgcggcggctcttcaccgccctgtgtgagctgcctgagctgcgctgcatcgagttccctgtgcccaaggactgctacccagagggcgccgcctacccccaggatgagctggccatgagcaagttcaaccagcagaagtatgatgaaattgctgaggagctgcgggctgtgctgctgcgggctgaccgggaggacatccaggtgtccacccccctgtttggcagctttgatcctgacatccaggagaccagcaatgagctgggcgccttcctgctgcaggccttcaagacagccctggagaacttcagccgggccctgaagcagattgaatag

SEQ ID NO: 39639 - DNA, 1278 bp, Artificial Sequence
  Description of Artificial Sequence: Synthetic coding sequence
atggccatcaagaagcagaagcgctgcaggaagatccggcctgtgtctgccttcatcagcggcagcccccaggacatggagagccagctgggcaacctgggcatccccccaggctggttcagcggcctgggcggcagccagcccacagccagcggctcctgggagggcctgtctgagctgcccacccacggctacaagctgcggcaccagacccagggccggcccaggcctcccaggaccaccccacctggccctggccggcccagcatgcctgcccctggcacccggcaggagaatggcatggccacccggctggatgagggcctggaggacttcttcagcagaagagtgctggaggagagcagcagctaccccaggaccctgaggacagtgcggcccggcctgtctgaggcccccctgccccccctgcagaagaagagaagaagaggcctcttccacttcagaagacccaggagcttcaagggggaccggggccctggcagccccaccaccggcctgctgctgcccccacctcctcctcctccacccacccaggagagcccccccagcccagacccccccagcctgggcaacaacagcagcccctgctggagccctgaggaggagagcagcctgctgcccggctttggaggcggccggggccccagcttccggaggaagatgggccctggccctgaccaggagggcagcacccaggcctggcagaagaggaggagcagtgatgatgctggccctggctcctggaagcccccacctccaccccagagcaccaagcccagcttcagcgccatgagaagagctgaggccacctggcacatcgccgaggagagcgcccccaaccacagctgccagagccccagccctgccagccaggatggagaggaggagaaggagggcaccctcttccctgagaggaccctgcctgccagaaatgccaagctgcaggaccctgccctggccccctggccacccaagcctgtggccgtgccccggggccggcagcccccccaggagcccggggtgcgggaggaggccgaggccggagatgctgcccctggggtgaacaagccccggctgcggctgagcagccagcaggaccaggaggagcctgaggtgcagggccccccagaccctggaagaagaacagcccccctgaagcccaagaggacccggcgggcccagagctgtgacaagctggagccagacagaagaagacctccagaccccaccggcaccagcgagcccggcacagactag

SEQ ID NO: 39640 - DNA, 4119 bp, Artificial Sequence
  Description of Artificial Sequence: Synthetic coding sequence
atggccaagcccagcgtggagctgacccgggagctgcaggacagcatccgccgctgcctgagccagggcgctgtgctgcagcagcaccacgtgaagctggagaccaagcccaagaagtttgaagatagagtgctggccctgacctcctggaggctgcacctgttcctgctgaaggtgcctgccaaggtggagagcagcttcaacgtgctggagatccgggccttcaacaccctgagccagaaccagatcctggtggagacagagcggggcatggtgtccatgaggctgcccagcgctgagagcgtggaccaggtgaccaggcatgtgtcctctgccctgagcaaggtgtgccccggccctggctgcctgatcagaagaggaaatgctgacaccccagagggcccccgggacaccagccccaacagcgagaccagcaccagcaccacccacagcgtgtgtggcggcttcagcgagacctatgctgccctgtgtgactacaacggcctgcactgccgggaggaggtgcagtgggatgtggacaccatctaccacgccgaggacaaccgggagttcaacctgctggacttcagccacctggagagccgggacctggccctgatggtggccgccctggcctacaaccagtggttcaccaagctgtactgcaaggacctgcggctgggcagcgaggtgctggagcaggtgctgcacaccctgagcaagagcggcagcctggaggagctggtgctggacaatgccggcctgaagacagactttgtgcagaagctggccggcgtgtttggagaaaatggcagctgtgtgctgcacgccctgaccctgagccacaaccccatcgaggacaagggcttcctgagcctgagccagcagctgctgtgcttccccagcggcctgaccaagctgtgcctggccaagacagccatcagcccccggggcctgcaggccctgggccagaccttcggggccaacccagcctttgccagcagcctgcgctacctggacctgagcaagaaccctggcctgctggccacagatgaggccaatgccctgtacagcttcctggcccagcccaatgccctggtgcacctggacctgagcggcacagactgtgtgattgacctgctgctgggcgccctgctgcacggctgctgcagccacctgacctacctgaacctggccaggaacagctgcagccacaggaagggccgggaggcccccccagccttcaagcagttcttcagcagcgcctacaccctgagccacgtgaacctgagcgccaccaagctgcccctggaggccctgcgggccctgctgcagggcctgagcctgaacagccacctgagtgacctgcacctggacctgagcagctgtgagctgcggtctgctggggcccaggccctgcaggagcagctgggcgctgtgacctgtgtgggcagcctggacctgagtgacaatggatttgacagcgacctgctgaccctggtgcctgccctgggcaagaacaagagcctgaagcacctgttcctgggcaagaacttcaacgtgaaggccaagaccctggaggagatcctgcacaagctggtgcagctgatccaggaggaggactgcagcctgcagagcctgtctgtggccgacagccggctgaagctgcggaccagcatcctgatcaatgccctgggcagcaacacctgcctggccaaggtggacctgtctggaaatggcatggaggacatcggggccaagatgctgagcaaggccctgcagatcaacagcagcctgcggaccatcctgtgggacaggaacaacaccagcgccctgggcttcctggacatcgcccgggccctggagagcaaccacaccctgcgcttcatgtccttccctgtgtctgacatcagccaggcctacagaagtgcccctgagaggacagaagatgtgtggcagaagatccagtggtgcctggtgaggaacaaccacagccagacctgcccccaggagcaggccttccggctgcagcagggcctggtgaccagcagcgctgagcagatgctgcagaggctgtgtggccgggtgcaggaggaggtgcgggccctgcggctgtgccccctggagcctgtgcaggatgagctgctgtatgcccgggacctgatcaaggatgccaagaacagccgggccctcttccccagcctgtatgagctgggccacgtgctggccaatgatggccctgtgcggcagaggctggagagcgtggccagcgaggtgtccaaggctgtggacaaggagctgcaggtgatcctggagagcatggtgtccctgacccaggagctgtgccctgtggccatgagggtggccgagggccacaacaagatgctgagcaatgtggccgagcgggtgacagtgcccaggaacttcatccggggggccctgctggagcaggccggccaggacatccagaacaagctggatgaggtgaagctgtctgtggtgacctacctgaccagcagcatcgtggatgagatcctgcaggagctgtaccacagccacaagagcctggcccggcacctgacccagctgcggaccctgagtgaccccccaggctgccccggccagggccaggacctgagcagccggggccggggcaggaaccacgaccacgaggagaccacagatgatgagctgggcaccaacatcgacaccatggccatcaagaagcagaagcgctgcaggaagatccggcctgtgtctgccttcatcagcggcagcccccaggacatggagagccagctgggcaacctgggcatccccccaggctggttcagcggcctgggcggcagccagcccacagccagcggctcctgggagggcctgtctgagctgcccacccacggctacaagctgcggcaccagacccagggccggcccaggcctcccaggaccaccccacctggccctggccggcccagcatgcctgcccctggcacccggcaggagaatggcatggccacccggctggatgagggcctggaggacttcttcagcagaagagtgctggaggagagcagcagctaccccaggaccctgaggacagtgcggcccggcctgtctgaggcccccctgccccccctgcagaagaagagaagaagaggcctcttccacttcagaagacccaggagcttcaagggggaccggggccctggcagccccaccaccggcctgctgctgcccccacctcctcctcctccacccacccaggagagcccccccagcccagacccccccagcctgggcaacaacagcagcccctgctggagccctgaggaggagagcagcctgctgcccggctttggaggcggccggggccccagcttccggaggaagatgggcacagagggcagcgagcctggagagggcggccctgcccctggaacagcccagcagccccgggtgcatggagtggccctgcccggcctggagcgggccaagggctggagctttgatggcaagcgggagggccctggccctgaccaggagggcagcacccaggcctggcagaagagaagaagcagtgatgatgctggccctggctcctggaagcccccacctccaccccagagcaccaagcccagcttcagcgccatgagaagagctgaggccacctggcacatcgccgaggagagcgcccccaaccacagctgccagagccccagccctgccagccaggatggagaggaggagaaggagggcaccctcttccctgagaggaccctgcctgccagaaatgccaagctgcaggaccctgccctggccccctggccacccaagcctgtggccgtgccccggggccggcagcccccccaggagcccggggtgcgggaggaggccgaggccggagatgctgcccctggggtgaacaagccccggctgcggctgagcagccagcaggaccaggaggagcctgaggtgcagggccccccagaccccggccgcaggacagcccccctgaagcccaagaggacccggcgggcccagagctgtgacaagctggagccagacagaagaagacctccagaccccaccggcaccagcgagcctggaacagactag

SEQ ID NO: 39641 - DNA, 555 bp, Artificial Sequence
  Description of Artificial Sequence: Synthetic coding sequence
atgctgaagaagatgggagaggccgtggcccgggtggccaggaaggtgaatgaaacagtggagagcggcagtgacaccctggacctggccgagtgcaagctggtgtccttccccatcggcatctacaaggtgctgagaaatgtgtctggccagatccacctgatcaccctggccaacaatgagctgaagagcctgaccagcaagttcatgaccaccttcagccagctgcgggagctgcacctggagggcaacttcctgcaccggctgcccagcgaggtgtctgccctgcagcacctgaaggccatcgacctgagcaggaaccagttccaggacttccctgagcagctgacagccctgcctgccctggagaccatcaacctggaggagaatgagatcgtggatgtgcctgtggagaagctggccgccatgcctgccctgcggagcatcaacctgcgcttcaaccccctgaatgctgaggtgcgggtgattgcccctcctctcatcaagtttgacatgctgatgagccctgagggcgcccgggcccccctgccctag

SEQ ID NO: 39642 - DNA, 387 bp, Artificial Sequence
  Description of Artificial Sequence: Synthetic coding sequence
atgctgaagaagatgggagaggccgtggcccgggtggccaggaaggtgaatgaaacagtggagagcggcagtgacaccctggacctggccgagtgcaagctggtgtccttccccatcggcatctacaaggtgctgagaaatgtgtctggccagatccacctgatcaccctggccaacaatgagctgaagagcctgaccagcaagttcatgaccaccttcagccagctgagagatgtgcctgtggagaagctggccgccatgcctgccctgcggagcatcaacctgcgcttcaaccccctgaatgctgaggtgcgggtgattgcccctcctctcatcaagtttgacatgctgatgagccctgagggcgcccgggcccccctgccctag

SEQ ID NO: 39643 - DNA, 405 bp, Artificial Sequence
  Description of Artificial Sequence: Synthetic coding sequence
atgctgaagaagatgggagaggccgtggcccgggtggccaggaaggtgaatgaaacagtggagagcggcagtgacaccctggagctgcacctggagggcaacttcctgcaccggctgcccagcgaggtgtctgccctgcagcacctgaaggccatcgacctgagcaggaaccagttccaggacttccctgagcagctgacagccctgcctgccctggagaccatcaacctggaggagaatgagatcgtggatgtgcctgtggagaagctggccgccatgcctgccctgcggagcatcaacctgcgcttcaaccccctgaatgctgaggtgcgggtgattgcccctcctctcatcaagtttgacatgctgatgagccctgagggcgcccgggcccccctgccctag

SEQ ID NO: 39644 - DNA, 555 bp, Artificial Sequence; identical to SEQ ID NO: 39641
  Description of Artificial Sequence: Synthetic coding sequence

SEQ ID NO: 39645 - DNA, 387 bp, Artificial Sequence; identical to SEQ ID NO: 39642
  Description of Artificial Sequence: Synthetic coding sequence

SEQ ID NO: 39646 - DNA, 405 bp, Artificial Sequence; identical to SEQ ID NO: 39643
  Description of Artificial Sequence: Synthetic coding sequence

SEQ ID NO: 39647 - DNA, 528 bp, Artificial Sequence
  Description of Artificial Sequence: Synthetic coding sequence
atgctgaagaagatgggagaggccgtggcccgggtggccaggaaggtgaatgaaacagtggagagcggcagtgacaccctggacctggccgagtgcaagctggtgtccttccccatcggcatctacaaggtgctgagaaatgtgtctggccagatccacctgatcaccctggccaacaatgagctgaagagcctgaccagcaagttcatgaccaccttcagccagctgcgggagctgcacctggagggcaacttcctgcaccggctgcccagcgaggtgtctgccctgcagcacctgaaggccatcgacctgagcaggaaccagttccaggacttccctgagcagctgacagccctgcctgccctggagaccatcaacctggaggagaatgagatcgtggatgtgcctgtggagaagctggccgccatgcctgccctgcggagcatcaacctgcgcttcaaccccctgaatgctgaggtgcgggtgattgcccctcctctcatcaagtttgacatgctgatgtcctag

SEQ ID NO: 39648 - DNA, 1032 bp, Artificial Sequence
  Description of Artificial Sequence: Synthetic coding sequence
atgtctgatgaagatgacctggaggacagcgagccagaccaggatgattctgagaaggaggaggatgagaaggagacagaggagggggaggactacaggaaggagggggaggagttccctgaggagtggctgcccacccccctgacagaggacatgatgaaggagggcctgagcctgctgtgcaagacaggaaatggcctggcccacgcctacgtgaagctggaggtgaaggagcgggacctgacagacatctacctgctgcggagctacatccacctgcgctacgtggacatcagcgagaaccacctgacagacctgagccccctgaactacctgacccacctgctgtggctgaaggcagatggcaaccggctgcggagcgcccagatgaatgagctgccctacctgcagatcgccagctttgcctacaaccagatcacagacacagagggcatcagccacccccggctggagaccctgaacctgaagggcaacagcatccacatggtgacaggcctggaccctgagaagctgatcagcctgcacacagtggagctgcggggcaaccagctggagagcaccctgggcatcaacctgcccaagctgaagaacctgtacctggcccagaacatgctgaagaaggtggagggcctggaggacctgagcaacctgaccaccctgcacctgcgggacaaccagattgacaccctgagcggcttcagccgggagatgaagagcctgcagtacctgaacctgcggggcaacatggtggccaacctgggggagctggccaagctgcgggacctgcccaagctgcgggccctggtgctgctggacaacccctgcacagatgagaccagctaccggcaggaggccctggtgcagatgccctacctggagcggctggacaaggagttctatgaggaggaggagagagctgaggctgatgtgatccggcagaggctgaaggaggagaaggagcaggagcctgagccccagagggacctggagcctgagcagagcctcatctag

SEQ ID NO: 39649 - DNA, 939 bp, Artificial Sequence
  Description of Artificial Sequence: Synthetic coding sequence
atgtctgatgaagatgacctggaggacagcgagccagaccaggatgattctgagaaggaggaggatgagaaggagacagaggagggggaggactacaggaaggagggggaggagttccctgaggagtggctgcccacccccctgacagaggacatgatgaaggagggcctgagcctgctgtgcaagacaggaaatggcctggcccacgcctacgtgaagctggaggtgaaggagcgggacctgacagacatctacctgctgcggagctacatccacctgcgctacgtggacatcagcgagaaccacctgacagacctgagccccctgaactacctgacccacctgctgtggctgaaggcagatggcaaccggctgcggagcgcccagatgaatgagctgccctacctgcagatcgccagctttgcctacaaccagatcacagacacagagggcatcagccacccccggctggagaccctgaacctgaagggcaacagcatccacatggtgacaggcctggaccctgagaagctgatcagcctgcacacagtggagctgcggggcaaccagctggagagcaccctgggcatcaacctgcccaagctgaagaacctgtacctggcccagaacatgctgaagaaggtggagggcctggaggacctgagcaacctgaccaccctgcacctgcgggacaaccagattgacaccctgagcggcttcagccgggagatgaagagcctgcagtacctgaacctgcggcgcagcaagaccctggccttccggccagaccagaccccccggggcagccaccacatgtatgaccgggagcagaggatgcctgtgtttgcccccaagctggagatccaccacaacctgcggccccgcatctgcagcgtgcctgtgctgtgggccgtgtggggcgctgagtggggcgcctag

SEQ ID NO: 39650 - DNA, 285 bp, Artificial Sequence
  Description of Artificial Sequence: Synthetic coding sequence
atgtctgatgaagatgacctggaggacagcgagccagaccaggatgattctgagaaggaggaggatgagaaggagacagaggagggggaggactacaggaaggagggggaggagttccctgaggagtggctgcccacccccctgacagaggacatgatgaaggagggcctgagcctgctgtgcaagacaggaaatggcctggcccacgcctacgtgaagctggaggtgaaggagcgggacctgacagacatctacctgctgcggagctacatccacctgaggtag

SEQ ID NO: 39651 - DNA, 1032 bp, Artificial Sequence; identical to SEQ ID NO: 39648
  Description of Artificial Sequence: Synthetic coding sequence

SEQ ID NO: 39652 - DNA, 1032 bp, Artificial Sequence; identical to SEQ ID NO: 39648
  Description of Artificial Sequence: Synthetic coding sequence

SEQ ID NO: 39653 - DNA, 1032 bp, Artificial Sequence; identical to SEQ ID NO: 39648
  Description of Artificial Sequence: Synthetic coding sequence

SEQ ID NO: 39654 - DNA, 1152 bp, Artificial Sequence
  Description of Artificial Sequence: Synthetic coding sequence
atggagggcagcagcagctatgaggtgcccagcgtggccgctgctgacctggaggagggcgccggccagaccaggagcctgcctgccacccccagcaaggatgtgcacaagggcgtgggcggcatcatcttcagcagcagccccatcctggacctgtctgagagcggcctgtgccgcctggaggaggtgttccgcatccccagcctgcagcagctgcacctgcagagaaatgccctgtgtgtgatcccccaggacttcttccagctgctgcccaacctgacctggctggacctgcgctacaaccgcatcaaggccctgcccagcggcatcggggcccaccagcacctgaagaccctgctgctggagaggaaccccatcaagatgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcatgtgttccgcaccagggtgcccaggaagcaggccctgcagaggctgcacgagaggaagacccgcatcatgggcgtggtgggccgggcccccacccacatgggagagggccggcagcccccacctggggccagctaccccaccagctgccacaggaccaagtggaggtctgagcagaaggactggaagagagctgagaggagaagaagtgagagcagcagaagaagccggctgtag

SEQ ID NO: 39655 - DNA, 510 bp, Artificial Sequence
  Description of Artificial Sequence: Synthetic coding sequence
atggagggcagcagcagctatgaggtgcccagcgtggccgctgctgacctggaggagggcgccggccagaccaggagcctgcctgccacccccagcaaggatgtgcacaagggcgtgggcggcatcatcttcagcagcagccccatcctggacctgtctgagagcggcctgtgccgcctggaggaggtgttccgcatccccagcctgcagcagctgcacctgcagagaaatgccctgtgtgtgatcccccaggacttcttccagctgctgcccaacctgacctggctggacctgcgctacaaccgcatcaaggccctgcccagcggcatcggggcccaccaggagaggaaccacgccgagagcacagagcccaagaccctgcccagcggcatccccagcagcgcccgctgtgccgagggcattggaggctacccagccctgcctgcagatgtgggcagcaggaccctgagcccccagaagagcaacttcagccggggcagcactggatag

SEQ ID NO: 39656 - DNA, 1407 bp, Artificial Sequence
  Description of Artificial Sequence: Synthetic coding sequence
atggacatcaacacctacaacaaccagctgcacctgcagagaaatgccctgtgtgtgatcccccaggacttcttccagctgctgcccaacctgacctggctggacctgcgctacaaccgcatcaaggccctgcccagcggcatcggggcccaccagcacctgaagaccctgctgctggagaggaaccccatcaagatgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcatgtgttccggaggaagacagccagcagccgcagcatcctgcctgacctgctgagcccctaccagatggccatccgggccaagaggctggaggagagcagagctgctgccctgcgggagctgcaggagaagcaggccctgatggagcagcagaggcgggagaagagggccctgcaggagtggagggagcgggcccagaggatgaggaagaggaaggaggagctgagcaagctgctgcccccaagaagatccatggtggccagcaagatccccagcgccacagacctgattgacaacaggaaggtgcccctgaaccccccaggcaagatgaagcccagcaaggagaagagcccccaggccagcaaggagatgtctgccctgcaggagaggaacctggaggagaagatcaagcagcacgtgctgcagatgagggagcagaggcgcttccacggccaggcccccctggaggagatgaggaaggctgctgaggacctggagatcgccacagagctgcaggatgaggtgctgaagctgaagctgggcctgaccctgaacaaggacagaagaagagctgccctgactggaaacctgagcctgggcctgcctgctgcccagccccagaacaccttcttcaacaccaagtacggggagagcggaaatgtgcggcgctaccagtag

SEQ ID NO: 39657 - DNA, 1407 bp, Artificial Sequence; identical to SEQ ID NO: 39656
  Description of Artificial Sequence: Synthetic coding sequence

SEQ ID NO: 39658 - DNA, 1593 bp, Artificial Sequence
  Description of Artificial Sequence: Synthetic coding sequence
atggagggcagcagcagctatgaggtgcccagcgtggccgctgctgacctggaggagggcgccggccagaccaggagcctgcctgccacccccagcaaggatgtgcacaagggcgtgggcggcatcatcttcagcagcagccccatcctggacctgtctgagagcggcctgtgccgcctggaggaggtgttccgcatccccagcctgcagcagctgcacctgcagagaaatgccctgtgtgtgatcccccaggacttcttccagctgctgcccaacctgacctggctggacctgcgctacaaccgcatcaaggccctgcccagcggcatcggggcccaccagcacctgaagaccctgctgctggagaggaaccccatcaagatgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcatgtgttccggaggaagacagccagcagccgcagcatcctgcctgacctgctgagcccctaccagatggccatccgggccaagaggctggaggagagcagagctgctgccctgcgggagctgcaggagaagcaggccctgatggagcagcagaggcgggagaagagggccctgcaggagtggagggagcgggcccagaggatgaggaagaggaaggaggagctgagcaagctgctgcccccaagaagatccatggtggccagcaagatccccagcgccacagacctgattgacaacaggaaggtgcccctgaaccccccaggcaagatgaagcccagcaaggagaagagcccccaggccagcaaggagatgtctgccctgcaggagaggaacctggaggagaagatcaagcagcacgtgctgcagatgagggagcagaggcgcttccacggccaggcccccctggaggagatgaggaaggctgctgaggacctggagatcgccacagagctgcaggatgaggtgctgaagctgaagctgggcctgaccctgaacaaggacagaagaagagctgccctgactggaaacctgagcctgggcctgcctgctgcccagccccagaacaccttcttcaacaccaagtacggggagagcggaaatgtgcggcgctaccagtag

SEQ ID NO: 39659 - DNA, 1593 bp, Artificial Sequence; identical to SEQ ID NO: 39658
  Description of Artificial Sequence: Synthetic coding sequence

SEQ ID NO: 39660 - DNA, 1152 bp, Artificial Sequence
  Description of Artificial Sequence: Synthetic coding sequence
atggagggcagcagcagctatgaggtgcccagcgtggccgctgctgacctggaggagggcgccggccagaccaggagcctgcctgccacccccagcaaggatgtgcacaagggcgtgggcggcatcatcttcagcagcagccccatcctggacctgtctgagagcggcctgtgccgcctggaggaggtgttccgcatccccagcctgcagcagctgcacctgcagagaaatgccctgtgtgtgatcccccaggacttcttccagctgctgcccaacctgacctggctggacctgcgctacaaccgcatcaaggccctgcccagcggcatcggggcccaccagcacctgaagaccctgctgctggagaggaaccccatcaagatgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcatgtgttccggaggaagacagccagcagccgcagcatcctgcctgacctgctgagcccctaccagatggccatccgggccaagaggctggaggagagcagagctgctgccctgcgggagctgcaggagaagcaggccctgatggagcagcagaggcggcccttcctgctgatcttccccagggtcttccaggccctgaccaggagcagcggccgcttcatcctggtgctgctgtag

SEQ ID NO: 39661 - DNA, 1152 bp, Artificial Sequence; identical to SEQ ID NO: 39654
  Description of Artificial Sequence: Synthetic coding sequence

SEQ ID NO: 39662 - DNA, 1107 bp, Artificial Sequence
  Description of Artificial Sequence: Synthetic coding sequence
atgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcatgtgttccggaggaagacagccagcagccgcagcatcctgcctgacctgctgagcccctaccagatggccatccgggccaagaggctggaggagagcagagctgctgccctgcgggagctgcaggagaagcaggccctgatggagcagcagaggcgggagaagagggccctgcaggagtggagggagcgggcccagaggatgaggaagaggaaggaggagctgagcaagctgctgcccccccggcgctccatggtggccagcaagatccccagcgccacagacctgattgacaacaggaaggtgcccctgaaccccccaggcaagatgaagcccagcaaggagaagagcccccaggccagcaaggagatgtctgccctgcaggagaggaacctggaggagaagatcaagcagcacgtgctgcagatgagggagcagaggcgcttccacggccaggcccccctggaggagatgaggaaggctgctgaggacctggagatcagccgccgctgggagcggggcggcatgagagctggctgtggggccacctcctggaggccccaccccacctag

SEQ ID NO: 39663 - DNA, 777 bp, Artificial Sequence
  Description of Artificial Sequence: Synthetic coding sequence
tgattccgcacctctgtgtccacccccagcggcaacacagacatggacatcaacacctacaacaaccagctgcacctgcagagaaatgccctgtgtgtgatcccccaggacttcttccagctgctgcccaacctgacctggctggacctgcgctacaaccgcatcaaggccctgcccagcggcatcggggcccaccagcacctgaagaccctgctgctggagaggaaccccatcaagatgctgcctgtggagctgggctctgtgaccaccctgaaggccctgaacctgcggcactgccccctggagttccccccccagctggtggtgcagaagggcctggtggccatccagcgcttcctgaggatgtgggccgtggagcacagcctgcccaggaaccccaccagccaggaggcccctcctgtgcgggagatgaccctgcgggacctgcccagccctggcctggagctgagcggggaccacgccagcaaccagggcgctgtgaatgcccaggaccctgagggcgctgtgatgaaggagaaggccagcttcctgccccctgtggagaagccagacctgtctgagctgaggaagtctgctgacagcagcgagaactggcccagcgaggaggagatccgccgcttctggaagctgcggcaggagatcgtggagcacgtgaaggcagatgtgctgggggaccagctgctgacccgggagctgccccccaacctgaaggccgccctgaacatcgagaaggagctgcccaagcccaggcactag

SEQ ID NO: 39664 - DNA, 1104 bp, Artificial Sequence
  Description of Artificial Sequence: Synthetic coding sequence
atggccagcgagctgtgcaagaccatctctgtggcccggctggagaagcacaagaacctcttcctgaactacagaaacctgcaccacttccccctggagctgctgaaggatgagggcctgcagtacctggagcggctgtacatgaagaggaacagcctgaccagcctgcctgagaacctggcccagaagctgcccaacctggtggagctgtacctgcacagcaacaacatcgtggtggtgcctgaggccatcggcagcctggtgaagctgcagtgcctggacctgagtgacaatgccctggagatcgtgtgcccagaaattggccgcctgcgggccctgcggcacctgcggctggccaacaaccagctgcagttcctgcccccagaggtgggggacctgaaggagctgcagaccctggacatcagcaccaaccggctgctgaccctgcctgagcggctgcacatgtgcctgagcctgcagtacctgactgtggacaggaaccggctgtggtacgtgcccaggcacctgtgccagctgcccagcctgaatgagctgtccatggccggcaaccggctggccttcctgcccctggacctgggccgcagccgggagctgcagtatgtgtatgtggacaacaacatccacctgaagggcctgcccagctacctgtacaacaaggtgattggctgcagcggctgtggggcccccatccaggtgtctgaggtgaagctgctgtccttcagcagcggccagaggacagtgttcctgcctgctgaggtgaaggccatcggcacagaacatgaccacgtgctgcccctgcaggagctggccatgaggggcctgtaccacacctaccacagcctgctgaaggacctgaacttcctgagccccatcagcctgcccaggagcctgctggagctgctgcactgccccctgggccactgccaccgctgcagcgagcccatgttcaccatcgtgtaccccaagctgttccccctgcgggagacccccatggccggcctgcaccagtggaagaccaccgtgtcctttgtggcctactgctgcagcacccagtgcctgcagacctttgacctgctgtcctag

SEQ ID NO: 39665 - DNA, 897 bp, Artificial Sequence
  Description of Artificial Sequence: Synthetic coding sequence
atggccagcgagctgtgcaagaccatctctgtggcccggctggagaagcacaagaacctcttcctgaactacagaaacctgcaccacttccccctggagctgctgaaggatgagggcctgcagtacctggagcggctgtacatgaagaggaacagcctgaccagcctgcctgagaacctggcccagaagctgcccaacctggtggagctgtacctgcacagcaacaacatcgtggtggtgcctgaggccatcggcagcctggtgaagctgcagtgcctggacctgagtgacaatgccctggagatcgtgtgcccagaaattggccgcctgcgggccctgcggcacctgcggctggccaacaaccagctgcagttcctgcccccagacctgggccgcagccgggagctgcagtatgtgtatgtggacaacaacatccacctgaagggcctgcccagctacctgtacaacaaggtgattggctgcagcggctgtggggcccccatccaggtgtctgaggtgaagctgctgtccttcagcagcggccagaggacagtgttcctgcctgctgaggtgaaggccatcggcacagaacatgaccacgtgctgcccctgcaggagctggccatgaggggcctgtaccacacctaccacagcctgctgaaggacctgaacttcctgagccccatcagcctgcccaggagcctgctggagctgctgcactgccccctgggccactgccaccgctgcagcgagcccatgttcaccatcgtgtaccccaagctgttccccctgcgggagacccccatggccggcctgcaccagtggaagaccaccgtgtcctttgtggcctactgctgcagcacccagtgcctgcagacctttgacctgctgtcctag

SEQ ID NO: 39666 - DNA, 456 bp, Artificial Sequence
  Description of Artificial Sequence: Synthetic coding sequence
atggccagcgagctgtgcaagaccatctctgtggcccggctggagaagcacaagaacctcttcctgaactacagaaacctgcaccacttccccctggagctgctgaaggatgagggcctgcagtacctggagcggctgtacatgaagaggaacagcctgaccagcctgcctgagaacctggcccagaagctgcccaacctggtggagctgtacctgcacagcaacaacatcgtggtggtgcctgaggccatcggcagcctggtgaagctgcagtgcctggacctgagtgacaatgccctggagatcgtgtgcccagaaattggccgcctgcgggccctgcggcacctgcggctggccaacaaccagctgcagttcctgccccctgtgccccactgcggccccaagagctccatggtgtgtgccgcccccagcctgcctgctgcccagccccagtag

SEQ ID NO: 39667 - DNA, 939 bp, Artificial Sequence
  Description of Artificial Sequence: Synthetic coding sequence
atggccagcgagctgtgcaagaccatctctgtggcccggctggagaagcacaagaacctcttcctgaactacagaaacctgcaccacttccccctggagctgctgaaggatgagggcctgcagtacctggagcggctgtacatgaagaggaacagcctgaccagcctgcctgagaacctggcccagaagctgcccaacctggtggagctgtacctgcacagcaacaacatcgtggtggtgcctgaggccatcggcagcctggtgaagctgcagtgcctggacctgagtgacaatgccctggagatcgtgtgcccagaaattggccgcctgcgggccctgcggcacctgcggctggccaacaaccagctgcagttcctgcccccagaggtgggggacctgaaggagctgcagaccctggacatcagcaccaaccggctgctgaccctgcctgagcggctgcacatgtgcctgagcctgcagtacctgactgtggacaggaaccggctgtggtacgtgcccaggcacctgtgccagctgcccagcctgaatgagctgtccatggccggcaaccggctggccttcctgcccctggacctgggccgcagccgggagctgcagtatgtgtatgtggacaacaacatccacctgaagggcctgcccagctacctgtacaacaaggtgattggctgcagcggctgtggggcccccatccaggtgtctgaggtgaagctgctgtccttcagcagcggccagaggacagtgttcctgcctgctgaggtgaaggccatcggcacagaacatgaccacgtgctgcccctgcaggagctggccatgaggggcctgtaccacacctaccacagcctgctgaagggccggcagctgctggtgctgtggctgacagctgcccctccttctgtgtgccgcctgctgacctgctag

SEQ ID NO: 39668 - DNA, 513 bp, Artificial Sequence
  Description of Artificial Sequence: Synthetic coding sequence
atggccagcgagctgtgcaagaccatctctgtggcccggctggagaagcacaagaacctcttcctgaactacagaaacctgcaccacttccccctggagctgctgaaggatgagggcctgcagtacctggagcggctgtacatgaagaggaacagcctgaccagcctgcctgagaacctggcccagaagctgcccaacctggtggagctgtacctgcacagcaacaacatcgtggtggtgcctgaggccatcggcagcctggtgaagctgcagtgcctggacctgagtgacaatgccctggagatcgtgtgcccagaaattggccgcctgcgggccctgcggcacctgcggctggccaacaaccagctgcagttcctgcccccagaggtgggggacctgaaggagctgcagaccctggacatcagcaccaaccggctgctgaccctgcctgagcggctgcacatgtgcctgagcctgcagtacctgactgtggacaggaaccggctgtggtag

SEQ ID NO: 39669 - DNA, 672 bp, Artificial Sequence
  Description of Artificial Sequence: Synthetic coding sequence
atgtacagcagcggctggccagctggagctgctgagcccaggcatggccggggccgggagctggcccaggccctgggctgcatgcatggagcccccagccagctggccagcctgagcctggcccactgcagcagcctgaagagcaggcctgagctggagcaccaggccagcggcaccaaggatgcctgcccagagccccagggccccagcctgctgaccctgcgggccctgcaggagctggacctgacagcctgcagcaagctgacagatgccagcctggccaaggtgctgcagttcctgcagctgcggcagctgagcctgagcctgctgcctgagctgacagacaatggcctggtggccgtggcccggggctgccccagcctggagcacctggccctgagccactgcagccggctgagtgacaagggctgggcccaggccgccagctcctggccccggctgcagcacctgaacctgagcagctgcagccagctgattgagcagaccctggatgccatcggccaggcctgccggcagctgcgggtgctggatgtggccacctgccccggcatcaacatggctgctgtgcggcgcttccaggcccagctgccccaggtgtcctgtgtgcagagcagatttgtgggcggcgctgacctgaccctgaccctgtag

SEQ ID NO: 39670 - DNA, 672 bp, Artificial Sequence; identical to SEQ ID NO: 39669
  Description of Artificial Sequence: Synthetic coding sequence

SEQ ID NO: 39671 - DNA, 672 bp, Artificial Sequence; identical to SEQ ID NO: 39669
  Description of Artificial Sequence: Synthetic coding sequence

SEQ ID NO: 39672 - DNA, 672 bp, Artificial Sequence; identical to SEQ ID NO: 39669
  Description of Artificial Sequence: Synthetic coding sequence

SEQ ID NO: 39673 - DNA, 498 bp, Artificial Sequence
  Description of Artificial Sequence: Synthetic coding sequence
atgtacagcagcggctggccagctggagctgctgagcccaggcatggccggggccgggagctggcccaggccctgggctgcatgcatggagcccccagccagctggccagcctgagcctggcccactgcagcagcctgaagagcaggcctgagctggagcaccaggccagcggcaccaaggatgcctgcccagagccccagggccccagcctgctgaccctgcgggccctgcaggagctggacctgacagcctgcagcaagctgacagatgccagcctggccaaggtgctgcagttcctgcagctgcggcagctgagcctgagcctgctgcctgagctgacagacaatggcctggtggccgtggcccggggctgccccagcctggagcacctggccctgagccactgcagccggctgagtgacaagggctgggcccaggccgccagctcctggccccggctgcagcacctgaacctgagcagctgcagccagctgtag

SEQ ID NO: 39674 - DNA, 906 bp, Artificial Sequence
  Description of Artificial Sequence: Synthetic coding sequence
atgggcgcccggcagagccgggccagcagcaaggacaagggccccaagaggatgctgttcaccggccggcggcagaagttcagcccctgggatgatgccctgctgagcggccgggaccccaggagcctgctgaagaggggcatgcaccacgtgtccttcagcctggtgacccggggcatgacagacatcccagacttcctgtggggcctgtctgaggtgcagaagctgaacctgagccacaaccagctgcgggtgctgcccccagaggtgggcaagctgacccgcatcgtggtgctgaacctgtgtggcaaccggctgaagagcctgccccgggaggtgtccctgctgcagtgcctgaaggtgctgtttgtgaacatgaactgcctgacagaggtgcctgctgagctgagcctgtgcaggaagctggaggtgctgagcctgagccacaactgcctgagccagctgcctgcctgctttgctgacctgagccggctgaggaagctgaacctgagcaacaacttctttgcccacatccccatgtgtgtgttcagcctgaaggagctgatcttcctgcacgtgggcagcaaccggctggagaacattgctgagagcatccagcacctggccagcctgcagatcttcatcgccgagggcaacaacatccacagcttccccaggagcctgtgcctggtgaccagcctggagctgctgaacctgaacaacaatgacatccagaccctgcccagcgagctgcacctgctgtgccgcctggtgcgcatcgcctggaaccccatggacaagggcctgcacatcagccacaaccccctgagcaagcccctgcctgagctggtggagggcggcctggagatgctgtttggctacctgaaggacaagaagcacacctag

SEQ ID NO: 39675 - DNA, 1491 bp, Artificial Sequence
  Description of Artificial Sequence: Synthetic coding sequence
atgagccagaccaggaagaagaccagcagcgagggggagaccaagccccagaccagcacagtgaacaagttcctgcggggcagcaatgctgagagcaggaaagaagataatgacctgaagaccagtgacagccagcccagcgactggatccagaagacagccaccagcgagacagccaagcccctgagcagcgagatggagtggaggagctccatggagaagaatgagcacttcctgcagaagctgggcaagaaggctgtgaacaagtgcctggacctgaacaactgtggcctgaccacagctgacatgaaggagatgggagaggcctttgagatgatccctgagctggaggagctgaacctgtcctggaacagcaaggtgggcggcaacctgcccctcatcctgcagaagttccagaagggcagcaagatccagatgattgagctggtggactgcagcctgaccagtgaagatggcaccttcctgggccagctgctgcccatgctgcagagcctggaggtgctggacctgagcatcaacagagacatcgtgggcagcctgaacagcatcgcccagggcctgaagagcaccagcaacctgaaggtgctgaagctgcacagctgtggcctgagccagaagtctgtgaagatcctggatgctgccttccgctacctgggggagctgaggaagctggacctgagctgcaacaaggacctgggcggcggctttgaggacagccctgcccagctggtgatgctgaagcacctgcaggtgctggacctgcaccagtgcagcctgacagcagatgatgtgatgagcctgacccaggtgatccccctgctgagcaacctgcaggagctggacctgagcgccaacaagaagatgggcagcagcagcgagaacctgctgagccggctgcgcttcctgcctgccctgaagagcctggtgatcaacaactgtgccctggagagcgagaccttcaccgccctggccgaggcctctgtgcacctgagcgccctggaggtgttcaacctgtcctggaacaagtgtgtgggcggcaacctgaagctgctgctggagaccctgaagctgtccatgagcctgcaggtgctgcggctgagcagctgcagcctggtgacagaagatgtggccctgctggccagcgtcatccagacaggccacctggccaagctgcagaagctggacctgagctacaatgacagcatctgtgatgctggctggaccatgttctgccagaatgtgcgcttcctgaaggagctgattgagctggacatcagcctgcggcccagcaacttccgggactgtggccagtggttccgccacctgctgtatgctgtgaccaagctgccccagatcacagagatcggcatgaagcgctggatcctgcctgccagccaggaggaggagctggagtgctttgaccaggacaagaagaggagcatccactttgaccacggcggcttccagtag

SEQ ID NO: 39676 - DNA, 1659 bp, Artificial Sequence
  Description of Artificial Sequence: Synthetic coding sequence
atgagccagaccaggaagaagaccagcagcgagggggagaccaagccccagaccagcacagtgaacaagttcctgcggggcagcaatgctgagagcaggaaagaagataatgacctgaagaccagtgacagccagcccagcgactggatccagaagacagccaccagcgagacagccaagcccctgagcagcgagatggagtggaggagctccatggagaagaatgagcacttcctgcagaagctgggcaagaaggctgtgaacaagtgcctggacctgaacaactgtggcctgaccacagctgacatgaaggagatggtggccctgctgcccttcctgcctgacctggaggagctggacatctcctggaatggatttgtgggcggcaccctgctgagcatcacccagcagatgcacctggtgtccaagctgaagatcctgcggctgggcagctgccgcctgaccacagatgatgtgcaggccctgggggaggcctttgagatgatccctgagctggaggagctgaacctgtcctggaacagcaaggtgggcggcaacctgcccctcatcctgcagaagttccagaagggcagcaagatccagatgattgagctggtggactgcagcctgaccagtgaagatggcaccttcctgggccagctgctgcccatgctgcagagcctggaggtgctggacctgagcatcaacagagacatcgtgggcagcctgaacagcatcgcccagggcctgaagagcaccagcaacctgaaggtgctgaagctgcacagctgtggcctgagccagaagtctgtgaagatcctggatgctgccttccgctacctgggggagctgaggaagctggacctgagctgcaacaaggacctgggcggcggctttgaggacagccctgcccagctggtgatgctgaagcacctgcaggtgctggacctgcaccagtgcagcctgacagcagatgatgtgatgagcctgacccaggtgatccccctgctgagcaacctgcaggagctggacctgagcgccaacaagaagatgggcagcagcagcgagaacctgctgagccggctgcgcttcctgcctgccctgaagagcctggtgatcaacaactgtgccctggagagcgagaccttcaccgccctggccgaggcctctgtgcacctgagcgccctggaggtgttcaacctgtcctggaacaagtgtgtgggcggcaacctgaagctgctgctggagaccctgaagctgtccatgagcctgcaggtgctgcggctgagcagctgcagcctggtgacagaagatgtggccctgctggccagcgtcatccagacaggccacctggccaagctgcagaagctggacctgagctacaatgacagcatctgtgatgctggctggaccatgttctgccagaatgtgcgcttcctgaaggagctgattgagctggacatcagcctgcggcccagcaacttccgggactgtggccagtggttccgccacctgctgtatgctgtgaccaagctgccccagatcacagagatcggcatgaagcgctggatcctgcctgccagccaggaggaggagctggagtgctttgaccaggacaagaagaggagcatccactttgaccacggcggcttccagtag

SEQ ID NO: 39677 - DNA, 1260 bp, Artificial Sequence
  Description of Artificial Sequence: Synthetic coding sequence
atgggcagcagccgggaggccgcccgggccccagcccggagccctgcctgggccagcacccaggccagcaccccaggagctgccctggccgtgcagcgggagagccctgagagcggcctgcagaagcactacagcaacctgtgcatggagaagagccagaagatcaaccccttcatcctgcacatcctgcaggaggtggatgaggagatcaagaagggcctggccgccggcatcaccctgaacattgctggcaacaaccggctggtgcctgtggagcgggtgactggagaggacttctggatcctgagcaagatcctgaagaactgcctgtacatcaatggcctggatgtgggctacaacctgctgtgtgatgtgggcgcctactatgctgccaagctgctgcagaagcagctgaacctgatctacctgaacctgatgtttaatgacatcggccctgagggcggggagctgattgccaaggtgctgcacaagaacagaaccctgaagtacctgaggatgacaggcaacaagattgaaaataaaggaggcatgttctttgctgccatgctgcagatcaacagcagcctggagaagctggacctgggggactgtgacctggaggagagcacagtgcacgtgggccgcatgctgaaggagaaccactgcctggtggccctgcacatgtgcaagcatgacatcaagaacagcggcatccagcagctgtgtgatgccctgtacctgaacagcagcctgcgctacctggatgtgtcctgcaacaagatcacccatgatggcatggtgtacctggctgatgtgctgaagagcaacaccaccctggaggtgattgacctgtccttcaacagaattgaaaatgctggggccaactacctgtctgagaccctgaccagccacaacagaagcctgaaggccctgtctgtggtgagcaacaacatcgagggggagggcctggtggccctgagccagagcatgaagaccaacctgaccttcagccacatctacatctggggcaacaagtttgatgaggccacctgcatcgcctacagcgacctgatccagatgggctgcctgaagccagacaacacagatgtggagccctttgtggtggatggccgggtgtacctggccgaggtgtccaatggcctgaagaagcactactactggaccagcacctacggggagagctatgaccacagcagcaatgccggctttgccctggtgcctgtgggccagcagccctag

SEQ ID NO: 39678 - DNA, 1395 bp, Artificial Sequence
  Description of Artificial Sequence: Synthetic coding sequence
atggccgcccagccccccaggcctgtgggggagaggtccatgggcagcagccgggaggccgcccgggccccagcccggagccctgcctgggccagcacccaggccagcacccctggggccgccctggccgtgcagcgggagagccctgagagcggcctgcagaagcactacagcaacctgtgcatggagaagagccagaagatcaaccccttcatcctgcacatcctgcaggaggtggatgaggagatcaagaagggcctggccgccggcatcaccctgaacattgctggcaacaaccggctggtgcctgtggagcgggtgactggagaggacttctggatcctgagcaagatcctgaagaactgcctgtacatcaatggcctggatgtgggctacaacctgctgtgtgatgtgggcgcctactatgctgccaagctgctgcagaagcagctgaacctgatctacctgaacctgatgtttaatgacatcggccctgagggcggggagctgattgccaaggtgctgcacaagaacagaaccctgaagtacctgaggatgactggaaacaagattgagaacaagggcggcatgttctttgctgccatgctgcagatcaacagcagcctggagaagctggacctgggggactgtgacctgggcatgcagagcgtgattgcctttgccaccgtgctgacccagaaccaggccatcaaggccatcaacctgaaccggcccatcctgtacagcgagcaggaggagagcacagtgcacgtgggccgcatgctgaaggagaaccactgcctggtggccctgcacatgtgcaagcatgacatcaagaacagcggcatccagcagctgtgtgatgccctgtacctgaacagcagcctgcgctacctggatgtgtcctgcaacaagatcacccatgatggcatggtgtacctggctgatgtgctgaagagcaacaccaccctggaggtgattgacctgtccttcaacagaattgaaaatgctggggccaactacctgtctgagaccctgaccagccacaacagaagcctgaaggccctgtctgtggtgagcaacaacattgaaggagagggcctggtggccctgagccagagcatgaagaccaacctgaccttcagccacatctacatctggggcaacaagtttgatgaggccacctgcatcgcctacagcgacctgatccagatgggctgcctgaagccagacaacacagatgtggagccctttgtggtggatggccgggtgtacctggccgaggtgtccaatggcctgaagaagcactactactggaccagcacctatggagagagctatgaccacagcagcaatgccggctttgccctggtgcctgtgggccagcagccctag

SEQ ID NO: 39679 - DNA, 1299 bp, Artificial Sequence
  Description of Artificial Sequence: Synthetic coding sequence
atggccgcccagccccccaggcctgtgggggagaggtccatgggcagcagccgggaggccgcccgggccccagcccggagccctgcctgggccagcacccaggccagcacccctggggccgccctggccgtgcagcgggagagccctgagagcggcctgcagaagcactacagcaacctgtgcatggagaagagccagaagatcaaccccttcatcctgcacatcctgcaggaggtggatgaggagatcaagaagggcctggccgccggcatcaccctgaacattgctggcaacaaccggctggtgcctgtggagcgggtgactggagaggacttctggatcctgagcaagatcctgaagaactgcctgtacatcaatggcctggatgtgggctacaacctgctgtgtgatgtgggcgcctactatgctgccaagctgctgcagaagcagctgaacctgatctacctgaacctgatgtttaatgacatcggccctgagggcggggagctgattgccaaggtgctgcacaagaacagaaccctgaagtacctgaggatgactggaaacaagattgagaacaagggcggcatgttctttgctgccatgctgcagatcaacagcagcctggagaagctggacctgggggactgtgacctggaggagagcacagtgcacgtgggccgcatgctgaaggagaaccactgcctggtggccctgcacatgtgcaagcatgacatcaagaacagcggcatccagcagctgtgtgatgccctgtacctgaacagcagcctgcgctacctggatgtgtcctgcaacaagatcacccatgatggcatggtgtacctggctgatgtgctgaagagcaacaccaccctggaggtgattgacctgtccttcaacagaattgaaaatgctggggccaactacctgtctgagaccctgaccagccacaacagaagcctgaaggccctgtctgtggtgagcaacaacattgaaggagagggcctggtggccctgagccagagcatgaagaccaacctgaccttcagccacatctacatctggggcaacaagtttgatgaggccacctgcatcgcctacagcgacctgatccagatgggctgcctgaagccagacaacacagatgtggagccctttgtggtggatggccgggtgtacctggccgaggtgtccaatggcctgaagaagcactactactggaccagcacctatggagagagctatgaccacagcagcaatgccggctttgccctggtgcctgtgggccagcagccctag

SEQ ID NO: 39680 - DNA, 981 bp, Artificial Sequence
  Description of Artificial Sequence: Synthetic coding sequence
atgacccgggagggctaccaggtgtccttcctggacaacaagagcagcggcagcagccctgagaaggagctgatccccaagccagacaccttccacctgacccatgatgccagcctgagcaagtgcctggatgtgggggacagcagccagatccacccctaccagctgcccagtgatgtgggcctggagaactatgacagctgctacagccagaccctgagcctgcacggcagcctgggcaagaggccccagaggagcaagaactaccaggagtacagcatcaagcccagcaatgacatcaagaccacagccagccacagctgtggggacctgctgaccagcctgagcaacccagacagcagcacaggccgcctgctgaagctgagcagtgacctgtatgccaccacccacttcaacagcgaccctgctgtgctggtgaatgtggagcagcagctgagcaccagcctggatgacctgaccccagcccacggctctgtgcccaacaatgctgtgctgggcaacagaaccacccccctgcggaccctgctgctgagccctggcaccagcgagcacaggaagatcttcaccaagaggagcctgagccccagcaagaggggcttcaagtggaaggacaacatcctggccaacctgaacctgaagcacggcttccaggatgccactggaagtgagcccctgagcagtgacctgggcagcctgcacggcctggccggcaaccacagcccccccatcagcgcccggaccccccacgtggccaccgtgctgcggcagctgctggagctggtggacaagcactggaatggaagtggcagcctgctgctgaacaagaagttcctgggcaagtttgaggccaagacaggccagagcgctgggggcaagccccactttgtgaggaagaacagcacagtgggcggccgctgctgccacctgaactgtgagtgggccaccgtgacctacctgtag

SEQ ID NO: 39681 - DNA, 2265 bp, Artificial Sequence
  Description of Artificial Sequence: Synthetic coding sequence
atggccgagcagtgggagctggatgaggagggcatccggcggctgggcgccctgaccctggagcagcctgagctggtggagagcctgagcctgcagggcagctatgctgggaagatccacagcattggagatgccttcaggaacttcaagaacctgcggagcctggacctgagcaggaacctgatcaccagcctgaagggcatccagtacctgtgcagcctgcaggacctgaacctgtactacaacaacatccccagcctggtggaggtgtcccggctgcagcccctgcccttcctgaaggagctggacctgcggctgaaccctgtggtgaggaaggacacagactaccgcctgtttgctgtgtacaccctgcagaccctggagaagctggatgacagaacagtgcgggagggggagaggaaggccgccaagctgcacttcagccagctgggcaacagcgagaacttcctgctggaggtggagaagagcagccgggagaagaccatgaagaactgtgtgactggagagagcagcgccagcaaggtgtctgccaacgtggacagccgcatcgagatggacagcaacaagggcctcttcatccccttccccaaccgggagatcaaggacagcctgagcaccagcgccacccagggcaatggcacccgggaccagaagctggacaccttccccctgggcacccagacccaggaggtggcccggcgggagatgcccagcgacaaccaccaggaggatgagttccgccactacagcccccggcagagcacagtgcgcagccctgagaagatgacccgggagggctaccaggtgtccttcctggacaacaagagcagcggcagcagccctgagaaggagctgatccccaagccagacaccttccacctgacccatgatgccagcctgagcaagtgcctggatgtgggggacagcagccagatccacccctaccagctgcccagtgatgtgggcctggagaactatgacagctgctacagccagaccctgagcctgcacggcagcctgggcaagaggccccagaggagcaagaactaccaggagtacagcatcaagcccagcaatgacatcaagaccacagccagccacagctgtggggacctgctgaccagcctgagcaacccagacagcagcacaggccgcctgctgaagctgagcagtgacctgtatgccaccacccacttcaacagcgaccctgctgtgctggtgaatgtggagcagcagctgagcaccagcctggatgacctgaccccagcccacggctctgtgcccaacaatgctgtgctgggcaacagaaccacccccctgcggaccctgctgctgagccctggcaccagcgagcacaggaagatcttcaccaagaggagcctgagccccagcaagaggggcttcaagtggaaggacaacatcctggccaacctgaacctgaagcacggcttccaggatgccactggaagtgagcccctgagcagtgacctgggcagcctgcacggcctggccggcaaccacagcccccccatcagcgcccggaccccccacgtggccaccgtgctgcggcagctgctggagctggtggacaagcactggaatggaagtggcagcctgctgctgaacaagaagttcctgggccctgcccgggacctgctgctgagcctggtggtgcctgcccccagccagccccgctgctgcagccaccctgaggacaccatgaaggccttctgccggcgggagctggagctgaaggaggccgcccagctggtgcccaatgacatggagagcctgaagcagaagctggtgcgggtgctggaggagaacctgatcctgtctgagaagatccagcagctggaggagggcgccgccatcagcatcgtgtctggccagcagagccacacctatgatgacctgctgcacaagaaccagcagctgaccatgcaggtggcctgcctgaaccaggagctggcccagctgaagaagctggagaagacagtggccatcctgcacgagagccagaggagcctggtggtgaccaatgagtacctgctgcagcagctgaacaaggagcccaagggctacagcggcaaggccctgctgcccccagagaagggccaccacctgggccgcagcagcccctttgggaagagcaccctgagcagcagcagccctgtggcccatgaaacaggccagtacctgatccagagcgtgctggatgctgcccctgagcccggcctgtag

SEQ ID NO: 39682 - DNA, 1590 bp, Artificial Sequence
  Description of Artificial Sequence: Synthetic coding sequence
atgctgcggccccgcttcctgcccccagatgacagaacagtgcgggagggggagaggaaggccgccaagctgcacttcagccagctgggcaacagcgagaacttcctgctggaggtggagaagagcagccgggagaagaccatgaagaactgtgtgactggagagagcagcgccagcaaggtgtctgccaacgtggacagcagaattgagatggacagcaacaagggcctcttcatccccttccccaaccgggagatcaaggacagcctgagcaccagcgccacccagggcaatggcacccgggaccagaagctggacaccttccccctgggcacccagacccaggaggtggcccggcgggagatgcccagcgacaaccaccaggaggatgagttccgccactacagcccccggcagagcacagtgcgcagccctgagaagatgacccgggagggctaccaggtgtccttcctggacaacaagagcagcggcagcagccctgagaaggagctgatccccaagccagacaccttccacctgacccatgatgccagcctgagcaagtgcctggatgtgggggacagcagccagatccacccctaccagctgcccagtgatgtgggcctggagaactatgacagctgctacagccagaccctgagcctgcacggcagcctgggcaagaggccccagaggagcaagaactaccaggagtacagcatcaagcccagcaatgacatcaagaccacagccagccacagctgtggggacctgctgaccagcctgagcaacccagacagcagcacaggccgcctgctgaagctgagcagtgacctgtatgccaccacccacttcaacagcgaccctgctgtgctggtgaatgtggagcagcagctgagcaccagcctggatgacctgaccccagcccacggctctgtgcccaacaatgctgtgctgggcaacagaaccacccccctgcggaccctgctgctgagccctggcaccagcgagcacaggaagatcttcaccaagaggagcctgagccccagcaagaggggcttcaagtggaaggacaacatcctggccaacctgaacctgaagcacggcttccaggatgccaccggcagcgaggagagcctgaagcagaagctggtgcgggtgctggaggagaacctgatcctgtctgagaagatccagcagctggaggagggcgccgccatcagcatcgtgtctggccagcagagccacacctatgatgacctgctgcacaagaaccagcagctgaccatgcaggtggcctgcctgaaccaggagctggcccagctgaagaagctggagaagacagtggccatcctgcacgagagccagaggagcctggtggtgaccaatgagtacctgctgcagcagctgaacaaggagcccaagggctacagcggcaaggccctgctgcccccagagaagggccaccacctgggccgcagcagcccctttgggaagagcaccctgagcagcagcagccctgtggcccacgagaccggccagtacctgatccagagcgtgctggatgctgcccctgagcccggcctgtag

SEQ ID NO: 39683 - DNA, 681 bp, Artificial Sequence
  Description of Artificial Sequence: Synthetic coding sequence
atggagggccagtacccctgccagcctgagagcaaggcctggttcccccgctgctaccggcagagggtgacctgggtggtgtgcaccgtgtggctggagaccaccgtgccccccagcctgcctgagccccccatgtggcccctgagcagtgacagctcctggagcctgtggatcagcacaggcatggccccagcccccagcagcagcaccaggagcttcagcgagagcctgaagcagaagctggtgcgggtgctggaggagaacctgatcctgtctgagaagatccagcagctggaggagggcgccgccatcagcatcgtgtctggccagcagagccacacctatgatgacctgctgcacaagaaccagcagctgaccatgcaggtggcctgcctgaaccaggagctggcccagctgaagaagctggagaagacagtggccatcctgcacgagagccagaggagcctggtggtgaccaatgagtacctgctgcagcagctgaacaaggagcccaagggctacagcggcaaggccctgctgcccccagagaagggccaccacctgggccgcagcagcccctttgggaagagcaccctgagcagcagcagccctgtggcccatgaaacaggccagtacctgatccagagcgtgctggatgctgcccctgagcccggcctgtag

SEQ ID NO: 39684 - DNA, 1902 bp, Artificial Sequence
  Description of Artificial Sequence: Synthetic coding sequence
atgctgcggccccgcttcctgcccccagatgacagaacagtgcgggagggggagaggaaggccgccaagctgcacttcagccagctgggcaacagcgagaacttcctgctggaggtggagaagagcagccgggagaagaccatgaagaactgtgtgactggagagagcagcgccagcaaggtgtctgccaacgtggacagcagaattgagatggacagcaacaagggcctcttcatccccttccccaaccgggagatcaaggacagcctgagcaccagcgccacccagggcaatggcacccgggaccagaagctggacaccttccccctgggcacccagacccaggaggtggcccggcgggagatgcccagcgacaaccaccaggaggatgagttccgccactacagcccccggcagagcacagtgcgcagccctgagaagatgacccgggagggctaccaggtgtccttcctggacaacaagagcagcggcagcagccctgagaaggagctgatccccaagccagacaccttccacctgacccatgatgccagcctgagcaagtgcctggatgtgggggacagcagccagatccacccctaccagctgcccagtgatgtgggcctggagaactatgacagctgctacagccagaccctgagcctgcacggcagcctgggcaagaggccccagaggagcaagaactaccaggagtacagcatcaagcccagcaatgacatcaagaccacagccagccacagctgtggggacctgctgaccagcctgagcaacccagacagcagcacaggccgcctgctgaagctgagcagtgacctgtatgccaccacccacttcaacagcgaccctgctgtgctggtgaatgtggagcagcagctgagcaccagcctggatgacctgaccccagcccacggctctgtgcccaacaatgctgtgctgggcaacagaaccacccccctgcggaccctgctgctgagccctggcaccagcgagcacaggaagatcttcaccaagaggagcctgagccccagcaagaggggcttcaagtggaaggacaacatcctggccaacctgaacctgaagcacggcttccaggatgccaccggcagcgagcccctgagcagtgacctgggcagcctgcacggcctggccggcaaccacagcccccccatcagcgcccggacccctcatgtggccaccgtgctgcggcagctgctggagctggtggacaagcactggaatggcagcggcagcctgctgctgaacaagaagttcctgggccctgcccgggacctgctgctgagcctggtggtgcctgcccccagccagccccgctgctgcagccaccctgaggacaccatgaaggccttctgcagaagagagctggagctgaaggaggccgcccagctggtgcccaatgacatggagagcctgaagcagaagctggtgcgggtgctggaggagaacctgatcctgtctgagaagatccagcagctggaggagggcgccgccatcagcatcgtgtctggccagcagagccacacctatgatgacctgctgcacaagaaccagcagctgaccatgcaggtggcctgcctgaaccaggagctggcccagctgaagaagctggagaagacagtggccatcctgcacgagagccagaggagcctggtggtgaccaatgagtacctgctgcagcagctgaacaaggagcccaagggctacagcggcaaggccctgctgcccccagagaagggccaccacctgggccgcagcagcccctttgggaagagcaccctgagcagcagcagccctgtggcccacgagaccggccagtacctgatccagagcgtgctggatgctgcccctgagcccggcctgtag

SEQ ID NO: 39685 - DNA, 5103 bp, Artificial Sequence
  Description of Artificial Sequence: Synthetic coding sequence
atgagcagcgcccagtgcccagccctggtgtgtgtgatgagccggctgcgcttctggggcccctggcccctgctgatgtggcagctgctgtggctgctggtgaaggaggcccagcccctggagtgggtgaaggaccccctgcagctgaccagcaaccccctgggccccccagacagctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagcagcccctggagcctgagcagttcctggccagccagcaggacctgaaggacaagctgagcccccaggagcggctgcctgtgagccccaagaagctgaagaaggaccctgcccagcgctggagcctggccgagatcatcggcatcacccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagagaccaggcacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgagctacatcctgccctacttctctgctgtgaacctggatgtgaagagcctgctgctgcccttcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcatcctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaacaacaacaccaagcacaccacagccagaaatgcctttgaagaaaatgacttcatggagaacaccaacatgcctgagggcaccatcagcgagaacaccaactacaaccacccccatgaagctgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccggggcatcttccgcttcctgccctggaggggctgcagcagccggcgggagagccaggacggcctgagcagctttggccagcccctgtggttcaaggacatgtacaagcccctgagcgccacccgcatcaacaaccacgcctggaagctgcacaagaagagcagcaatgaagacaagatcctgaacagagaccccggggacagcgaggcccccacagaggaggaggagagcgaggccctgccctag

SEQ ID NO: 39686 - DNA, 5103 bp, Artificial Sequence; identical to SEQ ID NO: 39685
  Description of Artificial Sequence: Synthetic coding sequence

SEQ ID NO: 39687 - DNA, 1008 bp, Artificial Sequence
  Description of Artificial Sequence: Synthetic coding sequence
atgacagaaaatgtggtgtgcaccggggctgtgaatgctgtgaaggaggtgtgggagaagaggatcaagaagctgaatgaagacctgaagcgggagaaggagttccagcacaagctggtgcgcatctgggaggagcgggtgtccctgaccaagctgcgggagaaggtgaccagagaagatggccgggtcatcctgaagattgagaaggaggagtggaagaccctgcccagcagcctgctgaagctgaaccagctgcaggagtggcagctgcacaggacaggcctgctgaagatccctgagttcatcggccgcttccagaacctgattgtgctggacctgagcaggaacaccatcagcgagatccccccaggcatcggcctgctgacccggctgcaggagctgatcctgagctacaacaagatcaagacagtgcccaaggagctgagcaactgtgccagcctggagaagctggagctggccgtgaacagagacatctgtgacctgccccaggagctgagcaacctgctgaagctgacccacctggacctgtccatgaatgacttcaccaccatccccctggccgtgctgaacatgcctgccctggagtggctggacatgggcagcaacaagctggagcagctgcctgacaccatcgagaggatgcagaacctgcacaccctgtggctgcagagaaatgagatcacctgcctgccccagaccatcagcaacatgaagaacctgggcaccctggtgctgagcaacaacaagctgcaggacatccctgtgtgcatggaggagatggccaacctgcgctttgtgaacttccgggacaaccccctgaagctgaaggtgtccctgcccccatctgagggcacagatgaggaggaggagcgggagctgtttggcctgcagttcatgcacacctacatccaggagagcagaagaagagctgaccaccaggtgaatggcagcaccaccctgcccatcagcatcaacacagatggatag

SEQ ID NO: 39688 - DNA, 1020 bp, Artificial Sequence
  Description of Artificial Sequence: Synthetic coding sequence
atgacagaaaatgtggtgtgcaccggggctgtgaatgctgtgaaggaggtgtgggagaagaggatcaagaagctgaatgaagacctgaagcgggagaaggagttccagcacaagctggtgcgcatctgggaggagcgggtgtccctgaccaagctgcgggagaaggtgaccagagaagatggccgggtcatcctgaagattgagaaggaggagtggaagaccctgcccagcagcctgctgaagctgaaccagctgcaggagtggcagctgcacaggacaggcctgctgaagatccctgagttcatcggccgcttccagaacctgattgtgctggacctgagcaggaacaccatcagcgagatccccccaggcatcggcctgctgacccggctgcaggagctgatcctgagctacaacaagatcaagacagtgcccaaggagctgagcaactgtgccagcctggagaagctggagctggccgtgaacagagacatctgtgacctgccccaggagctgagcaacctgctgaagctgacccacctggacctgtccatgaatgacttcaccaccatccccctggccgtgctgaacatgcctgccctggagtggctggacatgggcagcaacaagctggagcagctgcctgacaccatcgagaggatgcagaacctgcacaccctgtggctgcagagaaatgagatcacctgcctgccccagaccatcagcaacatgaagaacctgggcaccctggtgctgagcaacaacaagctgcaggacatccctgtgtgcatggaggagatggccaacctgcgctttgtgaacttccgggacaaccccctgaagctgaaggtgtccctgcccccatctgagggcacagatgaggaggaggagcgggagctgtttggcctgcagttcatgcacacctacatccaggagagcagaagaagagctgccctgcagttctgtgtgtgccacggccagatcctgaccatctacacctgcatggccctggagatctag

SEQ ID NO: 39689 - DNA, 1008 bp, Artificial Sequence; identical to SEQ ID NO: 39687
  Description of Artificial Sequence: Synthetic coding sequence

SEQ ID NO: 39690 - DNA, 1020 bp, Artificial Sequence; identical to SEQ ID NO: 39688
  Description of Artificial Sequence: Synthetic coding sequence

SEQ ID NO: 39691 - DNA, 1809 bp, Artificial Sequence
  Description of Artificial Sequence: Synthetic coding sequence
atgagccggctgaagagaattgctggccaggacctgcgggccggcttcaaggccggcggccgggactgtggcacctctgtgccccagggcctgctgaaggccgccaggaagagcggccagctgaacctgagcggcaggaacctgtctgaggtgccccagtgtgtgtggaggatcaacgtggacatccctgaggaggccaaccagaacctgagctttggagccacagagcgctggtgggagcagacagacctgaccaagctgatcatcagcaacaacaagctgcagagcctgacagatgacctgcggctgctgcctgccctgactgtgctggacatccatgacaaccagctgaccagcctgcccagcgccatccgggagctggagaacctgcagaagctgaatgtgagccacaacaagctgaagatcctgcctgaggagatcaccaacctgaggaacctgaagtgcctgtacctgcagcacaatgagctgacctgcatcagcgagggctttgagcagctgagcaacctggaggacctggacctgagcaacaaccacctgaccaccgtgcctgccagcttcagcagcctgagcagcctggtgcggctgaacctgagcagcaatgagctgaagagcctgcctgctgagatcaacaggatgaagaggctgaagcacctggactgcaacagcaacctgctggagaccatccccccagagctggccggcatggagagcctggagctgctgtacctgcggaggaacaagctgcgcttcctgcctgagttccccagctgcagcctgctgaaggagctgcacgtgggggagaaccagatcgagatgctggaggccgagcacctgaagcacctgaacagcatcctggtgctggacctgcgggacaacaagctgaagtctgtgcctgatgagatcatcctgctgcggagcctggagcggctggacctgagcaacaatgacatcagcagcctgccctacagcctgggcaacctgcacctgaagttcctggccctggagggcaaccccctgcggaccatccggcgggagatcatcagcaagggcacccaggaggtgctgaagtacctgcggagcaagatcaaggatgatggccccagccagagcgagagcgccacagaaacagccatgaccctgcccagcgagagccgggtgaacatccacgccatcatcaccctgaagatcctggactacagcgacaagcaggccaccctcatcccagatgaggtgtttgatgctgtgaagagcaacatcgtgaccagcatcaacttcagcaagaaccagctgtgtgagatccccaagaggatggtggagctgaaggagatggtgtctgatgtggacctgtccttcaacaagctgtccttcatcagcctggagctgtgtgtgctgcagaagctgaccttcctggacctgaggaacaacttcctgaacagcctgcctgaggagatggagagcctggtgcggctgcagaccatcaacctgtccttcaaccgcttcaagatgctgcctgaggtgctgtaccgcatcttcaccctggagaccatcctgatcagcaacaaccaggtgggctctgtggacccccagaagatgaagatgatggagaacctgaccaccctggacctgcagaacaatgacctgctgcagatccccccagagctgggcaactgtgtgaacctgcggaccctgctgctggatggcaaccccttccgggtgccccgggccgccatcctgatgaagggcacagctgccatcctggagtacctgcgggaccgcatccccacctag

SEQ ID NO: 39692 - DNA, 651 bp, Artificial Sequence
  Description of Artificial Sequence: Synthetic coding sequence
atgctgcagggcgccacagagctggtggccgagcccaacagaagagtgctggagaccctggccagcagcctgcacaccctgaagttccgccacctgctcttcagtgatgtggccgcccagcagagcctgcggcagctgctgcaccagctgatccaccacggggctgtgtcccaggtgtccctgtacagctggcctgtgcctgagagcgccctcttcatcctgatcctgaccatgtctgctggcttctggcagcccggccctgggggccccccctgccgcctgtgtggggaggccagccggggccgggcccccagcagagatgagggcagcctgctgctgggcagccggcggcccaggagagatgctgctgagcgctgtgccgccgccctgatggccagcaggaggaagtctgaggccaagcagatgcccagggctgccccagccaccagggtgaccaggaggagcacccaggagagcctgacagctgggggcacagacctgaagcgggagctgcacccccagcccccacccatgaggctgctggcccccagcggccacctgctgctgcagcagcccccacccctgcccctgctgctgcacccccacaccaacggccaccagctggcccagccccacagcctgagcccctag

SEQ ID NO: 39693 - DNA, 2439 bp, Artificial Sequence
  Description of Artificial Sequence: Synthetic coding sequence
atggccgcccctgaggcctggagggcccggagctgctggttctgtgaggtggccgccgccaccaccatggaggccaccagccgggaggccgccccagccaagagcagcgccagcggccccaatgcccccccagccctgtttgagctgtgtggccgggctgtgtctgcccacatgggcgtgctggagagcggcgtgtgggccctgcccggccccatcctgcagagcatcctgcccctgctgaacatctactacctggagcgcatcgaggagacagccctgaagaagggcctgagcacccaggccatctggaggcggctgtgggatgagctgatgaagacccggcccagcagcctggagagcgtgacctgctggagggccaagttcatggaggccttcttcagccacgtgctgcggggcaccattgatgtgtccagtgaccggcggctgtgtgaccagcgcttcagccccctgctgcacagcagcagacatgtgcggcagctgaccatctgcaacatgctgcagggcgccacagagctggtggccgagcccaacagaagagtgctggagaccctggccagcagcctgcacaccctgaagttccgccacctgctcttcagtgatgtggccgcccagcagagcctgcggcagctgctgcaccagctgatccaccacggggctgtgtcccaggtgtccctgtacagctggcctgtgcctgagagcgccctcttcatcctgatcctgaccatgtctgctggcttctggcagcccggccctgggggccccccctgccgcctgtgtggggaggccagccggggccgggcccccagcagagatgagggcagcctgctgctgggcagcagaagacccaggagagatgctgctgagcgctgtgccgccgccctgatggccagcaggaggaagtctgaggccaagcagatgccccgggccgccccagccaccagggtgacccggcgcagcacccaggagagcctgacagctgggggcacagacctgaagcgggagctgcaccccccagccaccagccatgaggcccctggcaccaagaggagccccagcgccccagctgccaccagcagcgccagcagcagcaccagcagctacaagagggccccagccagcagcgccccccagcccaagcccctgaagcgcttcaagagagctgctgggaagaagggggcccggacccggcagggccctggagctgagagcgaggacctgtatgactttgtgttcatcgtggccggggagaaggaggatggagaggagatggagatcggggaggtggcctgtggggccctggatggcagtgaccccagctgcctgggcctgcctgccctggaggccagccagcgcttccgcagcatcagcaccctggagctgttcaccgtgcccctgagcacagaggccgccctgaccctgtgccacctgctgagctcctgggtgtccctggagagcctgaccctgagctacaacggcctgggcagcaacatcttccggctgctggacagcctgcgggccctgagcggccaggccggctgccgcctgcgggccctgcacctgagtgacctcttcagccccctgcccatcctggagctgacccgggccatcgtgcgggccctgcccctgctgcgggtgctgagcatccgggtggaccaccccagccagagggacaaccctggggtgcctggaaatgccggcccccccagccacatcattggagatgaggagatccctgagaactgcctggagcagctggagatgggcttccccaggggggcccagcctgcccccctgctgtgcagcgtgctgaaggccagcggcagcctgcagcagctgagcctggacagcgccacctttgccagcccccaggactttggcctggtgctgcagaccctgaaggagtacaacctggccctgaagaggctgtccttccatgacatgaacctggccgactgccagagcgaggtgctcttcctgctgcagaacctgaccctgcaggagatcaccttctccttctgccgcctgtttgagaagaggcctgcccagttcctgcctgagatggtggccgccatgaagggcaacagcaccctgaagggcctgcggctgcccggcaaccggctgggcaatgccggcctgctggccctggctgatgtgttttctgaggacagcagcagcagcctgtgccagctggacatcagcagcaactgcatcaagccagatggcctgctggagtttgccaagaggctggagcgctggggccgcggggccttcggccacctgcggctcttccagaactggctggaccaggatgctgtgacagcccgggaggccatccggcggctgcgggccacctgccacgtggtgtctgacagctgggacagcagccaggcctttgctgactatgtgtccaccatgtag

SEQ ID NO: 39694 - DNA, 2088 bp, Artificial Sequence
  Description of Artificial Sequence: Synthetic coding sequence
atggaggccaccagccgggaggccgccccagccaagagcagcgccagcggccccaatgcccccccagccctgtttgagctgtgtggccgggctgtgtctgcccacatgggcgtgctggagagcggcgtgtgggccctgcccggccccatcctgcagagcatcctgcccctgctgaacatctactacctggagcgcatcgaggagacagccctgaagaagggcctgagcacccaggccatctggaggcggctgtgggatgagctgatgaagacccggcccagcagcctggagagcgtgacctgctggagggccaagttcatggaggccttcttcagccacgtgctgcggggcaccattgatgtgtccagtgaccggcggctgtgtgaccagcgcttcagccccctgctgcacagcagcagacatgtgcggcagctgaccatctgcaacatgctgcagggcgccacagagctggtggccgagcccaacagaagagtgctggagaccctggccagcagcctgcacaccctgaagttccgccacctgctcttcagtgatgtggccgcccagcagagcctgcggcagctgctgcaccagctgatccaccacggggctgtgtcccaggtgtccctgtacagctggcctgtgcctgagagcgccctcttcatcctgatcctgaccatgtctgctggcttctggcagcccggccctgggggccccccctgccgcctgtgtggggaggccagccggggccgggcccccagcagagatgagggcagcctgctgctgggcagcagaagacccaggagagatgctgctgagcgctgtgccgccgccctgatggccagcaggaggaagtctgaggccaagcagatgccccgggccgccccagccaccagggtgacccggcgcagcacccaggagagcctgacagctgggggcacagacctgaagcgggagctgcaccccccagccaccagccatgaggcccctggcaccaagaggagccccagcgccccagctgccaccagcagcgccagcagcagcaccagcagctacaagagggccccagccagcagcgccccccagcccaagcccctgaagcgcttcaagagagctgctgggaagaagggggcccggacccggcagggccctggagctgagagcgaggacctgtatgactttgtgttcatcgtggccggggagaaggaggatggagaggagatggagatcggggaggtggcctgtggggccctggatggcagtgaccccagctgcctgggcctgcctgccctggaggccagccagcgcttccgcagcatcagcaccctggagctgttcaccgtgcccctgagcacagaggccgccctgaccctgtgccacctgctgagctcctgggtgtccctggagagcctgaccctgagctacaacggcctgggcagcaacatcttccggctgctggacagcctgcgggccctgagcggccaggccggctgccgcctgcgggccctgcacctgagtgacctcttcagccccctgcccatcctggagctgacccgggccatcgtgcgggccctgcccctgctgcgggtgctgagcatccgggtggaccaccccagccagaggcacagctggggcatgctggcctgctggccctggcagatgttcagccagaggatccacccccccctgtctgtgtcctggacctctgtgcccacagccagcagccagatgggcttctggagcagccccagcggctggagcgctggagctgtggagcccctggtgacctgtgccagcagcaagacaggctggaccaggatgcagagccagcccgggaagcccagcggcggcagcggcctgcctgccatgtggctggccacccacggcacccacccccggcccagccagatcatgctggccccctgtgatggagcccggaccagccagagccacgcccgctaccaccagctggccggggctgaggcctgggccgcccagaaccccaaccaccagttctacctgagcctgtctgtgaccttcttcctgttcttccccagcagcctggccctgcgctcctggaggccctag

SEQ ID NO: 39695 - DNA, 1287 bp, Artificial Sequence
  Description of Artificial Sequence: Synthetic coding sequence
atgagctactacctgagcagcgagaaccacctggaccccggccccatctacatgagagaaaatggccagctgcacatggtgaacctggccctggatggagtgcgcagcagcctgcagaagccccggcccttccgcctcttccccaagggcttctctgtggagctgtgcatgaaccgggaggatgacacagccaggaaggagaagacagaccacttcatcttcacctacacccgggagggcaacctgcgctacagcgccaagagcctcttcagcctggtgctgggcttcatcagtgacaacgtggaccacatcgacagcctcatcggcttccctgagcagattgctgagaagctgttctctgctgctgaggcccggcagaagttcacagagcctggagctggcctgcgggccctgcagaagttcacagaggcctacggcagcctggtgctgtgcagcctgtgcctgaggaaccgctacctggtgatcagcgagaagctggaggagatcaagagcttccgggagctgacctgcctggacctgagctgctgcaagctgggagatgaacatgagctgctggagcacctgaccaatgaggccctgagctctgtgacccagctgcacctgaaggacaactgcctgagtgatgctggggtgaggaagatgacagcccctgtgcgggtgatgaagaggggcctggagaacctgaccctgctggacctgagctgcaaccctgagatcacagatgctggcatcggctacctgttctccttcaggaagctgaactgcctggacatcagcggcaccggcctgaaggacatcaagacagtgaagcacaagctgcagacccacatcggcctggtgcacagcaaggtgcccctgaaggagtttgaccacagcaactgcaagacagagggctgggccgaccagatcgtgctgcagtgggagcgggtgacagctgaggccgtgaagccccgggagaccagcgagcccagggctgctgcccagcgcttctacggcaagaggagcagagctgaggcccccctgaagtgccccctggccgacacccacatgaacagcagcgagaagctgcagttctacaaggagaaggccccagactgccacggccctgtgctgaagcatgaggccatcagcagccaggagagcaagaagagcaagaagaggccctttgaggagagcgagacagagcagaacaacagcagccagcccagcaagcagaagtatgtgtgcctggccgtggaggactgggacctgctgaacagctactag

SEQ ID NO: 39696 - DNA, 579 bp, Artificial Sequence
  Description of Artificial Sequence: Synthetic coding sequence
atgagctactacctgagcagcgagaaccacctggaccccggccccatctacatgagagaaaatggccagctgcacatggtgaacctggccctggatggagtgcgcagcagcctgcagaagccccggcccttccgcctcttccccaagggcttctctgtggagctgtgcatgaaccgggaggatgacacagccaggaaggagaagacagaccacttcatcttcacctacacccgggagggcaacctgcgctacagcgccaagagcctcttcagcctggtgctgggcttcatcagtgacaacgtggaccacatcgacagcctcatcggcttccctgagcagattgctgagaagctgttctctgctgctgaggcccggcagaagttcacagagcctggagctggcctgcgggccctgcagaagttcacagaggcctacggcagcctggtgctgtgcagcctgtgcctgaggaaccgctacctggtgatcagcgagaagctggaggagatcaagagcttccgggagctgacctgcctggacctgagctgctgcaagctgggagatgaacatgagctgctgtag

SEQ ID NO: 39697 - DNA, 1287 bp, Artificial Sequence; identical to SEQ ID NO: 39695
  Description of Artificial Sequence: Synthetic coding sequence

SEQ ID NO: 39698 - DNA, 720 bp, Artificial Sequence
  Description of Artificial Sequence: Synthetic coding sequence
atgagctactacctgagcagcgagaaccacctggaccccggccccatctacatgagagaaaatggccagctgcacatggtgaacctggccctggatggagtgcgcagcagcctgcagaagccccggcccttccgcctcttccccaagggcttctctgtggagctgtgcatgaaccgggaggatgacacagccaggaaggagaagacagaccacttcatcttcacctacacccgggagggcaacctgcgctacagcgccaagagcctcttcagcctggtgctgggcttcatcagtgacaacgtggaccacatcgacagcctcatcggcttccctgagcagattgctgagaagctgttctctgctgctgaggcccggcagaagttcacagagcctggagctggcctgcgggccctgcagaagttcacagaggcctacggcagcctggtgctgtgcagcctgtgcctgaggaaccgctacctggtgatcagcgagaagctggaggagatcaagagcttccgggagctgacctgcctggacctgagctgctgcaagctgggagatgaacatgagctgctggagcacctgaccaatgaggccctgagctctgtgacccagctgcacctgaaggacaactgcctgagtgatgctggggtgaggaagatgacagcccctgtgcgggtgatgaagaggggcctggagaacctgaccctgctggactag

SEQ ID NO: 39699 - DNA, 1584 bp, Artificial Sequence
  Description of Artificial Sequence: Synthetic coding sequence
atggagtgcctgtgtgcccaccccccagctggcctgcagcacctgggcctgggccacaacaagctgctgggccccctggagagcctgtatgtgacagccaaccactggggccgggtgcggctgggcctgggagatgctgtgctgacagctgctgcctgtgtgttcctgctcttcagcgagcccaggagcatctgcttcctggtgtgtggcagccggctgctggccccctgcagccctggcttcctgaccccaagaagaagctgcagccccagccggcccaacctggtgtccctggacctgggcttcaatgacctgacagacctgcagagcatggtgaccagcctgcggaccctgcggcacctgcggctgctggtgctgcagggcaaccccctggccctggtgccctactaccggggcctgaccatcgacagcctggcccagctgtgtgtgctggatgacatcaccgtgagccccaatgagaagcacctgttccggggcctgagcctgaatggagacctgctggcccaggaggcccagtttgtggtgaccatcggcaacatccggggcgtgctggacacctctgtgctggaccctgagcccaggcctgagggccccttcatcacctacaactactacgtgacctatgactttgtgaaggatgaggagggggagatgaatgaatctgctggggtgctggccgagatcgtgaagcccagccccagcctggagctgctggtggaggagagccctgaggaggtggtggaggatgtgattgaagatattgtggaggaggtgacagaggaggtggagggcagcctggagagcgaggtggaggagagcggggagagcgagctgagcgtcatcagcggccccagcaccatcctgcagatgccccgggccagcgctgaggagctggccaagctgcggctgagaattgacccccggctgtgccccagccctggcaccgtgctcttcagcacagcccacaagccctgggccgaggtgatcccctgcagctatgagatgcagcacagcctgcgggacctggtgcccctgaaggccttcctgctggccggcaccaccgtgaccatcgtggaggagaagatcctgtcctggcctgtggtgctgcctgctgtggacagccccctgagcgccaagaagggcaaaggagagaaggacaagaagggcaaggagaaggacagaacaggcaagggggagaaggagcccgccaaggagtggaaggtgctgaagaagaagaaggagccccccaaggagctgcggcaggacccccccatcctgcaggtgctgggccggggcctggtgatcctggagcccctgctggccggggagcccctggtgtccacagtgtgcaactttggagtggtgaggaccctgaccagtgaccggctgaccctggcccgggacagcaagaagatcaagaaggtggccaagaaggagaagcccaaggccgtcatccccatctatgaaggagactaccaccctgagcccctgactgtggaggtgcagatccagctgaaccagtgccgctctgctgaggaggccctgaggatgtttgctgtgtag

SEQ ID NO: 39700 - DNA, 1971 bp, Artificial Sequence
  Description of Artificial Sequence: Synthetic coding sequence
atggaggccagctatgaaagtgaaagtgaaagtgaaagtgaagctggccctggcacccagaggcctggcaccggcaccgtgtctgctgctgtgcgggagcacctgaggaagctgtgcctgcgggagttcccctgtggggccggctcctggaacaagagccgcttcctgccccagacctggaggacctggagggagctggtgccccgggaggaggatgtggtgtccccaggagaggagaccgtggaggccctgctgggcctggtgcgcagccgccacagcccctgggccctgctgaacaacagcaatgctgaggacagcttcctgcgggagctggccatccggaaccccctgaccatcacagacaccttcttctacagctacttccgcagcctgcgggtcatcgacaagaaggtgaccctggtggacaaggacctgctgaagttcctgaagctggaggagctggtgctgagcgccaaccgcatcaaggaggtggatgccaccaacctgccccccaccctgaaggtgctggagctgtatggaaatgagatcagctccatggagtgcctgtgtgcccaccccccagctggcctgcagcacctgggcctgggccacaacaagctgctgggccccctggagagcctgtatgtgacagccaaccactggcccaacctggtgtccctggacctgggcttcaatgacctgacagacctgcagagcatggtgaccagcctgcggaccctgcggcacctgcggctgctggtgctgcagggcaaccccctggccctggtgccctactaccggggcctgaccatcgacagcctggcccagctgtgtgtgctggatgacatcaccgtgagccccaatgagaagcacctgttccggggcctgagcctgaatggagacctgctggcccaggaggcccagtttgtggtgaccatcggcaacatccggggcgtgctggacacctctgtgctggaccctgagcccaggcctgagggccccttcatcacctacaactactacgtgacctatgactttgtgaaggatgaggagggggagatgaatgaatctgctggggtgctggccgagatcgtgaagcccagccccagcctggagctgctggtggaggagagccctgaggaggtggtggaggatgtgattgaggacatcgtggaggaggtgacagaggaggtggagggcagcctggagagcgaggtggaggagagcggggagagcgagctgagcgtcatcagcggccccagcaccatcctgcagatgccccgggccagcgctgaggagctggccaagctgcggctgagaattgacccccggctgtgccccagccctggcaccgtgctcttcagcacagcccacaagccctgggccgaggtgatcccctgcagctatgagatgcagcacagcctgcgggacctggtgcccctgaaggccttcctgctggccggcaccaccgtgaccatcgtggaggagaagatcctgtcctggcctgtggtgctgcctgctgtggacagccccctgagcgccaagaagggcaagggggagaaggacaagaagggcaaggagaaggacagaactggaaaaggagagaaggagcccgccaaggagtggaaggtgctgaagaagaagaaggagccccccaaggagctgcggcaggacccccccatcctgcaggtgctgggccggggcctggtgatcctggagcccctgctggccggggagcccctggtgtccacagtgtgcaactttggagtggtgaggaccctgaccagtgaccggctgaccctggcccgggacagcaagaagatcaagaaggtggccaagaaggagaagcccaaggctgtgatccccatctatgaaggagactaccaccctgagcccctgactgtggaggtgcagatccagctgaaccagtgccgctctgctgaggaggccctgaggatgtttgctgtgtag

SEQ ID NO: 39701 - DNA, 1416 bp, Artificial Sequence
  Description of Artificial Sequence: Synthetic coding sequence
atggagtgcctgtgtgcccaccccccagctggcctgcagcacctgggcctgggccacaacaagctgctgggccccctggagagcctgtatgtgacagccaaccactggcccaacctggtgtccctggacctgggcttcaatgacctgacagacctgcagagcatggtgaccagcctgcggaccctgcggcacctgcggctgctggtgctgcagggcaaccccctggccctggtgccctactaccggggcctgaccatcgacagcctggcccagctgtgtgtgctggatgacatcaccgtgagccccaatgagaagcacctgttccggggcctgagcctgaatggagacctgctggcccaggaggcccagtttgtggtgaccatcggcaacatccggggcgtgctggacacctctgtgctggaccctgagcccaggcctgagggccccttcatcacctacaactactacgtgacctatgactttgtgaaggatgaggagggggagatgaatgaatctgctggggtgctggccgagatcgtgaagcccagccccagcctggagctgctggtggaggagagccctgaggaggtggtggaggatgtgattgaagatattgtggaggaggtgacagaggaggtggagggcagcctggagagcgaggtggaggagagcggggagagcgagctgagcgtcatcagcggccccagcaccatcctgcagatgccccgggccagcgctgaggagctggccaagctgcggctgagaattgacccccggctgtgccccagccctggcaccgtgctcttcagcacagcccacaagccctgggccgaggtgatcccctgcagctatgagatgcagcacagcctgcgggacctggtgcccctgaaggccttcctgctggccggcaccaccgtgaccatcgtggaggagaagatcctgtcctggcctgtggtgctgcctgctgtggacagccccctgagcgccaagaagggcaaaggagagaaggacaagaagggcaaggagaaggacagaacaggcaagggggagaaggagcccgccaaggagtggaaggtgctgaagaagaagaaggagccccccaaggagctgcggcaggacccccccatcctgcaggtgctgggccggggcctggtgatcctggagcccctgctggccggggagcccctggtgtccacagtgtgcaactttggagtggtgaggaccctgaccagtgaccggctgaccctggcccgggacagcaagaagatcaagaaggtggccaagaaggagaagcccaaggccgtcatccccatctatgaaggagactaccaccctgagcccctgactgtggaggtgcagatccagctgaaccagtgccgctctgctgaggaggccctgaggatgtttgctgtgtag

SEQ ID NO: 39702 - DNA, 966 bp, Artificial Sequence
  Description of Artificial Sequence: Synthetic coding sequence
atgtctgggggcaagagcgcccagggccctgaggagggcggcgtgtgcatcacagaggccctgatcaccaagaggaacctgaccttcccagaagatggagagctgtctgagaagatgttccacaccctggatgagctgcagacagtgcggctggaccgggagggcatcaccaccatccggaacctggagggcctgcagaacctgcacagcctgtacctgcagggcaacaagatccagcagatcgagaacctggcctgcatccccagcctgcgcttcctgagcctggccggcaaccagatccggcaggtggagaacctgctggacctgccctgcctgcagttcctggacctgtctgaaaatctcatcgagaccctgaagctggatgagttcccccagagcctgctgatcctgaacctgagcggcaacagctgcaccaaccaggacggctaccgggagctggtgacagaggccctgcccctgctgctggacctggatggccagcctgtggtggagcgctggatcagtgatgaggaggatgaggccagcagtgatgaggagttccctgagctgagcggccccttctgcagcgagcggggcttcctgaaggagctggagcaggagctgagccgccaccgggagcaccggcagcagacagccctgacagagcacctgctgaggatggagatgcagcccaccctgacagacctgcccctgctgcccggggtgcccatggccggggacagcagccccagcgccaccccagcccagggcgaggagaccgtgcctgaggccgtgagcagcccccaggccagcagccccaccaagaagccctgcagcctcatcccccggggccaccagagcagcttctggggcaggaaaggagcccgggccgccacagcccccaaggcctctgtggccgaggcccccagcaccaccaagaccacagccaagaggagcaagaagtag

SEQ ID NO: 39703 - DNA, 1752 bp, Artificial Sequence
  Description of Artificial Sequence: Synthetic coding sequence
atggctgctgctgctgtgtctgagagctggccagagctggagctggccgagcgggagaggagaagagagctgctgctgactggacctggcctggaggagcgggtgcgggccgccggcggccagctgccccccaggctcttcaccctgcccctgctgcactacctggaggtgtctggctgcggcagcctgcgggcccctggccctggcctggcccagggcctgccccagctgcacagcctggtgctgcggagaaatgccctgggccctggcctgagccctgagctgggccccctgcctgccctgcgggtgctggacctgtctggaaatgccctggaggccctgcccccaggccagggcctgggccctgctgagcccccaggcctgccccagctgcagagcctgaacctgagcggcaaccggctgcgggagctgcctgctgacctggcccgctgtgccccccggctgcagagcctgaacctgactggaaactgcctggacagcttccctgctgagctgttccggcctggggccctgcccctgctgtctgagctggccgctgctgacaactgcctgcgggagctgagcccagacatcgcccacctggccagcctgaagaccctggacctgagcaacaaccagctgtctgagatcccagctgagctggccgactgccccaagctgaaggagatcaacttccggggcaacaagctgcgggacaagaggctggagaagatggtgtctggctgccagaccaggagcatcctggagtacctgcgggtgggcggccggggcggcggcaagggcaagggccgggcagagggcagcgagaaggaggagagcaggaggaagaggcgggagaggaagcagaggcgggagggcggagatggagaggagcaggatgtgggagatgctggccgcctgctgctgcgggtgctgcacgtgtctgagaaccctgtgcccctgactgtgcgggtgtccccagaggtgagagatgtgcggccctacatcgtgggcgctgtggtgcggggcatggacctgcagcctggaaatgccctgaagcgcttcctgaccagccagaccaagctgcacgaggacctgtgtgagaagaggacagctgccaccctggccacccatgagctgcgggctgtgaagggccccctgctgtactgtgcccggcccccccaggacctgaagatcgtgcccctgggcaggaaggaggccaaggccaaggagctggtgcggcagctgcagctggaggccgaggagcagaggaagcagaagaagaggcagagcgtgtctggcctgcaccgctacctgcacctgctggatggaaatgaaaactacccctgcctggtggatgctgatggagatgtgatctccttcccccccatcaccaacagcgagaagaccaaggtgaagaagaccaccagtgacctcttcctggaggtgaccagcgccaccagcctgcagatctgcaaggatgtgatggatgccctgatcctgaagatggccgagatgaagaagtacaccctggagaacaaggaggagggcagcctgagtgacacagaagcagatgctgtgtctggccagctgcctgaccccaccaccaaccccagcgctgggaaggatggccccagcctgctggtggtggagcaggtgcgggtggtggacctggagggcagcctgaaggtggtgtaccccagcaaggctgacctggccacagccccaccccacgtgacagtggtgaggtag

SEQ ID NO: 39704 - DNA, 1515 bp, Artificial Sequence
  Description of Artificial Sequence: Synthetic coding sequence
atgctgcggctggtggccgcctgcccagagagctgtgtggtgtgcaccaaggatgtgaccctgtgccaccagctgacctacatcgtggccgcccccatgaccaccagggtgctgatcatcacagatggctacctgagcagcattgagagcaccaacctgagcctgctcttcaacctggccctgctgagcctgagcagaaatggaattgaagatgtgcaggaggatgccctgcacggcctgaccatgctgcggaccctgctgctggagcacaaccagatcagcagcagcagcctgacagaccacaccttcagcaagctgcacagcctgcaggtgctggtgctgagcaacaatgccctgcggaccctgcggggctcctggttcaggaacaccagcggcctgacccggctgcagctggatggcaaccagatcaccaacctgacagacagcagctttggaggcaccaacctgcacagcctgcgctacctggacctgagcaacaacttcatctcctacatcggcaaggatgccttccggcccctgccccagctgcaggaggtggacctgagcaggaaccggctggcccacatgccagatgtgttcacccccctgaagcagctgatcctgctgagcctggacaagaaccagtggagctgcacctgtgacctgcaccccctggcccgcttcctgaggaactacatcaagagcagcgcccacaccctgagaaatgccaaggacctgaactgccagcccagcacagctgctgtggccgccgcccagagcgtgctgcggctgtctgagaccaactgtgacagcaaggcccccaacttcaccctggtgctgaaggacaggagccccctgctgcccggcccagatgtggccctgctgactgtgctgggctttgctggagctgtgggcctgacctgcctgggcctggtggtgttcaactggaagctgcaccagggcaaggccaatgagcacaccagcgagaacctgtgctgcaggacctttgatgagcccctgtgtgcccacgaggccaggaactaccacaccaagggctactgcaactgccacctgacccaggagaatgagatcaaggtgatgagcacagtgggcagcaggaaggagatgcccctgctgcaggagaacagccaccaggccaccagcgccagcgagagcgccaccctggatggcagcttcaggaacctgaagaagaaggaccggggcgtgggcagcaccctcttctgccaggacggccgcctgctgcacagcgagtgcagcgagcccccaggcaacatgagggccttcaatgaggccggcctgctgaccacctacaaccccaggaaggtgcagaagctgtggaacctggagcctggagaggtgcagccccagaccctgcagcaccacatcatcagaacagaggacatcagcagtgacatcttcagaagaagatatgccaccccagccagcgccctggccggggagagcctggagaagaggctgaccaatgaaagctag

SEQ ID NO: 39705 - DNA, 1533 bp, Artificial Sequence
  Description of Artificial Sequence: Synthetic coding sequence
atgctgcggctggtggccgcctgcccagagagctgtgtggtgtgcaccaaggatgtgaccctgtgccaccagctgacctacatcgtggccgcccccatgaccaccagggtgctgatcatcacagatggctacctgagcagcattgagagcaccaacctgagcctgctcttcaacctggccctgctgagcctgagcagaaatggaattgaagatgtgcaggaggatgccctgcacggcctgaccatgctgcggaccctgctgctggagcacaaccagatcagcagcagcagcctgacagaccacaccttcagcaagctgcacagcctgcaggtgctggtgctgagcaacaatgccctgcggaccctgcggggctcctggttcaggaacaccagcggcctgacccggctgcagctggatggcaaccagatcaccaacctgacagacagcagctttggaggcaccaacctgcacagcctgcgctacctggacctgagcaacaacttcatctcctacatcggcaaggatgccttccggcccctgccccagctgcaggaggtggacctgagcaggaaccggctggcccacatgccagatgtgttcacccccctgaagcagctgatcctgctgagcctggacaagaaccagtggagctgcacctgtgacctgcaccccctggcccgcttcctgaggaactacatcaagagcagcgcccacaccctgagaaatgccaaggacctgaactgccagcccagcacagctgctgtggccgccgcccagagcgtgctgcggctgtctgagaccaactgtgacagcaaggcccccaacttcaccctggtgctgaaggacaggagccccctgctgcccggcccagatgtggccctgctgactgtgctgggctttgctggagctgtgggcctgacctgcctgggcctggtggtgttcaactggaagctgcaccagggcaaggccaatgagcacaccagcgagaacctgtgctgcaggacctttgatgagcccctgtgtgcccacgaggccaggaactaccacaccaagggctactgcaactgccacctgacccaggagaatgagatcaaggtgatgagcacagtgggcagcaggaaggagatgcccctgctgcaggagaacagccaccaggccaccagcgccagcgagagcgccaccctggatggcagcttcaggaacctgaagaagaaggaccggggcgtgggcagcaccctcttctgccaggacggccgcctgctgcacagcgagtgcagcgagcccccaggcaacatgagggccttcaatgaggccggcctgctgaccacctacaaccccaggaaggtgcagaagctgtggaacctggagcctggagaggtgcagccccagaccctgcagcaccacatcatcagaacagaggacatcagcagtgacatcttcagaagaagatatgccaccccagccagcgccctggccggggagagcctggagaagaggctgaccaatgaatcctggcagccccccattgaatag

SEQ ID NO: 39706 - DNA, 1629 bp, Artificial Sequence
  Description of Artificial Sequence: Synthetic coding sequence
atggacctgggctgggacaggagccggggcccccggcgcagcaccagctctgtgcgggtgcgggagctgtcctggcagggcctgcacaacccctgcccccagagcaagggccctggcagccagagggaccggctgggggagcagctggtggaggagtacctgagccctgcccggctgcaggccctggcccgggtggatgacctgcggctggtgaggaccctggagatgtgtgtggacacccgggagggcagcctgggcaactttggagtgcacctgcccaacctggaccagctgaagctgaatggcagccacctgggcagcctgcgggacctgggcaccagcctgggccacctgcaggtgctgtggctggcccgctgtggcctggccgacctggatggcatcgccagcctgcctgccctgaaggagctgtatgccagctacaacaacatcagtgacctgagccccctgtgcctgctggagcagctggaggtgctggacctggagggcaacagcgtggaggacctgggccaggtgcgctacctgcagctgtgcccccggctggccatgctgaccctggagggcaacctggtgtgcctgcagcctgcccctggccccaccaacaaggtgccccggggctacaactacagagctgaggtgaggaagctgatcccccagctgcaggtgctggatgaggtgcctgctgcccacactggacctccagccccaccccggctgagccaggactggctggccgtgaaggaggccatcaagaagggaaatggcctgccccccctggactgccccaggggggcccccatccggcggctggaccctgagctgagcctgcctgagacccagagccgggccagccggccctggcccttcagcctgctggtgcggggcggccccctgcctgagggcctgctgtctgaggacctggcccctgaggacaacaccagcagcctgacccacggggccggccaggtgctgtgtggcaaccccaccaagggcctgcgggagaggaggcaccagtgccaggcccgggagcccccagagcagctgccccagcacaggcctggggaccctgctgccagcaccagcaccccagagccagaccctgctgacagcagtgacttcctggccctggccggcctgcgggcctggagggagcacggcgtgcggcccctgccctaccgccaccctgagagccagcaggagggcgctgtggccccctggggccccaggagagtgcctgaggagcaggtgcaccaggccgagcccaagacccccagcagcccccccagcctggccagcgagcccagcggcaccagcagccagcacctggtgcccagcccccccaagcacccccggccccgggacagcggcagcagcagcccccgctggagcacagacctgcagagccggggccgccgcctgcgggtgctgggctcctggggccctggcctgggagatggagtggccgctgtgcctgtgctgcgggccctggaggtggccagccggctgagcccccgggcccagggctgccccggccccaagccagccccagatgctgctgcccggccccccagggctgctgagctgagccaccccagccctgtgcccacctag

SEQ ID NO: 39707 - DNA, 720 bp, Artificial Sequence
  Description of Artificial Sequence: Synthetic coding sequence
atgggcaacagcgccctgcgggcccacgtggagacagcccagaagacaggagtcttccagctgaaggaccggggcctgacagagttccctgctgacctgcagaagctgaccagcaacctgcggaccatcgacctgagcaacaacaagattgagagcctgccccccctgctgattggcaagttcaccctgctgaagagcctgagcctgaacaacaacaagctgactgtgctgcctgatgagatctgcaacctgaagaagctggagaccctgagcctgaacaacaaccacctgcgggagctgcccagcaccttcggccagctgagcgccctgaagaccctgagcctgagcggcaaccagctgggcgccctgcccccccagctgtgcagcctgcggcacctggatgtgatggacctgagcaagaaccagatccgcagcatcccagattctgtgggggagctgcaggtgattgagctgaacctgaaccagaaccagatcagccagatctctgtgaagatcagctgctgcccccggctgaagatcctgcggctggaggagaactgcctggagctgtccatgctgccccagagcatcctgagtgacagccagatctgcctgctggccgtggagggcaacctgtttgagatcaagaagctgcgggagctggagggctatgacaagtacatggagcgcttcaccgccaccaagaagaagtttgcctag

SEQ ID NO: 39708 - DNA, 720 bp, Artificial Sequence; identical to SEQ ID NO: 39707
  Description of Artificial Sequence: Synthetic coding sequence

SEQ ID NO: 39709 - DNA, 1116 bp, Artificial Sequence
  Description of Artificial Sequence: Synthetic coding sequence
atggaggaggccggggctgctgtggtgacagctggggaggccgagctgaactggagccggctgtctgtgtccacagagaccctggagagcgagctggaggcccggggggaggagaggagaggagcccgggaggccctgctgcggctgctgctgccccacaaccggctggtgtccctgccccgggccctgggcagcggcttcccccacctgcagctgctggatgtgtctggaaatgccctgacagccctgggccctgagctgctggccctgcggggcctgcggaccctgctggccaagaacaaccggctgggcggccccagcgccctgcccaagggcctggcccagagccccctgtgccgcagcctgcaggtgctgaacctgagcggcaactgcttccaggaggtgcctgccagcctgctggagctgcgggccctgcagaccctgagcctgggcggcaaccagctgcagagcatcccagctgagattgagaacctgcagagcctggagtgcctgtacctgggcggcaacttcatcaaggagatccccccagagctgggcaacctgcccagcctgaactacctggtgctgtgtgacaacaagatccagagcatccccccccagctgagccagctgcacagcctgcggagcctgagcctgcacaacaacctgctgacctacctgccccgggagatcctgaacctgatccacctggaggagctgagcctgcggggcaaccccctggtggtgcgctttgtgcgggacctgacctatgacccccccaccctgctggagctggccgcccggaccatcaagatccggaacatctcctacaccccctatgacctgcccggcaacctgctgcgctacctgggcagcgccagcaactgccccaaccccaagtgtggcggcgtgtactttgactgctgcgtgcggcagatcaagtttgtggacttctgtgggaagtaccgcctgcccctgatgcactacctgtgcagccctgagtgcagcagcccctgcagcagcgccagccacagcagcaccagccagagcgagagtgacagtgaagatgaggcctctgtggccgcccggaggatgcagaaggtgctgctgggctag

SEQ ID NO: 39710 - DNA, 780 bp, Artificial Sequence
  Description of Artificial Sequence: Synthetic coding sequence
atggaccccccagctgagaagccaggagaggccggcggcctgcagatcaccccccagctgctgaagagcaggactggagagttcagcctggagagcatcctgctgctgaagctgcggggcctgggcctggccgacctgggctgcctgggagaatgtctgggcctggagtggctggacctgtctggaaatgccctgacccacctgggccccctggccagcctgcggcagctggccgtgctgaatgtgagcaacaaccggctgaccggcctggagcccctggccacctgtgagaacctgcagagcctgaatgctgctggcaacctgctggccaccccaggccagctgcagtgcctggccggcctgccctgcctggagtacctgcggctgcgggaccccctggcccggctgagcaaccccctgtgtgccaaccccagctactgggccgctgtgcgggagctgctgcccggcctgaaggtgattgatggagagagggtcatcggccggggcagcgagttctaccagctgtgccgggacctggacagcagcctgcggcccagcagcagccctggcccccgggccacagaggcccagccctgggtggagcccggctactgggagagctggcccagccgcagcagcagcatcctggaggaggcctgccggcagttccaggacaccctgcaggagtgctgggacctggaccggcaggccagtgacagcctggcccaggccgagcaggtgctgagcagcgctggccccaccagcagctttgtgttctag

SEQ ID NO: 39711 - DNA, 780 bp, Artificial Sequence; identical to SEQ ID NO: 39710
  Description of Artificial Sequence: Synthetic coding sequence

SEQ ID NO: 39712 - DNA, 780 bp, Artificial Sequence; identical to SEQ ID NO: 39710
  Description of Artificial Sequence: Synthetic coding sequence

SEQ ID NO: 39713 - DNA, 1746 bp, Artificial Sequence
  Description of Artificial Sequence: Synthetic coding sequence
atgcagaagccacccctgctgctgcggcggcccctgccccccaagttcaccaagctgagcctgcacgagaagaagacccacacagccaagacaggcaagattgagagcctgcacgtggccttcacagaagatgagaccaccagcatcaagatggacaggacccgcttcccagatgtgctgaggaaccagagcctgacccccatcaacatccagaacatcttcctggaccactgtgtgcaggagcgggtgacagccatcagcagcccccagaagagcaccaagcacgtgcgggagcagatcccagacacagccaccggcagcatcttcttcccccactgcaacagcgccagcacccgcatctttgggaagcagaccaacaagatggagagcagcaggaagttcaagaccatgaaggatgtgtacacagagaagaggctggagaacatcctgatcctgagcagcaagttcagcaagcccaagagcaccccaggctctgtgattgcccagaagctggagaagatgcaccccaagcaccagcccctgcctgagagccctggctacacctaccagcacatcagccgggacctgagcgccaccgtgcccagccccccacccatgacagtgtccatgaagccagagggccagtggccagagcacttcaagagcacagccaccctgaccctgcgggtgacagagttccctggctttgtgtccctgcccacccctgtgctgcccaggaagccccaccggcagagcgtcatcgagaccctggtgacagaaaatggaaacatcgagagcgtgcccaagcagatcccccccaggcctcctgagggcctgaccaagacagagaagattgaaagtgagatccacgtggtgcggggggagggcttcaagacagtggccgccaccaggtatgagaccatcacagccatgaccaacctggccatcgtgaactgccaggtgtatggaagaaatgccctgaacctgaagggcttcttcatcctgaactgcccagacctgacccccctggccttccagctgatctacctgaacctgtccttcaatgacctgcactacttccccacagagatcctgtgcctgaagaacctgcagatcctgaagctgaggaacaaccccatcaaggagatccccagcgagatccagcagctggagttcctgcgcatcttcaccatcgccttcaacctgatcaccgtgctgcccatcggcctcttcagcctgagctacctggaggagctggatgtgtcctacaatgagctgaccttcatccccaatgagatccagaagctgcggagcctggagaagctgactgtggatggaaatgagctgtccttcttcccccacggcatcctgaagctgaacctgaccaagatccagtttgagaacaacttcacccacccctgcttctggagggacaactacctgaacaacccccagcagctgacccagatcatcagcctcttcatcgtgcagaacaagctgcacaagttctatgacaagatccctgtggaggtgcagaagctgctgaagtggtggggcgcccagttcctgacagagctggcccccctgagcatctacagcagcaggaaggccatcacagagggctacatcgctgtggagctgcccaagtttgaggagagcaagaacatcacagagggcctgctgacccagaagagatatgaggaggtgatggtgaagtgcatcaatgccaccaccgtgaccagctag

SEQ ID NO: 39714 - DNA, 576 bp, Artificial Sequence
  Description of Artificial Sequence: Synthetic coding sequence
atgacagagcggctgctgatcaaggccctgagcggcggcaagaacaccaagatcatcaccctgaatggcaagaagatgaccaagatgcccagcgccctgggcaagctgcccggcctgaagaccctggtgctgcagaacaacctgatccccaaggtgtgcccagagctgtgcaacctgacccagttccaggacctgaagctgcgggagttctactgtgagggcaaccccctcttcctgcagcagcccgtcatcagcacccagcaggagaatgtgtggagcctgcaggagatcaccagcagatttgtgatgaaccagctggccgagaacaaccccttcctgatggatgacatcgagcgctacccccaggtgcgctccatgatcagccagggcaagacctgtgccatctgtggccagtacttcatcaccgtgtggctggagtgtgtgcgctttgtgcccccacccaaggactggaagatcagcaagaacctgaagctggtgcccctgcaggtgctgatctgcagctacaagtgcttcacccagagggaccccaacctgtttggcatcgcccaggtgtag

SEQ ID NO: 39715 - DNA, 153 bp, Artificial Sequence
  Description of Artificial Sequence: Synthetic coding sequence
atgacagagcggctgctgatcaaggccctgagcggcggcaagaacaccaagatcatcaccctgaatggcaagaagatgaccaagatgcccagcgccctgggcaagctgcccggcctgaagaccctggtgctgcagaacaacctgatcccctag

SEQ ID NO: 39716 - DNA, 1044 bp, Artificial Sequence
  Description of Artificial Sequence: Synthetic coding sequence
atgacagagcggctgctgatcaaggccctgagcggcggcaagaacaccaagatcatcaccctgaatggcaagaagatgaccaagatgcccagcgccctgggcaagctgcccggcctgaagaccctggtgctgcagaacaacctgatccccaaggtgtgcccagagctgtgcaacctgacccagctgaccaccctgaacctgggcaacaacctgctggaggaggtgcctgaggagatgaagtacctgaccagcctgaagaacctgcacctgagcggcaaccgcatctgccgctttgcccctggggcctgtgatggcctgcagaacctgatcctgctgaacctgaacaacaaccacctgacccagctgccccaggaggtgtcccggctgaagagcctgacctacatgagcatcaactacaaccagctggccagcatcccccgggagctgtgcttcctggagaacctggtggagctgcagctgaactacaaccagctgatctgcatccctgaggagatcaagttcctgaagaagctgcagaagctgctgctggccaggaacaacatcggcgtgctgcctgaggagctgtgtgacctgaagaagctgcgcatcctggacattgctggcaacatcatccagatcttccccagcggcttccaggacctgaagctgcgggagttctactgtgagggcaaccccctcttcctgcagcagcccgtcatcagcacccagcaggagaatgtgtggagcctgcaggagatcaccagcagatttgtgatgaaccagctggccgagaacaaccccttcctgatggatgacatcgagcgctacccccaggtgcgctccatgatcagccagggcaagacctgtgccatctgtggccagtacttcatcaccgtgtggctggagtgtgtgcgctttgtgcccccacccaaggactggaagatcagcaagaacctgaagctggtgcccctgcaggtgctgatctgcagctacaagtgcttcacccagagggaccccaacctgtttggcatcgcccaggtgtag

SEQ ID NO: 39717 - DNA, 1680 bp, Artificial Sequence
  Description of Artificial Sequence: Synthetic coding sequence
atgagcagcgagcagagcgcccctggggccagcccccgggcccccaggcctggcacccagaagagcagtggagctgtgaccaagaagggggagagagctgccaaggagaagccagccaccgtgctgccccctgtgggggaggaggagcccaagagccctgaggagtaccagtgcagcggcgtgctggagacagactttgctgagctgtgcacccgctggggctacacagacttccccaaggtggtgaaccggccccggccccaccccccatttgtgcccagcgccagcctgtctgagaaggccaccctggatgacccccggctgagcggcagctgcagcctgaacagcctggagagcaaatatgtgttcttccggcccaccatccaggtggagctggagcaggaggacagcaagtctgtgaaggagatctacatccggggctggaaggtggaggagcgcatcctgggcgtcttcagcaagtgcctgccccccctgacccagctgcaggccatcaacctgtggaaggtgggcctgacagacaagaccctgaccaccttcatcgagctgctgcccctgtgcagcagcaccctgaggaaggtgtccctggagggcaaccccctgcctgagcagagctaccacaagctgatggccctggacagcaccatcgcccacctgagcctgaggaacaacaacattgatgacagaggagcccagctgctgggccaggccctgagcaccctgcacagctgcaacagaaccctggtgtccctgaacctgggcttcaaccacatcggagatgagggcgccggctacatcgcagatggcctgcggctgaacagaagcctgctgtggctgagcctggcccacaaccgcatccaggacaagggggccctgaagctggccgaggtgctgcgggcctttgagctgacccacacagaggtggtggagcggcggcggctgctgctggagaagggcacccaggagaggagccgcagccccagcagcagccgccacggggacagcaagacagaccgggagaagagccagatggtgggcatcagcaacagcgccctggtggacaagacagacaagacccagaccatgaagacccccaagggcctgggcaagaagaaggagaagtcctgggagctggccaagaaggaggagaagctgggcagcggccagagccccacccagggcacccccaagaaggaggatgccaccaaggccggcaagggcaaggtgaccatccctgagcagaagcccagccgggccaagggcatcaagattggcagccgggagaagaggagcatcctgctggagagcgagctggtggtggaggccacagaggtggtgaaccccctgctggagcctgtggagcacagagatggcaaggtgttcatgcctggcaacaaggtgctgctgcacctgaacctgatccggaaccgcatcacagaggtgggcctggagggcttcctggccaccgtgcagtaccagatgcagttcagcaaggccaagagcgccagcaagggccctgtgggcctgctgtggctgagcctggccaagaactgctttgccccccagtgcccagcctatgccatcatccaggagctgatgctgccccgggaccccatcaaggccaagctgagagaagatgaggccatggccttcttcccctag

SEQ ID NO: 39718 - DNA, 864 bp, Artificial Sequence
  Description of Artificial Sequence: Synthetic coding sequence
atgtcctgggaccccaaccctgtgcccaggaccctgcgctgctggaggctgcggcgggccagcgagacagccctgcagagcagcagaagagctgtggaggaccagctgaagatctgtggccacagaagagatgctgatgtgtttgagctgttcctgagcaagaaggagctgacagaggtgattgacctgagccgcttcaagaagctgaagtacctgtggctgcaccacaacaagctgcacggcatcaccttcctgaccaggaactactgcctgacagagctgtacctgaacaacaatgccatctttgaaattgagggcctgcactacctgcccagcctgcacatcctgctgctgcaccacaatgagctgaccaacattgatgccaccgtgaaggagctgaagggcatgctgaacctgaagatcctgagcctgtaccagaaccccctgtgccagtacaacctgtaccgcctgtacatcatctaccacctgcccggggtggagctgctggacaggaaccaggtgacagagaaggagaggaggtccatgatcaccatcttcaaccacaagaaggcccacatcgtgcagagcatcgcctttggaggcaaggtggatgcctcctgggaccccaagagccccttcaagcagaagccagcccagagggtgcccagcgactttgcctttgccaacaacgtggacaagacagtgctggatgatcctgaagatgctgtgtttgtgcgctccatgaagaggtctgtgatgaccctgacctccatgaactgggacacagtgcccacccgggaggagcgctacctggaggaggagggcacagaaacagcccagatgctgactgtgaccctgaggtag

SEQ ID NO: 39719 - DNA, 951 bp, Artificial Sequence
  Description of Artificial Sequence: Synthetic coding sequence
atgctgcccagcagcatccagatctctggagagcccctgagcggggctgaggtgcgggacatctgccggggcctgcgggacaatgctgtgcggctgctgagcctgcggggctgccgcctgtgtgaccgggactttggccgcatctgccgggccctggccggggccaccagcctggcccagctgaacctgaacctgggcgtggtgagcagccccagccgcatcaagcagctggccgaggccctgcggaccaacagaagcatccagagcctcttcctgcacggcagccccctgacagatgctggcctggccctgctgaacccagccctggccctgcacccagccctggtggccctggacctgggggactgcatgctgggagatgaggccatcaacctgatctgtggcctgctgcccccagatggagccaagagcggcctgaaggagctgaccctgagcgccaaccctggcatcacccccaagggctggagccggctggccatcgctgtggcccacagcagccaggtgcgggtgctgaacctggactacaaccccctgggggaccacgtggccggcatgctggccgtggccgtggccagcagcaggaccctggaggtgctggacctggagggcaccggcctgaccaaccagagcgcccagaccctgctggacatggtggagaactaccccacagccctgcggagcctggtgctggctgaaaattccatcagccctgagctgcagcagcagatctgtgacctgctgtctgagggggaggaggaggaggaggtggccggcggggccggggacacccaggagtgggagcggggccgggagcctgctgcccaccagaggggcagcagctcctggatgtgccccagcgaccccagcagccagatggtgctgatgaccagcggcctgggggacagcctgctggccgagacagagatgtag

SEQ ID NO: 39720 - DNA, 1245 bp, Artificial Sequence
  Description of Artificial Sequence: Synthetic coding sequence
atgaagctgcactgtgaggtggaggtgatcagccgccacctgcctgccctgggcctgaggaacagaggcaagggcgtgcgggctgtgctgagcctgtgccagcagaccagccgcagccagccccctgtgcgggccttcctgctgatcagcaccctgaaggacaagaggggcaccaggtatgagctgcgggagaacatcgagcagttcttcaccaagtttgtggatgagggcaaggccaccgtgcggctgaaggagccccctgtggacatctgcctgagcaaggccatcagcagcagcctgaagggcttcctgagcgccatgaggctggcccaccggggctgcaatgtggacacccctgtgtccaccctgacccctgtgaagaccagcgagtttgagaacttcaagaccaagatggtgatcaccagcaagaaggactaccccctgagcaagaacttcccctacagcctggagcacctgcagaccagctactgcggcctggtgcgggtggacatgaggatgctgtgcctgaagagcctgaggaagctggacctgagccacaaccacatcaagaagctgcctgccaccatcggggacctgatccacctgcaggagctgaacctgaatgacaaccacctggagagcttctctgtggccctgtgccacagcaccctgcagaagagcctgcggagcctggacctgagcaagaacaagatcaaggccctgcctgtgcagttctgccagctgcaggagctgaagaacctgaagctggatgacaatgaactcatccagttcccctgcaagattggccagctgatcaacctgcgcttcctgtctgctgccaggaacaagctgcccttcctgcccagcgagttcaggaacctgagcctggagtacctggacctgtttggaaacacctttgagcagcccaaggtgctgcctgtgatcaagctgcaggcccccctgaccctgctggagagcagcgcccggaccatcctgcacaaccgcatcccctacggcagccacatcatccccttccacctgtgccaggacctggacacagccaagatctgtgtgtgtggccgcttctgcctgaacagcttcatccagggcaccaccaccatgaacctgcacagcgtggcccacacagtggtgctggtggacaacctgggcggcacagaggcccccatcatctcctacttctgcagcctgggctgctacgtgaacagcagtgacatgctgaagtag

SEQ ID NO: 39721 - DNA, 441 bp, Artificial Sequence
  Description of Artificial Sequence: Synthetic coding sequence
atgaagctgcactgtgaggtggaggtgatcagccgccacctgcctgccctgggcctgaggaacagaggcaagggcgtgcgggctgtgctgagcctgtgccagcagaccagccgcagccagccccctgtgcgggccttcctgctgatcagcaccctgaaggacaagaggggcaccaggtatgagctgcgggagaacatcgagcagttcttcaccaagtttgtggatgagggcaaggccaccgtgcggctgaaggagccccctgtggacatctgcctgagcaaggacagcatctggctgagctaccacagcatccccagcctgccccgcttcggctacaggaagaacctgtgcctgtggaagatcctgtctgagctgttccacagcaggaactactaccatgaaagtgccttctgctgcccccactgcggcctgagcaggtag

SEQ ID NO: 39722 - DNA, 1269 bp, Artificial Sequence
  Description of Artificial Sequence: Synthetic coding sequence
atgaagctgcactgtgaggtggaggtgatcagccgccacctgcctgccctgggcctgaggaacagaggcaagggcgtgcgggctgtgctgagcctgtgccagcagaccagccgcagccagccccctgtgcgggccttcctgctgatcagcaccctgaaggacaagaggggcaccaggtatgagctgcgggagaacatcgagcagttcttcaccaagtttgtggatgagggcaaggccaccgtgcggctgaaggagccccctgtggacatctgcctgagcaagatggagagccacagcgtgacccaggtgggcgtgcagtgggaggagctgggcagcctgcagcccaccggccacttccagcagttcaagcgcttccccttctcctatgaaacaggccaccggggctgcaatgtggacacccctgtgtccaccctgacccctgtgaagaccagcgagtttgagaacttcaagaccaagatggtgatcaccagcaagaaggactaccccctgagcaagaacttcccctacagcctggagcacctgcagaccagctactgcggcctggtgcgggtggacatgaggatgctgtgcctgaagagcctgaggaagctggacctgagccacaaccacatcaagaagctgcctgccaccatcggggacctgatccacctgcaggagctgaacctgaatgacaaccacctggagagcttctctgtggccctgtgccacagcaccctgcagaagagcctgcggagcctggacctgagcaagaacaagatcaaggccctgcctgtgcagttctgccagctgcaggagctgaagaacctgaagctggatgacaatgaactcatccagttcccctgcaagattggccagctgatcaacctgcgcttcctgtctgctgccaggaacaagctgcccttcctgcccagcgagttcaggaacctgagcctggagtacctggacctgtttggaaacacctttgagcagcccaaggtgctgcctgtgatcaagctgcaggcccccctgaccctgctggagagcagcgcccggaccatcctgcacaacagaaccatctaccccaaggagatcaacgtgaacatgtgggagaccctgcccggccgcatcagcctgggctgcatgtatgactttgctgccagcaactggagcaagggccgcttcctgtacacctgctggaggggcggcatgtgcatcgtgacccacctggatgacagcaagaccttcatcaagaccaacttctccttctag

SEQ ID NO: 39723 - DNA, 507 bp, Artificial Sequence
  Description of Artificial Sequence: Synthetic coding sequence
atgcaccccagcctggccaccatgggcaagctggccagcaagctgcagctggacctgtctgtggtgaagatctggttcaagaaccagagggccaagtggaagaggcagcagaggcagcagatgcagacccggcccagcctgggccctgccaaccagaccacctctgtgaagaaggaggagaccccatctgccatcaccacagccaacatccggcctgtgtccccaggcatcagtgatgccaatgaccatgacctgcgggagcccagcggcatcaagaaccctgggggcgccagcgccagcgcccgggtgtcctcctgggacagccagagctatgacatcgagcagatctgcctgggcgccagcaaccccccctgggccagcaccctgtttgaaattgatgaatttgtgaagatctatgacctgcccggggaggatgacaccagcagcctgaaccagtacctgtttcctgtgtgcctggagtatgaccagctgcagagctctgtgtag

SEQ ID NO: 39724 - DNA, 549 bp, Artificial Sequence
  Description of Artificial Sequence: Synthetic coding sequence
tgagcccacggcttccagccccacgcctctgtggagcccgcctgccaggccggcacctggaacctgaagcagctgagccaggagggcccccggcgctaccgccggcccaggacccgcttcctgagcaagcagctgacagccctgcgggagctgctggagaagaccatgcaccccagcctggccaccatgggcaagctggccagcaagctgcagctggacctgtctgtggtgaagatctggttcaagaaccagagggccaagtggaagaggcagcagaggcagcagatgcagacccggcccagcctgggccctgccaaccagaccacctctgtgaagaaggaggagacccccagcgccatcaccacagccaacatccggcctgtgtccccaggcatcagtgatgccaatgaccatgacctgcgggagcccagcggcatcaagaaccctggaggagccagcgccagcgcccgggtgtcctcctgggacagccagagctatgacatcgagcagatctgcctgggcgccagcaaccccccctgggccagctag

SEQ ID NO: 39725 - DNA, 573 bp, Artificial Sequence
  Description of Artificial Sequence: Synthetic coding sequence
atggccagccggggcaagacagagaccagcaagctgaagcagaacctggaggagcagctggaccggctgatgcagcagctgcaggacctggaggagtgccgggaggagctggacacagatgaatatgaggagaccaagaaggagaccctggagcagctgtctgagttcaatgacagcctgaagaagatcatgagcggcaacatgaccctggtggatgagctgagcggcatgcagctggccatccaggccgccatcagccaggccttcaagaccccagaggtgatccggctgtttgccaagaagcagcccggccagctgcggacccggctggccgagatggaccgggacctgatggtgggcaagctggagcgggacctgtacacccagcagaaggtggagatcctgacagccctgaggaagctgggggagaagctgacagcagatgatgaggccttcctgagcgccaatgctggggccatcctgagccagtttgagaaggtgtccacagacctgggcagcggggacaagatcctggccctggccagctttgaggtggagaagaccaagaagtag

SEQ ID NO: 39726 - DNA, 573 bp, Artificial Sequence; identical to SEQ ID NO: 39725
  Description of Artificial Sequence: Synthetic coding sequence

SEQ ID NO: 39727 - DNA, 573 bp, Artificial Sequence; identical to SEQ ID NO: 39725
  Description of Artificial Sequence: Synthetic coding sequence

SEQ ID NO: 39728 - DNA, 636 bp, Artificial Sequence
  Description of Artificial Sequence: Synthetic coding sequence
atgaacaacttcatcttcctgaagttcatgaccctgggcaccagcaggactggagagatcaagatggccagccggggcaagacagagaccagcaagctgaagcagaacctggaggagcagctggaccggctgatgcagcagctgcaggacctggaggagtgccgggaggagctggacacagatgaatatgaggagaccaagaaggagaccctggagcagctgtctgagttcaatgacagcctgaagaagatcatgagcggcaacatgaccctggtggatgagctgagcggcatgcagctggccatccaggccgccatcagccaggccttcaagaccccagaggtgatccggctgtttgccaagaagcagcccggccagctgcggacccggctggccgagatggaccgggacctgatggtgggcaagctggagcgggacctgtacacccagcagaaggtggagatcctgacagccctgaggaagctgggggagaagctgacagcagatgatgaggccttcctgagcgccaatgctggggccatcctgagccagtttgagaaggtgtccacagacctgggcagcggggacaagatcctggccctggccagctttgaggtggagaagaccaagaagtag

SEQ ID NO: 39729 - DNA, 720 bp, Artificial Sequence
  Description of Artificial Sequence: Synthetic coding sequence
atggtgcagccccagaccagcaaggccgagagccctgccctggccgccagccccaatgcccagatggatgatgtgattgacaccctgaccagcctgcggctgaccaacagcgccctgcggcgggaggccagcaccctgcgggcagagaaggccaacctgaccaacatgctggagagcgtgatggccgagctgaccctgctgcggacccgggcccgcatccctggggccctgcagatcaccccacccatcagcagcatcaccagcaatggcacccggcccatgaccaccccacccaccagcctgcctgagcccttcagcggggaccccggccgcctggccggcttcctgatgcagatggaccgcttcatgatcttccaggccagccgcttccctggagaggccgagcgggtggccttcctggtgtcccggctgactggagaggccgagaagtgggccatcccccacatgcagcctgacagccccctgaggaacaactaccagggcttcctggccgagctgcggaggacctacaagagccccctgcggcatgcccggcgggcccagatcaggaagaccagcgccagcaacagagctgtgcgggagcggcagatgctgtgccggcagctggccagcgctggcaccggcccctgccctgtgcacccagccagcaatggcaccagccctgccccagccctgcctgcccgggccaggaacctgtag

SEQ ID NO: 39730 - DNA, 2079 bp, Artificial Sequence
  Description of Artificial Sequence: Synthetic coding sequence
atggaccaccacatccccatgcacgccctgcctgaggagatccagaagatgctgcctgaggagaaggtgtgcaagtactgcggcgtgtcctacctgatcctgcacgagttcaaggccatggaggagaaggtgaaggccatggagaaggagatgaagttctaccagggctctgtggaccgggagaagaggctgcaggagaagctgcacagcctgagccaggagctggagcagtacaagattgacaacaagagcaagacagagcgcatctatgatgtgggcatgcagctgaagagccagcagaatgagttccagaaggtgaagaagcagctgagccacctgcaggatgagctgaagatcaagtaccggcagagctacatcttcagccagaggctgtctgagtacaagtacttctggaacaagaccctgagcctgctgaccttcaccaagcgggagctgaccagcatcaagaatgaggtgtatgacaactaccagaactggaccagcctgaagggagctgtgttcctgcagatcaagagcatcagcgagacagccctgacagaaattgacatcctgaacaagagcctgactgtgtcccagaggaacaaggtgtgcctggagaaggagatgaagaacctgaagctgctgagtgatgctgccatcctgcggagccagcagatccgcaccagccggcagcaggaggtgaacctgcagacccgctgctatgacctgcagaaggaggtgctggacctgcagtgcctggtggaggccctgggcctgaagctgcagaaggctgtgacagagatggacaactacaaggagatgctgatgaacaagagcaatgaagcagatgactgccagcgggagctgaagaagctgaagtttgagagcatcatcagcgagagccagcacaccatgctgctgaaggagaaggaggacagcctgatgacctgccagcagatctacaaggccctgcaggaggagctgactgtgaaggagaagcaggaggaggacatcaagaggcgcatcaacctggccgagaatgagctggagatcaccaagaccctgctgaaccagacccgggaggaggtgctgaccctgaagaatgaaagagagctgatgctgatcagccaccagaagagcattgagcagctgcaggagaccctgcggcagaagctgctgagtgatgacaactggaaggagaagattgaggccgagctggccaaggagcgggcccagcacctggtggagtttgaggagcaggccctgctcttcaaggaggagaccaagctgcagctggacatcgagaaggagaagcaccaggatgtgatccagaagtacaagaaggagcaggaggagctgcagatgaagatcagtgacctgatcaccggggccacccgggacctgcggcaggaggtgaccaccctgaaggagaagctgcacaagagccacatccgctacacagaggagagcaacagcaaggagaaggagattgagaacctgaagaacctggtggccgagtttgagagccggctgaagaaggagattgacagcaatgacagcgtgtctgagaacctgaggaaggagatggagcagaagagtgatgagctgaagagggtgatgctggcccagacccagctgattgagcagttcaaccagagccaggaggagaacaccttcctgcaggagaccgtgagaagagaatgtgaggagagatttgagctgacagaggccctgagccaggcccgggagcagctgctggagctgagcaagctgcggggcagcctgcccttcagcccctgcagcctgagcaagggcagcctgaccagccctgctgctgctgtgagcaaccacggggagaggagcctggcccggctgaacagcgagaagggcatccagatccccaacctgcggggcgtgtccaagcccaccaccttccccaccagtgacaagcccaagagggtgcgcagcggcgtgcccatcctgccccagccccaccccccccggggcggggccagcagcgccaatgagacccggcagaggctggccgccatcctgcggcggcggcgcagccagcagtag

SEQ ID NO: 39731 - DNA, 1167 bp, Artificial Sequence
  Description of Artificial Sequence: Synthetic coding sequence
atgctgctgaaggagaaggaggacagcctgatgacctgccagcagatctacaaggccctgcaggaggagctgactgtgaaggagaagcaggaggaggacatcaagaggcgcatcaacctggccgagaatgagctggagatcaccaagaccctgctgaaccagacccgggaggaggtgctgaccctgaagaatgaaagagagctgatgctgatcagccaccagaagagcattgagcagctgcaggagaccctgcggcagaagctgctgagtgatgacaactggaaggagaagattgaggccgagctggccaaggagcgggcccagcacctggtggagtttgaggagcaggccctgctcttcaaggaggagaccaagctgcagctggacatcgagaaggagaagcaccaggatgtgatccagaagtacaagaaggagcaggaggagctgcagatgaagatcagtgacctgatcaccggggccacccgggacctgcggcaggaggtgaccaccctgaaggagaagctgcacaagagccacatccgctacacagaggagagcaacagcaaggagaaggagattgagaacctgaagaacctggtggccgagtttgagagccggctgaagaaggagattgacagcaatgacagcgtgtctgagaacctgaggaaggagatggagcagaagagtgatgagctgaagagggtgatgctggcccagacccagctgattgagcagttcaaccagagccaggaggagaacaccttcctgcaggagaccgtgagaagagaatgtgaggagagatttgagctgacagaggccctgagccaggcccgggagcagctgctggagctgagcaagctgcggggcagcctgcccttcagcccctgcagcctgagcaagggcagcctgaccagccctgctgctgctgtgagcaaccacggggagaggagcctggcccggctgaacagcgagaagggcatccagatccccaacctgcggggcgtgtccaagcccaccaccttccccaccagtgacaagcccaagagggtgcgcagcggcgtgcccatcctgccccagccccaccccccccggggcggggccagcagcgccaatgagacccggcagaggctggccgccatcctgcggcggcggcgcagccagcagtag

SEQ ID NO: 39732 - DNA, 1653 bp, Artificial Sequence
  Description of Artificial Sequence: Synthetic coding sequence
atggcctctgtgttccactacttcctgctggtgctggtgttcctggacacccatgctgcccagcccttctgcctgcccggctgcacctgcagcgaggagagctttggaagaaccctgcagtgcacctctgtgtccctgggcaagatccctggcaacctgtctgaggagttcaagcaggtgagaattgagaacagccccctgtttgagatgccccagggcagcttcatcaacatgagcaccctggagtacctgtggctgaacttcaacaacatcagcgtcatccacctgggcgccctggagcacctgcctgagctgcgggagctgcggctggagggcaacaagctgtgcagcgtgccctggacagccttccgggccacccccctgctgcgggtgctggacctgaagaggaacaagattgatgccctgcctgagctggccctgcagttcctggtgtccctgacctacctggacctgagcagcaaccggctgactgtggtgtccaagtctgtgttcctgaactggccagcctaccagaagtgccggcagcctgactgtggggctgagatcctgagcagcctggtggtggccctgcatgacaacccctgggtgtgtgactgccgcctgcggggcctggtgcagtttgtgaagagcatcaccctgcctgtgatcctggtgaacagctacctgatctgccagggccccctgagcaaggccggccagctgttccatgaaacagagctgagcgcctgcatgaagccccagatcagcaccccatctgccaacatcaccatccgggccggccagaatgtgaccctgcgctgcctggcccaggccagccccagccccagcatcgcctggacctaccccctgtccatgtggagggagtttgatgtgctgaccagcagcactggagaggacacagccctgtctgagctggccatcccagctgcccacctggtggacagcggcaactacacctgcatggccagcaacagcatcggcaagagcaacctggtgatcagcctgcacgtgcagcctgcccaggccctgcacgccccagacagcctgagcatccccagcgagggcaatgcctacatcgacctgcgggtggtgaagcagacagtgcacggcatcctgctggagtggctggccgtggccgacaccagcaaggaggagtggttcaccctgtacatcgccagtgatgaggccttcaggaaggaggtggtgcacatcggccctggcatcaacacctatgctgtggatgacctgctgcccggcaccaagtatgaggcctgcctgagcctggagggccagcccccccaccagggccagtgtgtggcctttgtgactggaagagatgctgggggcctggaggcccgggagcacctgctgcacgtgacagtggtgctgtgtgtggtgctgctggccgtgcctgtgggcgcctatgcctgggccgcccagggcccctgcagctgcagcaagtgggtgctgcggggctgcctgcacaggaggaaggcccccagctgcaccccagctgccccccagagcaaggatggcagcttccgggagcaccctgctgtgtgtgatgatggagagggccacatcgacacagaaggagacaaggagaagggcggcacagaggacaacagctag

SEQ ID NO: 39733 - DNA, 1683 bp, Artificial Sequence
  Description of Artificial Sequence: Synthetic coding sequence
atggcctctgtgttccactacttcctgctggtgctggtgttcctggacacccatgctgcccagcccttctgcctgcccggctgcacctgcagcgaggagagctttggaagaaccctgcagtgcacctctgtgtccctgggcaagatccctggcaacctgtctgaggagttcaagcaggtgagaattgagaacagccccctgtttgagatgccccagggcagcttcatcaacatgagcaccctggagtacctgtggctgaacttcaacaacatcagcgtcatccacctgggcgccctggagcacctgcctgagctgcgggagctgcggctggagggcaacaagctgtgcagcgtgccctggacagccttccgggccacccccctgctgcgggtgctggacctgaagaggaacaagattgatgccctgcctgagctggccctgcagttcctggtgtccctgacctacctggacctgagcagcaaccggctgactgtggtgtccaagtctgtgttcctgaactggccagcctaccagaagtgccggcagcctgactgtggggctgagatcctgagcagcctggtggtggccctgcatgacaacccctgggtgtgtgactgccgcctgcggggcctggtgcagtttgtgaagagcatcaccctgcctgtgatcctggtgaacagctacctgatctgccagggccccctgagcaaggccggccagctgttccatgaaacagagctgagcgcctgcatgaagccccagatcagcaccccatctgccaacatcaccatccgggccggccagaatgtgaccctgcgctgcctggcccaggccagccccagccccagcatcgcctggacctaccccctgtccatgtggagggagtttgatggcctgctgggcggcaagcacctgacccctgtgctgaccagcagcactggagaggacacagccctgtctgagctggccatcccagctgcccacctggtggacagcggcaactacacctgcatggccagcaacagcatcggcaagagcaacctggtgatcagcctgcacgtgcagcctgcccaggccctgcacgccccagacagcctgagcatccccagcgagggcaatgcctacatcgacctgcgggtggtgaagcagacagtgcacggcatcctgctggagtggctggccgtggccgacaccagcaaggaggagtggttcaccctgtacatcgccagtgatgaggccttcaggaaggaggtggtgcacatcggccctggcatcaacacctatgctgtggatgacctgctgcccggcaccaagtatgaggcctgcctgagcctggagggccagcccccccaccagggccagtgtgtggcctttgtgactggaagagatgctgggggcctggaggcccgggagcacctgctgcacgtgacagtggtgctgtgtgtggtgctgctggccgtgcctgtgggcgcctatgcctgggccgcccagggcccctgcagctgcagcaagtgggtgctgcggggctgcctgcacaggaggaaggcccccagctgcaccccagctgccccccagagcaaggatggcagcttccgggagcaccctgctgtgtgtgatgatggagagggccacatcgacacagaaggagacaaggagaagggcggcacagaggacaacagctag

SEQ ID NO: 39734 - DNA, 1176 bp, Artificial Sequence
  Description of Artificial Sequence: Synthetic coding sequence
atgaggggcagctgtgagaggtctggagaagatgaggagcagaaggaggaggccatggtggcctgtggccgcctgagcggcgtgcctgaggccgagcagggccctgaggccaactgggacagcgacctggagacagagggcacagatggcctgggggagctggtgcgggacaccctgtacctgcggagctgccgggcccacagcgtggtgcccatcagctgcttcctgcggcagggcagcgcccaggagctgaacctgcggcaccggggcctgggcccccagggcgcccgggccctggccagcagcctgagcagcaacccctacgtgaagaggctggacctgcgggacaatggcctgtgtggggccggggctgaggccctggccggggccctgagcaagagcagcagcatccatgatgtggacctgtctgagaaccagctgggcgtggccggggcccaggccctgtgtgccgccctgactgtgaaccaggccatgaggaagatgcagctgtctggaaatggcctggaggagcaggccgcccagcacctggccgagctgctgctggcccacacagacctgaagagcctggacctgagctacaaccagctgaatgaccaggccggggagaccctgggccctgccctggctgaaaatacaggcctgacagagctgaatgtgtcctggaaccacctgcggggccctggagctgtggcctttgcccggggcctggaggccaacatcttcctgaaggtgctggacatctcctacaatggatttggagaccccggggccagcgctgtgggggaggccctgaaggccaacaacgtgctggaggagctgaacatgagcaacaaccgcatcagcgccatgggcgccctgagcctgggcctgggcctgcgggtgaaccagaccctgcgcatcctggtgtccaggaaccccatgaggtctgagggctgcttcggcctgctgaagtctgtgcaggacaacccagccagcgccctggagctgctggacttcagtgacatccaggtgaatgctgagtttgatggcctggccagctctgtgcggggcatcctgcctgagctgtgcatcaagacaggagcctgccgggtggagtacaagaaggagctgctgcctgtgttccgcagcgccctgcctgcctctgtgcccaagtag

SEQ ID NO: 39735 - DNA, 486 bp, Artificial Sequence
  Description of Artificial Sequence: Synthetic coding sequence
atgaggggcagctgtgagaggtctggagaagatgaggagcagaaggaggaggccatggtggcctgtggccgcctgagcggcgtgcctgaggccgagcagggccctgaggccaactgggacagcgacctggagacagagggcacagatggcctgggggagctggtgcgggacaccctgtacctgcggagctgccgggcccacagcgtggtgcccatcagctgcttcctgcggcagggcagcgcccaggagctgaacctgcggcaccggggcctgggcccccagggcgcccgggccctggccagcagcctgagcagcaacccctacgtgaagaggctggacctgcgggacaatggcctgtgtggggccggggctgaggccctggccggggccctgagcaagagcagcagcatccacggccgctgctgggtgtggggccgctgggccggcgtgagcagcttcagcagcggcatgtgcctgcacaggtag

SEQ ID NO: 39736 - DNA, 2298 bp, Artificial Sequence
  Description of Artificial Sequence: Synthetic coding sequence
atggccgccagccagggcggcggcggcaacagcggcggcggcggctgcggcggcggcggcagcagcggcggctgcggcacagctgggggcggcggcggcggggccggcggcggcggcggcggcggcggcggcaccctggtggtgcccatccctgtgcccaccctgtttggccagcccttccccaacggccccccctggaaccctggcagcctgcagccccagcacacagtgcgcagcctggaccgggccctggaggaggccggcagcagcggcatcctgagcctgagcggcaggaagctgcgggacttccctggcagcggctatgacctgacagacaccacccaggccgacctgagcaggaaccgcttcacagagatccccagtgatgtgtggctgtttgcccccctggagaccctgaacctgtaccacaactgcatcaagaccatccctgaggccatcaagaacctgcagatgctgacctacctgaacatcagcaggaacctgctgagcaccctgcccaagtacctgtttgacctgcccctgaaggtgctggtggtgagcaacaacaagctggtgtccatccctgaggagatcggcaagctgaaggacctgatggagctggacatcagctgcaatgagatccaggtgctgccccagcagatgggcaagctgcacagcctgcgggagctgaacatcagaagaaacaacctgcacgtgctgcctgatgagctgggggacctgcccctggtgaagctggacttcagctgcaacaaggtgacagagatccctgtgtgctacaggaagctgcaccacctgcaggtgatcatcctggacaacaaccccctgcaggtgcccccagcccagatctgcctgaagggcaaggtgcacatcttcaagtacctgaacatccaggcctgctgcaggatggacaagaagccagacagcctggacctgcccagcctgagcaagaggatgcccagccagcccctgacagacagcatggaggacttctaccccaacaagaaccacggcccagattctggaattggaagtgacaatggagagaagaggctgagcaccacagagcccagtgatgatgacacagtgtccctgcacagccaggtgtctgagagcaaccgggagcagaccagcagaaatgacagccacatcatcggcagcaagacagacagccagaaggaccaggaggtgtatgactttgtggaccccaacacagaagatgtggccgtgcctgagcagggcaatgcccacatcggcagctttgtgtccttcttcaagggcaaggagaagtgcagcgagaagagcaggaagaatgaggagctgggagatgagaagaggctggagaaggagcagctgctggccgaggaggaggatgatgacctgaaggaggtgacagacctgaggaagattgctgcccagctgctgcagcaggagcagaagaaccgcatcctgaaccacagcacctctgtgatgaggaacaagcccaagcagacagtggagtgtgagaagtctgtgtctgcagatgaggtgaacagccccctgagccccctgacctggcagcccctggagaaccagaaggaccagattgatgagcagccctggccagagagccaccccatcatctggcagagcgaggagcggcggcgcagcaagcagatcaggaaggagtacttcaagtacaagtccatgaggaagagcagcagtggaaatgaaaatgatgagcaggacagcgacaatgccaacatgagcacccagagccctgtgagcagcgaggagtatgacagaacagatggcttcagccacagccccttcggcctgaagcccaggtctgccttcagccgcagcagccggcaggagtatggagctgctgaccccggcttcaccatgaggaggaagatggagcacctgcgggaggagcgggagcagatccggcagctgaggaacaacctggagagccggctgaaggtgatcctgcctgatgacatcggggccgccctgatggatggagtggtgctgtgccacctggccaaccacatccggcccaggtctgtggccagcatccacgtgcccagccctgctgtgcccaagctgtccatggccaagtgcagaagaaatgtggagaacttcctggatgcctgcaagaagctgggcgtgtcccaggagcggctgtgcctgccccaccacatcctggaggagcggggcctggtgaaggtgggcgtgacagtgcaggccctgctggagctgcccaccaccaaggccagccagctgtctgtggcctag

SEQ ID NO: 39737 - DNA, 735 bp, Artificial Sequence
  Description of Artificial Sequence: Synthetic coding sequence
ggcctcttcagcctgcccggcacctggaggagagtgcgggaggaggccgtgacagtgggggagagccaccccatcatctggcagagcgaggagaggagaagaagcaagcagatcaggaaggagtacttcaagtacaagtccatgaggaagagcagcagtggaaatgaaaatgatgagcaggacagcgacaatgccaacatgagcacccagagccctgtgtcctctgaggagtatgacagaacagatggcttcagccacagccccttcggcctgaagcccaggtctgccttcagccgcagcagccggcaggagtatggagctgctgaccccggcttcaccatgaggaggaagatggagcacctgcgggaggagcgggagcagatccggcagctgaggaacaacctggagagccggctgaaggtgatcctgcctgatgacattggagctgccctgatggatggagtggtgctgtgccacctggccaaccacatccggcccaggtctgtggccagcatccacgtgcccagccctgctgtgcccaagctgtccatggccaagtgcagaagaaatgtggagaacttcctggatgcctgcaagaagctgggcgtgtcccaggagcggctgtgcctgccccaccacatcctggaggagcggggcctggtgaaggtgggcgtgacagtgcaggccctgctggagctgcccaccaccaaggccagccagctgtctgtggcctag

SEQ ID NO: 39738 - DNA, 2247 bp, Artificial Sequence
  Description of Artificial Sequence: Synthetic coding sequence
atggccgccagccagggcggcggcggcaacagcggcggcggcggctgcggcggcggcggcagcagcggcggctgcggcacagctgggggcggcggcggcggggccggcggcggcggcggcggcggcggcggcaccctggtggtgcccatccctgtgcccaccctgtttggccagcccttccccaacggccccccctggaaccctggcagcctgcagccccagcacacagtgcgcagcctggaccgggccctggaggaggccggcagcagcggcatcctgagcctgagcggcaggaagctgcgggacttccctggcagcggctatgacctgacagacaccacccaggccgacctgagcaggaaccgcttcacagagatccccagtgatgtgtggctgtttgcccccctggagaccctgaacctgtaccacaactgcatcaagaccatccctgaggccatcaagaacctgcagatgctgacctacctgaacatcagcaggaacctgctgagcaccctgcccaagtacctgtttgacctgcccctgaaggtgctggtggtgagcaacaacaagctggtgtccatccctgaggagatcggcaagctgaaggacctgatggagctggacatcagctgcaatgagatccaggtgctgccccagcagatgggcaagctgcacagcctgcgggagctgaacatcagaagaaacaacctgcacgtgctgcctgatgagctgggggacctgcccctggtgaagctggacttcagctgcaacaaggtgacagagatccctgtgtgctacaggaagctgcaccacctgcaggtgatcatcctggacaacaaccccctgcaggtgcccccagcccagatctgcctgaagggcaaggtgcacatcttcaagtacctgaacatccaggcctgctgcaggatggacaagaagccagacagcctggacctgcccagcctgagcaagaggatgcccagccagcccctgacagacagcatggaggacttctaccccaacaagaaccacggcccagattctggaattggaagtgacaatggagagaagaggctgagcaccacagagcccagtgatgatgacacagtgtccctgcacagccaggtgtctgagagcaaccgggagcagaccagcagaaatgacagccacatcatcggcagcaagacagacagccagaaggaccaggaggtgtatgactttgtggaccccaacacagaagatgtggccgtgcctgagcagggcaatgcccacatcggcagctttgtgtccttcttcaagggcaaggagaagtgcagcgagaagagcaggaagaatgaggagctgggagatgagaagaggctggagaaggagcagctgctggccgaggaggaggatgatgacctgaaggaggtgacagacctgaggaagattgctgcccagctgctgcagcaggagcagaagaaccgcatcctgaaccacagcacctctgtgatgaggaacaagcccaagcagacagtggagtgtgagaagtctgtgtctgcagatgaggtgaacagccccctgagccccctgacctggcagcccctggagaaccagaaggaccagattgatgagcagccctggccagagagccaccccatcatctggcagagcgaggagcggcggcgcagcaagcagatcaggaaggagtacttcaagtacaagtccatgaggaagagcagcagtggaaatgaaaatgatgaggagtatgacagaacagatggcttcagccacagccccttcggcctgaagcccaggtctgccttcagccgcagcagccggcaggagtatggagctgctgaccccggcttcaccatgaggaggaagatggagcacctgcgggaggagcgggagcagatccggcagctgaggaacaacctggagagccggctgaaggtgatcctgcctgatgacattggagctgccctgatggatggagtggtgctgtgccacctggccaaccacatccggcccaggtctgtggccagcatccacgtgcccagccctgctgtgcccaagctgtccatggccaagtgcagaagaaatgtggagaacttcctggatgcctgcaagaagctgggcgtgtcccaggagcggctgtgcctgccccaccacatcctggaggagcggggcctggtgaaggtgggcgtgacagtgcaggccctgctggagctgcccaccaccaaggccagccagctgtctgtggcctag

SEQ ID NO: 39739 - DNA, 2247 bp, Artificial Sequence; identical to SEQ ID NO: 39738
  Description of Artificial Sequence: Synthetic coding sequence

SEQ ID NO: 39740 - DNA, 351 bp, Artificial Sequence
  Description of Artificial Sequence: Synthetic coding sequence
atgacccagctgaaggagctggacatcagcaacaatgccatccgggagatccccagaaatattggagagctgaggaacctggtgtccctgcacgcctacaacaaccagatctcctacctgccccccagcctgctgagcctgaatgacctgcagcagctgaacctgagcggcaacaacctgacagccctgcccagcgccatctacaacatcttcagcctgaaggagatcaactttgatgacaaccccctgctgcggccccctgtggagatctgcaagggcaagcagctgtacaccatcgcccgctacctgcagagagcagatgaaagagatggcctgcagctgcacagctag

SEQ ID NO: 39741 - DNA, 2583 bp, Artificial Sequence
  Description of Artificial Sequence: Synthetic coding sequence
atgtctgagaaggagggcatgtctgaggtgctggaggacaccatcagccagttcaggaaggagagccgcagccagagcatgaaggagcccggcttcatcaaggagaccagcaacctgatcaatgaggccagtgactacctggagggcaagagcagcaaccagatctatgagacccacccccggcagaacaccctggagagcaccagcagcagcggcaggaagagcaagagaaatgaggagcagaagaagaacctgcagttcagcgagaccagcaccaggacaggcaccagccagagcctgagcagcctgaccggccgcacagctgagtaccaggccctggtgaacttcctgagccatgaaacagtgggggaggtgagcccccaggtgtctgaggagaaccagaagcagctgggcctgggcgctgacaacttcaccgtgaacctggaggccaagggcctgcaggagttccccaaggacatcctgaagatcaagtatgtgaagtacctgtacctggacaagaaccagatcaagaccttccagggcgctgacagcggggacctgctgggcctggagatcctgagcctgcaggagaatggcctgagcagcctgcccagcgagatccagctgctgcacaacctgcgcatcctgaatgtgagccacaaccacatcagccacatccccaaggagatcagccagctgggcaacatccggcagctgttcttctacaacaactacatcgagaacttccccagcgacctggagtgcctgggcaacctggagatcctgagcctgggcaagaacaagctgcggcacatcccagacaccctgcccagcctgaagaccctgcgggtgctgaacctggagtacaaccagctgaccaccttccccaaggccctgtgcttcctgcccaagctgatcagcctggacctgactggaaacctgatcagcagcctgcccaaggagatccgggagctgaagaacctggagaccctgctgatggaccacaacaagctgaccttcctggccgtggagatcttccagctgctgaagatcaaggagctgcagctggccgacaacaagctggaggtgatcagccacaagattgagaacttccgggagctgcgcatcctgatcctggacaagaacctgctgaagaacatccctgagaagatcagctgctgtgccatgctggagtgcctgagcctgagtgacaacaagctgacagagctgcccaagtacatccacaagctgaacaacctgaggaagctgcacgtgaacagaaacaacatggtgaagatcacagactgcatcagccacctgaacaacatctgcagcctggagttcagcggcaacatcatcacagatgtgcccatcgagatcaagaactgccagaagatcatcaagattgagctgagctacaacaagatcatgtacttccccctgggcctgtgtgccctggacagcctgtactacctgtctgtgaatggaaactacatcagcgagatccctgtggacatctccttcagcaagcagctgctgcacctggagctgtctgagaacaagctgctgatcttcagcgagcacttctgcagcctcatcaacctgaagtacctggacctgggcaagaaccagatcaagaagatcccagccagcatcagcaacatgatcagcctgcacgtgctgatcctgtgctgcaacaagtttgagaccttcccccgggagctgtgcaccctggagaacctgcaggtgctggacctgtctgagaaccagctgcagaagatcagcagtgacatctgcaacctgaagggcatccagaagctgaacttcagcagcaaccagttcatccacttccccatcgagctgtgccagctgcagagcctggagcagctgaacatcagccagatcaagggcaggaagctgacccggctgcccggggagctgagcaacatgacccagctgaaggagctggacatcagcaacaatgccatccgggagatccccaggaacatcggggagctgaggaacctggtgtccctgcacgcctacaacaaccagatctcctacctgccccccagcctgctgagcctgaatgacctgcagcagctgaacctgagcggcaacaacctgacagccctgcccagcgccatctacaacatcttcagcctgaaggagatcaactttgatgacaaccccctgctgcggccccctgtggagatctgcaagggcaagcagctgtacaccatcgcccgctacctgcagagagcagatgaaagagatgagaagatcctggagaagatcttcaagatcgtggccaacaacatcacagagaccaactttgagttcctgtgccagaagctgaacctggccaacagcgagacagacatgcccaccaagagcacagtgtccctgtctgagcgggcccaccaggccctggtgatctggaagacccagagcaacaagctgagcctgacagctgctgccctgcgggaccagctgatccgggccctgaccatgattggagcctatgagatcatggacaagatcacagccctgaacctcttcacccgggccatcaagttctag

SEQ ID NO: 39742 - DNA, 180 bp, Artificial Sequence
  Description of Artificial Sequence: Synthetic coding sequence
atgtctgagaaggagggcatgtctgaggtgctggaggacaccatcagccagttcaggaaggagagccgcagccagagcatgaaggagcccggcttcatcaaggagaccagcaacctgatcaatgaggccagtgactacctggagggcaagagcagcaaccagatctatgagacccactag

SEQ ID NO: 39743 - DNA, 354 bp, Artificial Sequence
  Description of Artificial Sequence: Synthetic coding sequence
atgacccagctgaaggagctggacatcagcaacaatgccatccgggagatccccagaaatattggagagctgaggaacctggtgtccctgcacgcctacaacaaccagatctcctacctgccccccagcctgctgagcctgaatgacctgcagcagctgaacctgagcggcaacaacctgacagccctgcccagcgccatctacaacatcttcagcctgaaggagatcaactttgatgacaaccccctgctgcggccccctgtggagatctgcaagggcaagcagctgtacaccatcgcccgctacctgcagagagcagatgaaagagatggccgcctgaagatccacacctag

SEQ ID NO: 39744 - DNA, 2583 bp, Artificial Sequence; identical to SEQ ID NO: 39741
  Description of Artificial Sequence: Synthetic coding sequence

SEQ ID NO: 39745 - DNA, 2478 bp, Artificial Sequence
  Description of Artificial Sequence: Synthetic coding sequence
atggccaccagcgagcgggccctgctgcggaccagggctgccagcctgctgcggggcctgggccgcagcaggactggagcccggagcctgcagttccgggcagagaaggagcggcagccctgctggagcttccccatgggccagaagaccaagggcagcagcaacatcgccagcagctacctgctgcagcagctgatgcaccgctaccaggagctggacagtgatggagatgaggaccagggcgagggggaggccggcagcgaggagagcagcgagagcgagatgctgaacctggaggaggagtttgatggagtgctgcgggaggaggccgtggccaaggccctgcaccacctgggccgcagcggcagcggcacagagcaggtgtacctgaacctgaccctgagcggctgcaacctgattgatgtgtccatcctgtgtggctacgtgcacctgcagaagctggacctgagcgccaacaagattgaggacctgagctgtgtgtcctgcatgccctacctgctggagctgaatgccagccagaacaacctgaccaccttcttcaacttcaagccacccaagaacctgaagaaggctgacttcagccacaaccagatcagcgagatctgtgacctgagcgcctaccacgccctgaccaagctgatcctggatggaaatgaaattgaggagatcagcggcctggagatgtgcaacaacctgatccacctgagcctggccaacaacaagatcaccaccatcaatggcctgaacaagctgcccatcaagatcctgtgcctgagcaacaaccagatcgagatgatcaccggcctggaggacctgaaggccctgcagaacctggacctgagccacaaccagatcagcagcctgcagggcctggagaaccacgacctgctggaggtgatcaacctggaggacaacaagattgctgagctgcgggagattgagtacatcaagaacctgcccatcctgcgggtgctgaacctgctggagaaccccatccaggagaagtctgagtactggttcttcgtcatcttcatgctgctgcggctgacagagctggaccagaagaagatcaaggtggaggagaaggtgtctgctgtgaacaagtatgaccccccacctgaggtggtggccgcccaggaccacctgacccacgtggtgaacagcgtgatgcagccccagaggatctttgacagcaccctgcccagcctggatgccccctaccccatgctgatcctggccggccctgaggcctgtgggaagcgggagctggcccaccggctgtgccggcagttcagcacctacttccgctacggggcctgccacaccacccggcccccctactttggagagggggacagagtggactaccacttcatcagccaggatgtgtttgatgagatggtgaacatgggcaagttcatcctgaccttctcctatggcaaccacaagtatggcctgaacagagacacagtggagggcatcgccagagatggcctggccagctgcatccacatggagattgagggcgtgcgcagcctgaagtacagctactttgagccccgctacatcctggtggtgcccatgaacaaggagaagtatgagggctacctgcggaggaagggcctcttcagcagagctgagattgaatttgctgtgtcccgggtggacctgtacatcaagatcaaccagaacttccctggctactttgatgaagtcatcaatgctgatgacctggatgtggcctaccagaagctgagccagctgatccgggagtacctgggcctgacagaggagcccgccaagagcctggccaccacagcagatgtgaagaccagccacctgaagccagaggcccaccccaccaagtacatcagcagcaacatgggagacttcctgcacagcacagacaggaactacctgatcaagttctgggccaagctgagcgccaagaagaccccagctgagcgggacagcatccaccggcagcacgaggccgcccggcaggccctgatgggccgcatccggccagaccacaccctgctcttccagaggggccctgtgcctgcccccctgaccagcggcctgcactactacaccaccctggaggagctgtggaagagctttgacctgtgtgaggactacttcaagccacccttcggcccctacccagagaagagcggcaaggacagcctggtgtccatgaagtgcagcctcttccgcttctgcccctggagcaaggagctgcccttccagcccccagagggcagcatcagcagccacctgggcagcggggccagtgacagcgagacagaggagaccaggaaggccctgcccatccagagcttcagccatgagaaggagagccaccagcaccggcagcacagcgtgcctgtgatcagcaggcctggcagcaatgtgaagcccaccctgccccccatcccccagggcagaagatag

SEQ ID NO: 39746 - DNA, 3933 bp, Artificial Sequence
  Description of Artificial Sequence: Synthetic coding sequence
atggatgatgatgatgccaagctgaaggccgagattgaggccgagctggacaagctgagcatcagcagcctggagaaggaggacattgaaagtgatgccaagtctgagacccagagtgatgacagcgacacagacagcgtggagctgcctgagagcgtgctgcactgcatcaacatcatcaagaacagaagcaaggctgtggaggagctgatcctgcaggacctggaggacacagacatcctgagctgcagctatggagctgtgagcaacaaccacatgcacctgaggacaggcctgagcacagaatatgaggagagcagcgagcagctgatcaagatcctgtctgaaattgagaaggaggagttcatgaggagcaagacagactgtgccaccccagactttgtgcctgagcccagcccccatgacctgcccatggatgagcacgtgctgcctgatgatgctgacatcaactttggctactgtgaggtggaggagaagtgccggcagagctttgaggcctggcaggagaagcagaaggagctggaggacaaggagaagcagaccctgaaggcccagagggaccgggaggagaagcagttccaggaggaggaggagaagaggcactgctggatgaagcagttcaaggtggagaagaagaagctggagaacatccagaaggagtacatccggaacctgcacctgcagatggaggaggagaggacccgcttcaaggaccagcaggagaaggagaagaacagcctgctgaagcagcagaacaatgctgctgtgaagatccaggccaagtacaaggcctttgtggcctaccagaagtatggccccatcatcaaggagcagatcgagagcaagaagaggaaggcccaggagtggaaggagaaggaggccaagatccggcagaaggaggaggagaacaggaagaggctggaggaggagcagaggatcaaggaggagaggaagaagcagaaggaggaggagaggaagaggcgggagaaggagtatgaggagaagaagaacatcgtgaagcaggagcgggagcagctgatcagcaaggagaagatcatcctgagagaagatgccagccagcagctgatcatcagcagcgccctgaagaagagcggctacaacaacaagcacctgagcctggaggacatcagcaatgacaagggggacatcgccaagaacctggtggatgagaacagcaagaagcaggaggatgtgctgctgtggctggtggaggagagcaacatgaaggaaaatgtggaccggcagaccatcctgaaggagagcatccaggtgaagctgaaggagagcatcagcagccagaccatcctggccgacttcaagatggaggagaagaatgaaaacctggccaagaagcgctgcagcgaggagctggtgaagcaggagaggaaatatgaaaatacagacaacaagacagagctgggcaacagcgacctgaagggcaacctgaaggagcagttccccctgcaggagctgaagagtgatgcccagaaggaggagaagatcatgaagcacgtgatcaatgaaaatacaggccagaagacccagatcatcctgggccacaaccaggagatcagcgaggtgaagaccaatgaggagcagaagatcatcaaggacaaccagcagaagaagatccagaaggtggagaaggaggagatccaggagcagaatggcctgctgtacaaggacaaggacaccctggtgatctctgtgaagcagaggagcctgagcctgaccagcgagaacagcaaggatgtgagagaaaatgtcatcctgcaggagaaggagatctacagcaagagcaaggagattgaggagaaccccaaggacaatgcctggaacagcggcatcgtcatcttcaacaccacagacaccatgatcaacatcgagggcaagagaaatgaccaggactatgtgctgggcagacatgccccctgtgagggcctgagcaactacaatgctgagagctccatggtgtccaaggaggtgaacagcctgaagtctgagatccggaacatcagcgagaagtgccatgaaaatgcccctgagccagacagcatgacctgctgcgtgtctgagagcaccctgctgtacagcattgaggagcggcggctggcctggatcaagagcttcaagccctggctggagatcttcaagcagaaccagcagaagaagatcgtgcggaggaagaggcctgtgaagtgcccagccaacatgaccccagccctggacaagctggagatcctgcgctgtggcccctgggacaccctgcagcaggtgaccaccgtgaccttccaggacctgcccggctgtgtgctgagcaccctggctgaatgtaccaacctgcagttcctgagcctgcggcgctgtggcctgaccagcctgcacagcctgagcaactgcaagaagctgaagtacattgatgcccaggagaaccacatcgaggccattgaatgtgagaacctggagaacctgtgtgtggtgctgctgaacaagaaccagctgaccagcctgcacggcctggatggctgcaccaacatccagtgcctggagctgagctacaacaagatcaccagaattggctacagcttcttcctggaggagaagctggtggacaatgccggcttctgccaccacctgggcaccagcaccagctacctgagcctggcccaggtgtggatccccaccggcctgtgctggagctggatccccatcaccagcctgaccaagaacagcgactgcaacttcctgatcagccacctgtactggaactgtggcctggagagcctgaagaacctgcagcagctgatcctggaccacaaccagctgatcaacaccaagggcctgtgtgacacccccaccatcgtgtacctggactgcagccacaaccacctgacagatgtggagggcgtggagaactgtggcctgctgcagatcctgaagctgcagggcaactacctgtctgagctgcccagcctggagaacctggtgctgctgcgggagctgcacctggatgacaacagcatcagcacagtggaggccttcagcagctactggctgcccctgctgcagaacatcaccatcagccagaacagcctgaccaagatcgtgcccctcttccactttgtgtccctggagaagctggatgtgagccacaactgcctgagtgacctgaagagcgccatcaagtggtttgatgcctgctacagcctgcacgagctgagcctgaccggcaaccccctgctgcaggagaccaactggagggacagcctgctgaaggtgctgcctgccctgcgcatcctgaatggaaacatcctgaacagcaacagcgagagcaggacagaggagcacaaccagctgggcagcgctggcttcctggccctgtgccagagccagatccgggagttcaacctgctgattgagaactacatcactggaaaaggagatgtgttcaccctggacacagctgagaacctgtgccactacttcaagaagctgatgatcctgagcacagagtacagacatgcccacgagagaggagatgtgaccatcaccaagaaggatgaaagtgaggcccagaagaaccacctggcccccaccaacagcgacagcaccctgcagaatggagtcttctacagctgtgcccgggagggggagccagacagcccagacatccctgagaagtggatggattctgtgagcagccacagccccctgagcaagagcgccacctgtgagaacatggagggccgccaccaggagatcctggtgtgccagaagcgggaggacagcaaggccagcagcatccccaccatccgcatccccttcaaggaggtggtgatgaccaacagcctgctgaggaaccaccagaacatcgagcccagcgagaagtag

SEQ ID NO: 39747 - DNA, 495 bp, Artificial Sequence
  Description of Artificial Sequence: Synthetic coding sequence
atggatgatgatgatgccaagctgaaggccgagattgaggccgagctggacaagctgagcatcagcagcctggagaaggaggacattgaaagtgatgccaagtctgagacccagagtgatgacagcgacacagacagcgtggagctgcctgagagcgtgctgcactgcatcaacatcatcaagaacagaagcaaggctgtggaggagctgatcctgcaggacctggaggacacagacatcctgagctgcagctatggagctgtgagcaacaaccacatgcacctgaggacaggcctgagcacagaatatgaggagagcagcgagcagctgatcaagatcctgtctgaaattgagaaggaggagttcatgaggagcaagacagactgtgccaccccagactttgtgcctgagcccagcccccatgacctgcccatggatgagcacgtgctgcctgatgatgctgacatcaactttggctactgtgaggtggagtag

SEQ ID NO: 39748 - DNA, 5169 bp, Artificial Sequence
  Description of Artificial Sequence: Synthetic coding sequence
atggatgatgatgatgccaagctgaaggccgagattgaggccgagctggacaagctgagcatcagcagcctggagaaggaggacattgaaagtgatgccaagtctgagacccagagtgatgacagcgacacagacagcgtggagctgcctgagagcgtgctgcactgcatcaacatcatcaagaacagaagcaaggctgtggaggagctgatcctgcaggacctggaggacacagacatcctgagctgcagctatggagctgtgagcaacaaccacatgcacctgaggacaggcctgagcacagaatatgaggagagcagcgagcagctgatcaagatcctgtctgaaattgagaaggaggagttcatgaggagcaagacagactgtgccaccccagactttgtgcctgagcccagcccccatgacctgcccatggatgagcacgtgctgcctgatgatgctgacatcaactttggctactgtgaggtggaggagaagtgccggcagagctttgaggcctggcaggagaagcagaaggagctggaggacaaggagaagcagaccctgaaggcccagagggaccgggaggagaagcagttccaggaggaggaggagaagaggcactgctggatgaagcagttcaaggtggagaagaagaagctggagaacatccagaagcaggagcaggacaagatgaatgatgagctgtacaaggaggagaagatctggaaggagaagttcaagcagcacgaggagtacatccggaacctgcacctgcagatggaggaggagaggacccgcttcaaggaccagcaggagaaggagaagaacagcctgctgaagcagcagaacaatgctgctgtgaagatccaggccaagtacaaggcctttgtggcctaccagaagtatggccccatcatcaaggagcagatcgagagcaagaagaggaaggcccaggagtggaaggagaaggaggccaagatccggcagaaggaggaggagaacaggaagaggctggaggaggagcagaggatcaaggaggagaggaagaagcagaaggaggaggagaggaagagaagagagaaggagtatgaggagaagaagaacatcgtgaagcaggagcgggagcagctgatcagcaaggagaagatcatcctgcgggaggatgccagccagcagctgatcatcagcagcgccctgaagaagagcggctacaacaacaagcacctgagcctggaggacatcagcaatgacaagggggacatcgccaagaacctggtggatgagaacagcaagaagcaggaggatgtgctgctgtggctggtggaggagagcaacatgaaggaaaatgtggaccggcagaccatcctgaaggagagcatccaggtgaagctgaaggagagcatcagcagccagaccatcctggccgacttcaagatggaggagaagaatgaaaacctggccaagaagcgctgcagcgaggagctggtgaagcaggagaggaaatatgagaacacagacaacaagacagagctgggcaacagcgacctgaagggcaacctgaaggagcagttccccctgcaggagctgaagagtgatgcccagaaggaggagaagatcatgaagcacgtgatcaatgaaaatacaggccagaagacccagatcatcctgggccacaaccaggagatcagcgaggtgaagaccaatgaggagcagaagatcatcaaggacaaccagcagaagaagatccagaaggtggagaaggaggagatccaggagcagaatggcctgctgtacaaggacaaggacaccctggtgatctctgtgaagcagaggagcctgagcctgaccagcgagaacagcaaggatgtgcgggagaatgtcatcctgcaggagaaggagatctacagcaagagcaaggagattgaggagaaccccaaggacaatgcctggaacagcggcatcgtcatcttcaacaccacagacaccatgatcaacatcgagggcaagagaaatgaccaggactatgtgctgggcagacatgccccctgtgagggcctgagcaactacaatgctgagagctccatggtgtccaaggaggtgaacagcctgaagtctgagatccggaacatcagcgagaagtgccatgaaaatgcccctgagccagacagcatgacctgctgcgtgtctgagagcaccctgctgtacagcattgaggagcggcggctggcctggatcaagagcttcaagccctggctggagatcttcaagcagaaccagcagaagaagatcgtgcggaggaagaggcctgtgaagtgcccagccaacatgaccccagccctggacaagctggagatcctgcgctgtggcccctgggacaccctgcagcaggtgaccaccgtgaccttccaggacctgcccggctgtgtgctgagcaccctggccgagtgcaccaacctgcagttcctgagcctgcggcgctgtggcctgaccagcctgcacagcctgagcaactgcaagaagctgaagtacattgatgcccaggagaaccacatcgaggccattgaatgtgagaacctggagaacctgtgtgtggtgctgctgaacaagaaccagctgaccagcctgcacggcctggatggctgcaccaacatccagtgcctggagctgagctacaacaagatcacccgcatcggctacagcttcttcctggaggagaagctggtggacaatgccggcttctgccaccacctgggcaccagcaccagctacctgagcctggcccaggtgtggatccccaccggcctgtgctggagctggatccccatcaccagcctgaccaagaacagcgactgcaacttcctgatcagccacctgtactggaactgtggcctggagagcctgaagaacctgcagcagctgatcctggaccacaaccagctgatcaacaccaagggcctgtgtgacacccccaccatcgtgtacctggactgcagccacaaccacctgacagatgtggagggcgtggagaactgtggcctgctgcagatcctgaagctgcagggcaactacctgtctgagctgcccagcctggagaacctggtgctgctgcgggagctgcacctggatgacaacagcatcagcacagtggaggccttcagcagctactggctgcccctgctgcagaacatcaccatcagccagaacagcctgaccaagatcgtgcccctcttccactttgtgtccctggagaagctggatgtgagccacaactgcctgagtgacctgaagagcgccatcaagtggtttgatgcctgctacagcctgcacgagctgagcctgactggaaaccccctgctgcaggagaccaactggagggacagcctgctgaaggtgctgcctgccctgcgcatcctgaatggaaacatcctgaacagcaacagcgagagcaggacagaggagcacaaccagctgggcagcgctggcttcctggccctgtgccagagccagatccgggagttcaacctgctgattgagaactacatcactggaaaaggagatgtgttcaccctggacacagctgagaacctgtgccactacttcaagaagctgatgatcctgagcacagagtacagacatgcccacgagagaggagatgtgaccatcaccaagaaggatgagagcgaggcccagaagaaccacctggcccccaccaacagcgacagcaccctgcagaatggagtcttctacagctgtgcccgggagggggagccagacagcccagacatccctgagaagtggatggacagcgtgagcagccacagccccctgagcaagagcgccacctgtgagaacatggagggccgccaccaggagatcctggtgtgccagaagcgggaggacagcaaggccagcagcatccccaccatccgcatccccttcaaggaggtggtgatgaccaacagcctgctgaggaaccaccagaacatcgagcccagcgagaagatcatggctgctgtggtgatccagagctactggaggggctacctgatgaggcggcagacccacttcagcacccggctgcacacagctgccacagagggcctgcccaacagcagcatcaagaaccagaccatcctgaagaagggcaagcgggagaacatcgtgaacatcaggaagcagcgggagaaggccgccatcctgatccaggccgtgtggaagggcttcatcctgaggaagaagctgaccacagccctggaggccatcaagaatgaggagagtgatgaggagtaccgggagattgacctggaggacttcatctttgatgaggccgccctggaggaggagtggctggccctggacagcacccgcttccccagccagaccctgctgctgagcaaccagctgcactggcccaagatccctggcaacctgaagtgggatgacaccagcttcaacctgcccagcaacccagcccaggcctggctgtgcaatgacaaggagaacctgagcagcagcgagcacacccagttcaacagccgctctgagaacaagaccagctcctggaccccagagagcaagaccagcaggaagagcctgctgaagtctgagaaggagaagaagatcagcgaggagtggggcttcaaggacatcagcacagcccagcagatgctgaagagggcccagaagatgaagagcaagaagctgaagaagaagattgacagcacagtgcggctggccctcttcaagaacaatgaaaacaaggtgtccctgcccaagagccccaagatggtgcagcccaggagagatggctactttgagggcatcgaggaggaccccatccacaaggacaccacagccaatgagaagctggagaggaaccgggagtacacctaccagtggctgcacacccaggtgggcgtgcatgagaccaccagcagcaggaacatgaagtgcaaccacttcctgcctgagctggaccctgatgtgctgaatggaggccgggtgcagctggtggcccggctggtgtcccgggaggacacagacctggacctcttctccatgaccaacggcagcgccctgtctgtgaaccgggagaagaagaaccaggcccaccgccacagcgctggcagcagcagcaagctgtggttccccagcaagctgatctag

SEQ ID NO: 39749 - DNA, 1875 bp, Artificial Sequence
  Description of Artificial Sequence: Synthetic coding sequence
atgtttcatggaacagtgacagaggagctgaccagccatgaggagtggagccactacaatgaaaacatccgggagggccagaaggactttgtgtttgtgaagttcaacggcctgcacctgaagtccatggagaacctgcagagctgcatcagcctgcgggtgtgcatcttcagcaacaacttcatcacagacatccaccccctgcagagctgcatcaagctgatcaagctggacctgcacggcaaccagatcaagagcctgcccaacaccaagttctggaatggcctgaagaacctgaagctgctgtacctgcatgacaatggatttgccaagctgaagaacatctgtgtgctgagcgcctgccccaccctgattgccctgaccatgtttgactgccctgtgtccctgaagaagggctaccgccacgtgctggtgaacagcatctggcccctgaaggccctggaccaccacgtgatcagtgatgaggagatcatccagaactggcacctgcctgagcgcttcaaggcctgcaaccacaggctcttcttcaacttctgcccagccctgaggaagggcaccacctatgaggaggagatcaacaacatcaagcacatcaccagcaagatcaatgccatcctggcccacaacagccctgtgctgattgtgcagcgctggatccggggcttcctggtgaggaagaacctgagccctgtgttcttccacaagaagaagcagcaggagaagatcatccggggctatgaggccaagtggatctacatcaccaagggctatgaggacaagctgctgaaggacctcttcttcaagccagagaccaacatcaagggcaagctggcctactggaagcacaacatctactaccctgtggacctgaagaacagcagcgagcacaggaagcacgtgagcagcatcctgtgtgagctgaagcccaaggacctgggcatgaagagcaagaccagccgccacctgatccagaagggccaggagagtgaagatgagatcgtggatgagaagctggacaccagcttccgcatcagcgtcttcaagctgcccatctacaccagcggcagcctgaagaacaatgctgtgctgcgggagaagaagcagcacttcttccctgcctacccccagcccatctacaccacccaccccaagcccatcatcaagaaggacatccggctggagaggtccatgaaggagttctttgccccccagagagctggcatgaagctgcggaccttcagtgacatcgacaagtactacacagagcagaagaagcaggagtaccacaaggagaaggtgcgggtggtggccatggcccaggtggcccgggagcgggtgcgggtggccgtgaatgagcacctgaaccagaagaagtatgccacccagaagctgattgaggagaacaaggagaccatccagaacagcctgcggcaggtgtggcagaaccgcttcaactacctggagaaggcccgggagaggaaggccctcttcctgaaggagaagagccagaaggccagcgagcggctgctggtgcagaacctgaacaatgaaagaaccctgctgacccggggcctgctgaagattgaccggctggagaagaatgaagctgtgctgaaggagaagagcctgattgtgaagcagaagctgaaggccgagaagtacaggaagaacctgctgaaggagatgaagaaggtgcgcagccaggagatctacaagaggcactgtgaggagaagtttgtgatggacatgattgcctttgagaaggcctgtgagcggctgcaggatgccaagaccaaggtggccatcgtgaagaccaacctggacttcaaggtgcccaacggcctcatcaagtag

SEQ ID NO: 39750 - DNA, 900 bp, Artificial Sequence
  Description of Artificial Sequence: Synthetic coding sequence
atgtttcatggaacagtgacagaggagctgaccagccatgaggagtggagccactacaatgaaaacatccgggagggccagaaggactttgtgtttgtgaagttcaacggcctgcacctgaagtccatggagaacctgcagagctgcatcagcctgcgggtgtgcatcttcagcaacaacttcatcacagacatccaccccctgcagagctgcatcaagctgatcaagctggacctgcacggcaaccagatcaagagcctgcccaacaccaagttctggaatggcctgaagaacctgaagctgctgtacctgcatgacaatggatttgccaagctgaagaacatctgtgtgctgagcgcctgccccaccctgattgccctgaccatgtttgactgccctgtgtccctgaagaagggctaccgccacgtgctggtgaacagcatctggcccctgaaggccctggaccaccacgtgatcagtgatgaggagatcatccagaactggcacctgcctgagcgcttcaaggcctgcaaccacaggctcttcttcaacttctgcccagccctgaggaagggcaccacctatgaggaggagatcaacaacatcaagcacatcaccagcaagatcaatgccatcctggcccacaacagccctgtgctgattgtgcagcgctggatccggggcttcctggtgaggaagaacctgagccctgtgttcttccacaagaagaagcagcaggagaagatcatccggggctatgaggccaagtggatctacatcaccaagggctatgaggacaagctgctgaaggacctcttcttcaagccagagaccaacatcaagggcaagctggcctactggaagcatgacatcaagaagctgtacagcaaccaccactag

SEQ ID NO: 39751 - DNA, 1683 bp, Artificial Sequence
  Description of Artificial Sequence: Synthetic coding sequence
atgagcaaggacatcaagtctgtggagcacagccccaagatccaccagagaaatgacccccagcacgtgaatgacaggaccttcttcattgatgccagcaaccagagcctgacagccatccccctggagatcttcaccttcacagagctggaggaggtgcacctggagaacaaccagatcgaggagatcccccaggagatccagaggctgaagaacatccgggtgctgtacctggacaagaacaacctgcggagcctgtgcccagccctgggcctgctgagcagcctggagagcctggacctgagctacaaccccatcttcagcagcagcctggtggtggtgtccttcctgcacgccctgcgggagctgcggctgtaccagacagacctgaaggagatccctgtggtgatcttcaagaacctgcaccacctggagctgctgggcctgaccggcaaccacctgaagtgcctgcccaaggagatcgtgaaccagaccaagctgcgggagatctacctgaagaggaaccagtttgaggtgttcccccaggagctgtgtgtgctgtacaccctggagatcatcgacctggatgagaacaagatcggggccatccctgaggagatcggccacctgaccggcctgcagaagttctacatggccagcaacaacctgcctgtgctgcctgccagcctgtgccagtgcagccagctgtctgtgctggacctgagccacaacctgctgcacagcatccccaagagctttgctgagctgaggaagatgacagagatcggcctgagcggcaaccggctggagaaggtgcccaggctcatctgccgctggaccagcctgcacctgctgtacctgggcaacacaggcctgcaccggctgcggggcagcttccgctgcctggtgaacctgcgcttcctggacctgagccagaaccacctgcaccactgccccctgcagatctgtgccctgaagaacctggaggtgctgggcctggatgacaacaagattggccagctgcccagcgagctgggcagcctgagcaagctgaagatcctgggcctgactggaaatgagttcctgtccttccctgaggaggtgctgagcctggccagcctggagaagctgtacatcggccaggaccagggcttcaagctgacctacgtgcctgagcacatcaggaagctgcagagcctgaaggagctgtacatcgagaacaaccacctggagtacctgcctgtgtccctgggctccatgcccaacctggaggtgctggactgccgccacaacctgctgaagcagctgcctgatgccatctgccaggcccaggccctgaaggagctgcggctggaggacaacctgctgacccacctgcctgagaacctggacagcctggtgaacctgaaggtgctgaccctgatggacaaccccatggaggagccccccaaggaggtgtgtgccgagggcaatgaggccatctggaagtacctgaaggagaacagaaacagaaacatcatggccaccaagatccaggcctggtggaggggcaccatggtgcagaggggctttgggaagtttggagagctgctgaagccccagaagaagggcaagaccagccccaaggacaagaagggcaagaaggatgtgaagggcaagccaggcaagggcaagaagaagtag

SEQ ID NO: 39752 - DNA, 537 bp, Artificial Sequence
  Description of Artificial Sequence: Synthetic coding sequence
atggagcacaaggatgatgatgatgatgatgtgtcctttgccaagtggatgagcagcttctggggccacagctggagggaggaggaccagaggggcctgcgggagcggcaccggctgcaggccaccagccacaggaagaccagcctgccctgccccctgcctgtgctgccccgcatccccagcagtgactgccaccccaggaggcacagccatgaggaccaggagttccgctgccgcagccacgtgcgggactacaggaagtacagtgaagatggcagcttcaaggagcccctggagagcaagggccgcagccacagcaagattgagaagttcagcgagagctttgagcggcagctgtgcttccgcaccaagaggtctgccagcctgggccctgagagcaggaaggagagaaatgaaagagaatgtctgaggatggagatcaagagcaggaagaaggtggaggaggagaggagcagcaggaaggaggagcacggggaggcccacatggcccccctgtttgagaagggccctgagtag

SEQ ID NO: 39753 - DNA, 1446 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctatgacagatttgtgctgtacaaggagggggagcgggacttcctgcagaggcctggccagcagccccaggccggcctgagccaggccaacttcaccctgggccctgtgagccccagccacggcggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagccggggctactttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgtccttccccagcgagcccctggagctgatggtgtctggccacagcggcggcagcagcctgccccccaccggcccccccagcaccccagccagccacgccaaggactacacagtggagaacctgatccgcatgggcatggccggcctggtgctggtgttcctgggcatcctgctgtttgaggcccagcacagccagaggaacccccaggatgctgctggaagatag

SEQ ID NO: 39754 - DNA, 1395 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctatgacagatttgtgctgtacaaggagggggagcgggacttcctgcagaggcctggccagcagccccaggccggcctgagccaggccaacttcaccctgggccctgtgagccccagccacggcggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagccggggctactttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgtccttccccagcgagcccctggagctgatggtgtctgccagccacgccaaggactacacagtggagaacctgatccgcatgggcatggccggcctggtgctggtgttcctgggcatcctgctgtttgaggcccagcacagccagaggaacccccaggatgctgctggccgctag

SEQ ID NO: 39755 - DNA, 1899 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctacaacagatttgtgctgtacaaggagggggagcgggacttcctgcagaggcctggccagcagccccaggccggcctgagccaggccaacttcaccctgggccctgtgagccccagcaatggaggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccacagcggcggcagcagcctgccccccaccggcccccccagcaccccaggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagcagagcccccatgatgaggacccccaggccgtgacctacgcccctgtgaagcacagcagcccccggcgggagatggccagcccccccagcagcctgagcggggagttcctggacaccaaggaccggcaggtggaggaggaccggcagatggacacagaagctgctgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 39756 - DNA, 582 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccacagaagagtgtag

SEQ ID NO: 39757 - DNA, 1899 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctatgacagatttgtgctgtacaaggagggggagcgggacttcctgcagaggcctggccagcagccccaggccggcctgagccaggccaacttcaccctgggccctgtgagccccagccacggcggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagccggggctactttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgtccttccccagcgagcccctggagctgatggtgtctggccacagcggcggcagcagcctgccccccaccggcccccccagcaccccaggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagcagagcccccatgatgaggacccccaggccgtgacctacgcccctgtgaagcacagcagcccccggcgggagatggccagcccccccagcagcctgagcggggagttcctggacaccaaggaccggcaggtggaggaggaccggcagatggacacagaagctgctgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 39758 - DNA, 1368 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctatgacagatttgtgctgtacaaggagggggagcgggacttcctgcagaggcctggccagcagccccaggccggcctgagccaggccaacttcaccctgggccctgtgagccccagccacggcggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagccggggctactttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgtccttccccagcgagcccctggagctgatggtgtctggagagggcgctgaccctgtgctgtctgagctgaagggcagcgcccaggcccaggccccccggcgggccctgggctgggatggcccccgggaggccgtgcgggaggcctag

SEQ ID NO: 39759 - DNA, 1896 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgacaggcttctacaacaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagcggcggcttccaggccctcttccctgtgggccctgtgacccccagccaccgctggaggttcacctgctactactactacaccaacaccccccgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctatgacagatttgtgctgtacaaggagggggagcgggacttcctgcagaggcctggccagcagccccaggccggcctgagccaggccaacttcaccctgggccctgtgagccccagccacggcggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccacagcggcggcagcagcctgccccccaccggcccccccagcaccccaggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagagcccccatgatgaggacccccaggccgtgacctacgcccctgtgaagcacagcagcccccggcgggagatggccagcccccccagcagcctgtctggagagttcctggacaccaaggaccggcaggtggaggaggaccggcagatggacacagaggccgccgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 39760 - DNA, 1083 bp, Artificial Sequence
  Description of Artificial Sequence: Synthetic coding sequence
atgatccccctgctgctggccgccctgctgtgtgtgcctgctggggccctgacctgctacggggacagcggccagcctgtggactggtttgtggtgtacaagctgcctgccctgcggggcagcggggaggccgcccagaggggcctgcagtacaagtacctggatgagagcagcggcggctggagagatggccgggccctgatcaacagccctgagggcgctgtgggccgcagcctgcagcccctgtaccgcagcaacaccagccagctggccttcctgctgtacaatgaccagcccccccagcccagcaaggcccaggacagctccatgaggggccacaccaagggcgtgctgctgctggaccatgatggcggcttctggctggtgcacagcgtgcccaacttccccccaccagccagcagcgctgcctacagctggccccacagcgcctgcacctacggccagaccctgctgtgtgtgtccttcccctttgcccagttcagcaagatgggcaagcagctgacctacacctacccctgggtgtacaactaccagctggagggcatctttgcccaggagttcccagacctggagaatgtggtgaagggccaccacgtgtcccaggagccctggaacagcagcatcaccctgaccagccaggccggggctgtgttccagagctttgccaagttcagcaagtttggagatgacctgtacagcggctggctggccgccgccctgggcaccaacctgcaggtgcagttctggcacaagacagtgggcatcctgcccagcaactgcagcgacatctggcaggtgctgaatgtgaaccagatcgccttccctggccctgctggccccagcttcaacagcacagaggaccacagcaagtggtgtgtgagccccaagggcccctggacctgtgtgggggacatgaacagaaaccagggcgaggagcagaggggcggcggcaccctgtgtgcccagctgcctgccctgtggaaggccttccagcccctggtgaagaactaccagccctgcaatggcatggccaggaagcccagccgggcctacaagatctag

SEQ ID NO: 39761 - DNA, 2346 bp, Artificial Sequence
  Description of Artificial Sequence: Synthetic coding sequence
atggccgccaacgtgggggaccagaggagcacagactggagcagccagtacagcatggtggccggggccggccgggagaatggcatggagacccccatgcatgaaaatcctgagtgggagaaggcccggcaggccctggccagcatcagcaagagcggggctgctgggggcagcgccaagagcagcagcaatggacctgtggccagcgcccagtatgtgtcccaggccgaggccagcgccctgcagcagcagcagtactaccagtggtaccagcagtacaactatgcctacccctacagctactactaccccatgcctcctgtgcccggcatggatgagagcatgagctaccaggccccaccccagcagctgcccagcgcccagcccccccagcccagcaacccccctcatggagcccacaccctgaacagcggcccccagcccggcacagccccagccacccagcacagccaggccggccctgccaccggccaggcctacggcccccacacctacacagagcccgccaagcccaagaagggccagcagctgtggaacaggatgaagccagcccctggcaccggcggcctgaagttcaacatccagaagaggccctttgctgtgaccacccagagctttggcagcaatgctgagggccagcacagcggcttcggcccccagcccaaccctgagaaggtgcagaaccacagcggcagcagcgcccggggcaacctgagcggcaagccagatgactggccccaggacatgaaggagtatgtggagcgctgcttcaccgcctgtgagagcgaggaggacaaggacagaacagagaagctgctgaaggaggtgctgcaggcccggctgcaggacggcagcgcctacaccatcgactggagccgggagcccctgcccggcctgacccgggagcctgtggccgagagccccaagaagaagcgctgggaggccgccagcagcctgcacccccccaggggggccggcagcgccacccggggcggcggggcccccagccagaggggcacccctggggccggcggggccggccgggcccggggcaacagcttcaccaagtttggaaacagaaatgtgttcatgaaggacaacagcagcagcagcagcacagacagccgcagccgcagcagcagccgcagccccaccaggcacttccgccgcagtgacagccacagcgacagcgacagcagctacagcggaaatgaatgccaccctgtgggcagaagaaatcctccacccaagggccggggcggccgcggggcccacatggaccggggccggggccgggcccagaggggcaagagacatgacctggcccccaccaagaggagcaggaagaagatggccgccctggagtgtgaggaccctgagcgggagctgaagaagcagaagagagctgcccgcttccagcacggccacagccggcggctgcggctggagcccctggtgctgcagatgagcagcctggagagcagcggggctgaccctgactggcaggagctgcagatcgtgggcacctgcccagacatcaccaagcactacctgcggctgacctgtgccccagaccccagcacagtgcggcctgtggccgtgctgaagaagagcctgtgcatggtgaagtgccactggaaggagaagcaggactatgcctttgcctgtgagcagatgaagagcatccggcaggacctgactgtgcagggcatcagaacagagttcaccgtggaggtgtatgagacccacgccagaattgccctggagaagggggaccacgaggagttcaaccagtgccagacccagctgaagagcctgtatgcagagaacctgcctggaaatgtgggggagttcaccgcctaccgcatcctgtactacatcttcaccaagaacagcggggacatcaccacagagctggcctacctgacccgggagctgaaggctgacccctgtgtggcccacgccctggccctgaggacagcctgggccctgggcaactaccaccgcttcttccggctgtactgccacgccccctgcatgagcggctacctggtggacaagtttgctgaccgggagaggaaggtggccctgaaggccatgatcaagacctacgtggtgcccagcagcctgctgcccctgctcttccccagcttccggctggtgagcagctgcatcaagctgagcccctgccccctgctgcccctgccccctgtgttcctgctgatcttcttcagccccttcccccccagcctgagcgccttcttcccctggttcagcacaggcaagacagtgccccccagcctgccccccagcagcgccatgtag

SEQ ID NO: 39762 - DNA, 2403 bp, Artificial Sequence
  Description of Artificial Sequence: Synthetic coding sequence
atggccgccaacgtgggggaccagaggagcacagactggagcagccagtacagcatggtggccggggccggccgggagaatggcatggagacccccatgcatgaaaatcctgagtgggagaaggcccggcaggccctggccagcatcagcaagagcggggctgctgggggcagcgccaagagcagcagcaatggacctgtggccagcgcccagtatgtgtcccaggccgaggccagcgccctgcagcagcagcagtactaccagtggtaccagcagtacaactatgcctacccctacagctactactaccccatgtccatgtaccagagctatggcagccccagccagtatggcatggccggcagctatggcagcgccaccccccagcagcccagcgccccccagcaccagggcaccctgaaccagccccctgtgcccggcatggatgagagcatgagctaccaggccccaccccagcagctgcccagcgcccagcccccccagcccagcaaccccccccacggggcccacaccctgaacagcggcccccagcctggaacagccccagccacccagcacagccaggccggccctgccaccggccaggcctacggcccccacacctacacagagcccgccaagcccaagaagggccagcagctgtggaacaggatgaagccagcccctggcactggaggcctgaagttcaacatccagaagaggccctttgctgtgaccacccagagctttggcagcaatgctgagggccagcacagcggcttcggcccccagcccaaccctgagaaggtgcagaaccacagcggcagcagcgcccggggcaacctgagcggcaagccagatgactggccccaggacatgaaggagtatgtggagcgctgcttcaccgcctgtgagagcgaggaggacaaggacagaacagagaagctgctgaaggaggtgctgcaggcccggctgcaggacggcagcgcctacaccatcgactggagccgggagcccctgcccggcctgacccgggagcctgtggccgagagccccaagaagaagcgctgggaggccgccagcagcctgcaccccccaagaggagctggcagcgccacccggggcggcggggcccccagccagaggggcaccccaggagctggaggagctggccgggcccggggcaacagcttcaccaagtttggaaacagaaatgtgttcatgaaggacaacagcagcagcagcagcacagacagccgcagccgcagcagcagccgcagccccaccaggcacttcagaagaagtgacagccacagcgacagcgacagcagctacagcggaaatgaatgccaccctgtgggcagaagaaaccccccacccaagggccggggcggccgcggggcccacatggaccggggccggggccgggcccagaggggcaagagacatgacctggcccccaccaagaggagcaggaagaagatggccgccctggagtgtgaagatcctgagcgggagctgaagaagcagaagagagctgcccgcttccagcacggccacagccggcggctgcggctggagcccctggtgctgcagatgagcagcctggagagcagtggagctgaccctgactggcaggagctgcagatcgtgggcacctgcccagacatcaccaagcactacctgcggctgacctgtgccccagaccccagcacagtgcggcctgtggccgtgctgaagaagagcctgtgcatggtgaagtgccactggaaggagaagcaggactatgcctttgcctgtgagcagatgaagagcatccggcaggacctgactgtgcagggcatcagaacagagttcaccgtggaggtgtatgagacccacgcccgcatcgccctggagaagggggaccacgaggagttcaaccagtgccagacccagctgaagagcctgtatgcagagaacctgcctggaaatgtgggggagttcaccgcctaccgcatcctgtactacatcttcaccaagaacagcggggacatcaccacagagctggcctacctgacccgggagctgaaggctgacccctgtgtggcccacgccctggccctgaggacagcctgggccctgggcaactaccaccgcttcttccggctgtactgccacgccccctgcatgagcggctacctggtggacaagtttgctgaccgggagaggaaggtggccctgaaggccatgatcaagaccttccggcctgccctgcctgtgtcctacctgcaggccgagctggcctttgaaggagaggccgcctgccgggccttcctggagcccctgggcctggcctacacaggccctgacaacagcagcattgactgccgcctgagcctggcccagctgagcgccttctag

SEQ ID NO: 39763 - DNA, 165 bp, Artificial Sequence
  Description of Artificial Sequence: Synthetic coding sequence
atggccgccaacgtgggggaccagaggagcacagactggagcagccagtacagcatggtggccggggccggccgggagaatggcatggagacccccatgcatgaaaatccagacaggagcggcatcgactgccgcctgagcctggcccagctgagcgccttctag

SEQ ID NO: 39764 - DNA, 903 bp, Artificial Sequence
  Description of Artificial Sequence: Synthetic coding sequence
atggccgccaacgtgggggaccagaggagcacagactggagcagccagtacagcatggtggccggggccggccgggagaatggcatggagacccccatgcatgaaaatcctgagtgggagaaggcccggcaggccctggccagcatcagcaagagcggggctgctgggggcagcgccaagagcagcagcaatggacctgtggccagcgcccagtatgtgtcccaggccgaggccagcgccctgcagcagcagcagtactaccagtggtaccagcagtacaactatgcctacccctacagctactactaccccatgtccatgtaccagagctatggcagccccagccagtatggcatggccggcagctatggcagcgccaccccccagcagcccagcgccccccagcaccagggcaccctgaaccagccccctgtgcccggcatggatgagagcatgagctaccaggccccaccccagcagctgcccagcgcccagcccccccagcccagcaaccccccccacggggcccacaccctgaacagcggcccccagcctggaacagccccagccacccagcacagccaggccggccctgccaccggccaggcctacggcccccacacctacacagagcccgccaagcccaagaagggccagcagctgtggaacaggatgaagccagcccctggcactggaggcctgaagttcaacatccagaagaggccctttgctgtgaccacccagagctttggcagcaatgctgagggccagcacagcggcttcggcccccagcccaaccctgagaaggtgcagaaccacagcggcagcagcgcccggggcaacctgagcggcaagccagatgactggccccaggacatgaaggagtatgtggagcgctgctag

SEQ ID NO: 39765 - DNA, 276 bp, Artificial Sequence
  Description of Artificial Sequence: Synthetic coding sequence
atggccgccaacgtgggggaccagaggagcacagactggagcagccagtacagcatggtggccggggccggccgggagaatggcatggagacccccatgcatgaaaatcctgagtgggagaaggcccggcaggccctggccagcatcagcaagagcggggctgctgggggcagcgccaagagcagcagcaatggacctgtggccagcgcccagtatgtgtcccaggccgaggccagcgccctgcagcagcagcagtactaccagtggtaccagtag

SEQ ID NO: 39766 - DNA, 591 bp, Artificial Sequence
  Description of Artificial Sequence: Synthetic coding sequence
atggtgtgccgcctcatctgtgtgttccacagcaccaatgctgtgtctgtgttcagcctgagcctcttccgggcctgcacccctgtgcctgaccctgccccctggcccatcccctgccgcggggccagcggcaagaagacaggccggcctgcccgggcccggctgcggcggggccacccagccagccccccaacagcccgctgcctgacctgctttgccacagacagctgcagccagcccctgggcgcctctgtgtttggagtgggggagctgctgcgggactgtgcccggccccggccccccaccctgaagtgccagcaccaccagcaccagatcctgcggcggcacacagccctgcggacccggcggcccggccgcctggtgagcagctgcatcaagctgagcccctgccccctgctgcccctgccccctgtgttcctgctgatcttcttcagccccttcccccccagcctgagcgccttcttcccctggttcagcacaggcaagacagtgcccctgcccccctgcctgcacggcagccctgcccacgtgatgctgcccagcctcttctttgtgtgtgtgttcatctag

SEQ ID NO: 39767 - DNA, 1506 bp, Artificial Sequence
  Description of Artificial Sequence: Synthetic coding sequence
atgggcagcaggcctccctgtggggccaccagcagcgcccggcgggcctgccagtttcctgcccccatggctgctgcccgggagcctgagctgccccaggaggccccagccacagagcccgcccctcctccagcctgccgcttcttcctggagggccgctgccgctttggagcccgctgccggcagccccaccctggggccccagcccctcctggccgggaggcccagcctgaggccggggccaagaagccacccctgaggacagctgctgatgtgatccagaggatccgctgggacccccggctggaccctgctgacttctctgtgggctacgtggaccgcttcctgggcgtgcgggaggagcccttcagcgccttctgctgggaccagcccctggccgccctgggccctggggtgctggccgtgccccagcaccgggtgcgcttcttccgcttccacggccgcctggtgtgggaccgggccagcaggacagacctggtgtttggcagcggcagcgctgctggccggggccccaccatcctggatgcccccaacacagagggcgcccacggggctgagggcgctgagtggaccctggccggcaccggccaggaggcccaggccgcccccaagaggggcagcacccggcccctgtgcaccggccaccaggagcccggggtggaggagcccggggagctggaggccgcccaggagcgggccctgggcacagctgctgacctgggcaccctggccccccggggccgcctggccggcgtgacagaggaggccctgaagcccacagctgccaccaggaccaccctgctgggcggcaaggaggcccaggccctgggcgtgcctgggggcagcgctgagaccacagaagctgagtggggccctgctgcctggccagaggacaagagggcccggctgtctgtggccgccccctgccagccccggcccacccactttgtggccctgatggtgacagagcccggcctgcaggccgaggtgaccaaggcccaggagtacctggtgcacgtggccccccactgtgccaacttcctggtgcccagccagaacctgcacctgaccctggccctgctgcggctggccggggccggggaggaggccgccgccatcggggccctgcggcgggccctgctggcccctggcctgaatgccccaccccggctgtccttcaggaagctggtgctgctgggcccccacgtgctgtgtgccccacccagccccaccctggagagcatggcccaggtgctgagccagaggctggaggccgagggcctgagcaccctgcagagccctggccagctgcacccccacctgactgtggccaaggtgccccacggcagccaggtgcacctgcccaagctggagttcaccctgagccaggaggtgggctgccagcccctgcagaccctgtggctgtgcagaattggaagaactggaggccccttccagcccctggccgagatccggctggagtag

SEQ ID NO: 39768 - DNA, 3252 bp, Artificial Sequence
  Description of Artificial Sequence: Synthetic coding sequence
atggcctgcccagccctgggcctggaggccctgcagcccctgcagcctgagcccccacctgagcccgccttcagcgaggcccagaagtggattgagcaggtgacaggccgcagctttggagacaaggacttcagaacaggcctggagaatggcatcctgctgtgtgagctgctgaatgccatcaagccaggcctggtgaagaagatcaaccggctgcccacccccatcgccggcctggacaacatcatcctcttcctgcggggctgcaaggagctgggcctgaaggagagccagctgtttgaccccagcgacctgcaggacaccagcaacagagtgacagtgaagagcctggactacagcaggaagctgaagaatgtgctggtgaccatctactggctgggcaaggccgccaacagctgcaccagctacagcggcaccaccctgaacctgaaggagtttgagggcctgctggcccagatgaggaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgctatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgaccccccagttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagaagagcccccgggagcacttccaggccggccccttcagcccctgcagccccaccccacctggccagagccccaacagaagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39769 - DNA, 4401 bp, Artificial Sequence
  Description of Artificial Sequence: Synthetic coding sequence
aggaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttctccttccctgagaccatcgaggaggagggcagcgaggtgggcagcgctggggaggacaacccagctggccagatgaaccctggctggaagcccagtgatggcggctgtgagctgcctgatggcagcggcaaggagcaccccagcagtgatggagctgtggtggccccagcccccaagtctgaggagaaggatgctgctgagatccagaagaggaagaggctggagcaggccggcatcaaggtgatgcctgctgcccagagatttgccagccagaagcagctgtctgaggagaaggaggccatccgggacatcgtgctgaggaaggagaacagcttcctgacccaccagcacggcaatgacagcgaggccgagggggaggtggtgtgccgcctgcctgacctggagaaggatgactttgctgcccggcgggccaggatgaaccagaccaagcccatggtgcccctgaaccagctgctgtatggcccctaccccaagaagggagctgagaagagtgatggcagcaagcagctgagcaagggcatcagcaagaagaggagcctggagtacaagaggaaccagggccacacagaggaggtgaagctgattgtgacctgcaacatgagggcccaggagagcgagcctgtggagggcggcctgaggaaggtgcctgacctgcacaaggatgacctggcccagcagaggatccagggcagcctggccccccaccgggagccccccagcttcatcaccctgagcaacatcacagaggccgacctggagacctgggagcggctgaaggtgtctgagaaggccagagatggagatgtgcagcacatctgtgccagcgagcccagccctgagatcaaggccgagacagccatcagagatgactttgccaacaggaaggcccgggccagcaagaaggccagcagcccccggcagaagtttgtgcacttcggccctgtgacagagctggaccagcagaagtggaagaggctgagcatcggcaaggccggccccagagaagatgaggaggaggtgatctgccacggcagcaagatccagatggattctgtgtcccctgtgtctgctgccaccagcagcctgaagggccaccagatcttcaaccggcagaatgactgcaggaccatgaactgtggccgcggggactactgccggcgggcctcctggctggcccctgtgcctgagagccaggaggagtgggtgtgcagcctgggagaatgtccccggggcacagaggaggtgaccagcaagcagctgccccaggacggcaaggaggagacagagagcgccccccgggacagcgagcggctgagcaaggccgagaggtctgaggacagcagccagcccctggtgtgccccctggcctctgaatgtgaggccagcggcacagaggagaagctggagaagatgacagccccagcctggagcggcagcggcctgaagggccagaggaagctggatgacagcaggaaggatgacatgatggcccggaggacaggcatgagcctgcggcacacaggcagcaaccccaaccagttcctgcctgtgccctttgccaagcagcaggatgtggaggagagcagcaagggcctgcccatgaaggaccagagatatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcattgaagatactgtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagaaggagccctggcccacagcggcaaccctgtgtccaagggcgtgcatgaggaccaccagctggacacagaggccggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagaagagcccccgggagcacttccaggccggccccttcagcccctgcagccccaccccacctggccagagccccaacagaagcatcagcggcaagaagctgtgcagcagctgtggcctgcccctgggcaaaggagctgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39770 - DNA, 2673 bp, Artificial Sequence
  Description of Artificial Sequence: Synthetic coding sequence
atggattctgagcggcaggtgaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgcagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcattgaagatactgtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagaaggagccctggcccacagcggcaaccctgtgtccaagggcgtgcatgaggaccaccagctggacacagaggccggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaaaggagctgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39771 - DNA, 2709 bp, Artificial Sequence
  Description of Artificial Sequence: Synthetic coding sequence
atggattctgagcggcaggtgaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgctatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcattgaagatactgtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagaaggagccctggcccacagcggcaaccctgtgtccaagggcgtgcatgaggaccaccagctggacacagaggccggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaaaggagctgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39772 - DNA, 4404 bp, Artificial Sequence
  Description of Artificial Sequence: Synthetic coding sequence
atgaggaaggacacagatgacatcgagagccccaagaggagcatccgggacagcggctacatcgactgctgggacagcgagaggagtgacagcctgagcccccccaggcatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccacggggagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttctccttccctgagaccatcgaggaggagggcagcgaggtgggcagcgctggggaggacaacccagctggccagatgaaccctggctggaagcccagtgatggcggctgtgagctgcctgatggcagcggcaaggagcaccccagcagtgatggagctgtggtggccccagcccccaagtctgaggagaaggatgctgctgagatccagaagaggaagaggctggagcaggccggcatcaaggtgatgcctgctgcccagagatttgccagccagaagcagctgtctgaggagaaggaggccatccgggacatcgtgctgaggaaagaaaattccttcctgacccaccagcacggcaatgattctgaggccgagggggaggtggtgtgccgcctgcctgacctggagaaggatgactttgctgcccggcgggccaggatgaaccagaccaagcccatggtgcccctgaaccagctgctgtatggcccctaccccaagaagggagctgagaagagtgatggcagcaagcagctgagcaagggcatcagcaagaagaggagcctggagtacaagaggaaccagggccacacagaggaggtgaagctgattgtgacctgcaacatgagggcccaggagagcgagcctgtggagggcggcctgaggaaggtgcctgacctgcacaaggatgacctggcccagcagaggatccagggcagcctggccccccaccgggagcccccatccttcatcaccctgagcaacatcacagaagctgacctggagacctgggagcggctgaaggtgtctgagaaggccagagatggagatgtgcagcacatctgtgccagcgagcccagccctgagatcaaggccgagacagccatcagagatgactttgccaacaggaaggcccgggccagcaagaaggccagcagcccccggcagaagtttgtgcactttggacctgtgacagagctggaccagcagaagtggaagaggctgagcatcggcaaggccggcccccgggaggatgaggaggaggtgatctgccacggcagcaagatccagatggacagcgtgtcccctgtgtctgctgccaccagcagcctgaagggccaccagatcttcaaccggcagaatgactgcaggaccatgaactgtggccgcggggactactgcagaagagcctcctggctggcccctgtgcctgagagccaggaggagtgggtgtgcagcctgggggagtgcccccggggcacagaggaggtgaccagcaagcagctgccccaggacggcaaggaggagacagaaagtgccccccgggacagcgagcggctgagcaaggccgagaggtctgaggacagcagccagcccctggtgtgccccctggcctctgaatgtgaggccagcggcacagaggagaagctggagaagatgacagccccagcctggagcggcagcggcctgaagggccagaggaagctggatgacagcaggaaggatgacatgatggccaggagaacaggcatgagcctgcggcacacaggcagcaaccccaaccagttcctgcctgtgccctttgccaagcagcaggatgtggaggagagcagcaagggcctgcccatgaaggaccagagatatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggggaggatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagaaacagtgcaccgggaggaggagaaggagagagaatgtcccaccgtggccccagcccacagcctgaccaagagccagatgtttgaaggagtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaagggcaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagaagagcccccgggagcacttccaggccggccccttcagcccctgcagccccaccccacctggccagagccccaacagaagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39773 - DNA, 2694 bp, Artificial Sequence
  Description of Artificial Sequence: Synthetic coding sequence
atgaggaaggacacagatgacatcgagagccccaagaggagcatccgggacagcggctacatcgactgctgggacagcgagaggagtgacagcctgagcccccccaggcatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccacggggagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgctatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggggaggatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagaaacagtgcaccgggaggaggagaaggagagagaatgtcccaccgtggccccagcccacagcctgaccaagagccagatgtttgaaggagtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaagggcaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39774 - DNA, 3210 bp, Artificial Sequence
  Description of Artificial Sequence: Synthetic coding sequence
atggcctgcccagccctgggcctggaggccctgcagcccctgcagcctgagcccccacctgagcccgccttcagcgaggcccagaagtggattgagcaggtgacaggccgcagctttggagacaaggacttcagaacaggcctggagaatggcatcctgctgtgtgagctgctgaatgccatcaagccaggcctggtgaagaagatcaaccggctgcccacccccatcgccggcctggacaacatcatcctcttcctgcggggctgcaaggagctgggcctgaaggagagccagctgtttgaccccagcgacctgcaggacaccagcaacagagtgacagtgaagagcctggactacagcaggaagctgaagaatgtgctggtgaccatctactggctgggcaaggccgccaacagctgcaccagctacagcggcaccaccctgaacctgaaggagtttgagggcctgctggcccagatgaggaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgcagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggagagccctggaacagcctctgtgcccctgcgggtgcagaacagctggaggaggagccagttcttcagccagagcgtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39775 - DNA, 3174 bp, Artificial Sequence
  Description of Artificial Sequence: Synthetic coding sequence
atggcctgcccagccctgggcctggaggccctgcagcccctgcagcctgagcccccacctgagcccgccttcagcgaggcccagaagtggattgagcaggtgacaggccgcagctttggagacaaggacttcagaacaggcctggagaatggcatcctgctgtgtgagctgctgaatgccatcaagccaggcctggtgaagaagatcaaccggctgcccacccccatcgccggcctggacaacatcatcctcttcctgcggggctgcaaggagctgggcctgaaggagagccagctgtttgaccccagcgacctgcaggacaccagcaacagagtgacagtgaagagcctggactacagcaggaagctgaagaatgtgctggtgaccatctactggctgggcaaggccgccaacagctgcaccagctacagcggcaccaccctgaacctgaaggagtttgagggcctgctggcccagatgaggaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgctatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgaccccccagttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39776 - DNA, 1230 bp, Artificial Sequence
  Description of Artificial Sequence: Synthetic coding sequence
atgaacctggaccgctgcaacagcattgctgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcatcgaggacacagtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagagggcgccctggcccacagcggcaaccctgtgtccaaaggagtgcatgaggaccaccagctggacacagaagctggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaagggggccgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39777 - DNA, 3171 bp, Artificial Sequence
  Description of Artificial Sequence: Synthetic coding sequence
atggcctgcccagccctgggcctggaggccctgcagcccctgcagcctgagcccccacctgagcccgccttcagcgaggcccagaagtggattgagcaggtgacaggccgcagctttggagacaaggacttcagaacaggcctggagaatggcatcctgctgtgtgagctgctgaatgccatcaagccaggcctggtgaagaagatcaaccggctgcccacccccatcgccggcctggacaacatcatcctcttcctgcggggctgcaaggagctgggcctgaaggagagccagctgtttgaccccagcgacctgcaggacaccagcaacagagtgacagtgaagagcctggactacagcaggaagctgaagaatgtgctggtgaccatctactggctgggcaaggccgccaacagctgcaccagctacagcggcaccaccctgaacctgaaggagtttgagggcctgctggcccagatgaggaaggacacagatgacatcgagagccccaagaggagcatccgggacagcggctacatcgactgctgggacagcgagaggagtgacagcctgagccccccaagacatggaagagatgacagctttgacagcctggacagctttggcagccgcagccggcagacccccagcccagatgtggtgctgcggggcagcagtgatggccggggcagtgacagcgagagtgacctgccccacaggaagctgcctgatgtgaagaaggatgacatgtctgcccggaggaccagccatggagagcccaagtctgctgtgcccttcaaccagtacctgcccaacaagagcaaccagacagcctacgtgcctgcccccctgaggaagaagaaggccgagcgggaggagtacaggaagtcctggagcacagccaccagccccctgggcggggagcggcccttccgctatggccccaggacccctgtgtctgatgatgctgagagcacctccatgtttgacatgagatgtgaggaggaggccgctgtgcagccccacagccgggcccggcaggagcagctgcagctgatcaacaaccagctgcgggaggaggatgacaagtggcaggatgacctggcccgctggaagagcagaagaagatctgtgtcccaggacctgatcaagaaggaggaggagaggaagaagatggagaagctgctggccggagaagatggcaccagcgagaggaggaagagcatcaagacctaccgggagatcgtgcaggagaaggagcggcgggagcgggagctgcacgaggcctacaagaatgcccggagccaggaggaggccgagggcatcctgcagcagtacatcgagcgcttcaccatcagcgaggccgtgctggagcggctggagatgcccaagatcctggagaggagccacagcacagagcccaacctgagcagcttcctgaatgaccccaaccccatgaagtacctgcggcagcagagcctgcccccacccaagttcaccgccaccgtggagaccaccatcgcccgggcctctgtgctggacacctccatgtctgctggcagcggcagccccagcaagacagtgacccccaaggctgtgcccatgctgacccccaagccctacagccagcccaagaacagccaggatgtgctgaagaccttcaaggtggatggcaaggtgtctgtgaatggagagaccgtgcaccgggaggaggagaaggagcgggagtgccccaccgtggccccagcccacagcctgaccaagagccagatgtttgagggcgtggcccgggtgcacggcagccccctggagctgaagcaggacaatggcagcattgagatcaacatcaagaagcccaacagcgtgccccaggagctggccgccaccacagagaagacagagcccaacagccaggaggacaagaatgatggcggcaagagcaggaaaggaaacatcgagctggccagcagcgagccccagcacttcaccaccaccgtgacccgctgcagccccaccgtggcctttgtggagttccccagcagcccccagctgaagaatgatgtgtctgaggagaaggaccagaagaagccagaaaatgagatgtctgggaaggtggagctggtgctgagccagaaggtggtgaagcccaagagccctgagcctgaggccaccctgaccttccccttcctggacaagatgcctgaggccaaccagctgcacctgcccaacctgaacagccaggtggacagccccagcagcgagaagagccctgtgatgacccccttcaagttctgggcctgggaccctgaggaggagcggcggcggcaggagaagtggcagcaggagcaggagcggctgctgcaggagcgctaccagaaggagcaggacaagctgaaggaggagtgggagaaggcccagaaggaggtggaggaggaggagcggcgctactatgaggaggagaggaagatcattgaagatactgtggtgcccttcaccgtgagcagcagcagcgctgaccagctgagcaccagcagctccatgacagagggcagcggcaccatgaacaagattgacctgggcaactgccaggatgagaagcaggaccggcgctggaagaagagcttccagggagatgacagcgacctgctgctgaagacccgggagagtgaccggctggaggagaagggcagcctgacagaaggagccctggcccacagcggcaaccctgtgtccaagggcgtgcatgaggaccaccagctggacacagaggccggggccccccactgcggcaccaacccccagctggcccaggaccccagccagaaccagcagaccagcaaccccacccacagcagtgaagatgtgaagcccaagaccctgcccctggacaagagcatcaaccaccagatcgagagccccagcgagaggaggaagagcatcagcggcaagaagctgtgcagcagctgtggcctgcccctgggcaaaggagctgccatgatcatcgagaccctgaacctgtacttccacatccagtgcttccgctgtggcatctgcaagggccagctgggagatgctgtgtctggaacagatgtgcgcatcagaaatggcctgctgaactgcaatgactgctacatgaggagccgctctgctggccagcccaccaccctgtag

SEQ ID NO: 39778 - DNA, 384 bp, Artificial Sequence
  Description of Artificial Sequence: Synthetic coding sequence
atgttccaggccgccggggccgcccaggccacccccagccatgatgccaagggcggcggcagcagcacagtgcagaggagcaagagcttcagcctgcgggcccaggtgaaggagacctgtgccgcctgccagaagacagtgtaccccatggagcggctggtggccgacaagctgatcttccacaacagctgcttctgctgcaagcactgccacaccaagctgagcctgggcagctatgctgccctgcatggagagttctactgcaagccccacttccagcagctgttcaagagcaaaggaaattatgatgagggcttcggcaggaagcagcacaaggagctgtgggcccacaaggaggtggaccccggcaccaagacagcctag

SEQ ID NO: 39779 - DNA, 1944 bp, Artificial Sequence
  Description of Artificial Sequence: Synthetic coding sequence
atgaggctgaccctgctgtgctgcacctggagggaggagaggatgggagaggagggcagcgagctgcctgtgtgtgccagctgtggccagaggatctatgatggccagtacctgcaggccctgaatgctgactggcatgctgactgcttccgctgctgtgactgcagcgccagcctgagccaccagtactatgagaaggatggccagctgttctgcaagaaggactactgggcccgctacggggagagctgccacggctgcagcgagcagatcaccaagggcctggtgatggtggccggggagctgaagtaccaccctgagtgcttcatctgcctgacctgtggcaccttcatcggagatggagacacctacaccctggtggagcacagcaagctgtactgcggccactgctactaccagacagtggtgacccctgtgattgagcagatcctgcctgacagccctggcagccacctgccccacacagtgaccctggtgtccatcccagccagcagccacggcaagaggggcctgtctgtgtccattgaccccccccacggccccccaggctgcggcacagagcacagccacacagtgcgggtgcagggcgtggaccccggctgcatgagcccagatgtgaagaacagcatccacgtgggggaccgcatcctggagatcaatggcacccccatcagaaatgtgcccctggatgaaattgacctgctgatccaggagaccagccggctgctgcagctgaccctggagcatgacccccatgacaccctgggccacggcctgggccctgagaccagccccctgagcagccctgcctacaccccatctggagaggccggcagcagcgcccggcagaagcctgtgctgcggagctgcagcattgacaggagccctggagctggcagcctgggcagccctgccagccagaggaaggacctgggccgctctgagagcctgcgggtggtgtgccggccccaccgcatcttccggcccagcgacctgattcatggagaggtgctgggcaagggctgcttcggccaggccatcaaggtgacccaccgggagactggagaggtgatggtgatgaaggagctgatccgctttgatgaggagacccagaggaccttcctgaaggaggtgaaggtgatgcgctgcctggagcaccccaacgtgctgaagttcatcggcgtgctgtacaaggacaagaggctgaacttcatcacagagtacatcaagggcggcaccctgcggggcatcatcaagtccatggacagccagtacccctggagccagagggtgtcctttgccaaggacatcgccagcggcatggcctacctgcacagcatgaacatcatccaccgggacctgaacagccacaactgcctggtgcgggagaacaagaatgtggtggtggccgactttggcctggcccggctgatggtggatgagaagacccagcctgagggcctgcggagcctgaagaagccagacaggaagaagcgctacacagtggtgggcaacccctactggatggcccctgagatgatcaatggccgctcctatgatgagaaggtggatgtgttctcctttggaattgtgctgtgtgagatcatcggccgggtgaatgctgaccctgactacctgcccaggaccatggactttggcctgaatgtgcggggcttcctggaccgctactgcccccccaactgcccccccagcttcttccccatcaccgtgcgctgctgtgacctggaccctgagaagaggcccagctttgtgaagctggagcactggctggagaccctgaggatgcacctggccggccacctgcccctgggcccccagctggagcagctggaccggggcttctgggagacctacagaagaggagagagcggcctgcctgcccaccctgaggtgcctgactag

SEQ ID NO: 39780 - DNA, 741 bp, Artificial Sequence
  Description of Artificial Sequence: Synthetic coding sequence
atgtttcctgtgaaggtgaaggtggagaagtctgagctggagatggtgaaggccaggaaccagctggatgctgtgctgcagtgcctgctggagaagagccacatggaccgggagcggctggatgaggaggccggcaagacccccagcgacacccacaacaaggactgcagcattgctgccaccgggaagaggcccagcgcccgcttcccccaccagaggaggaagaagagaagagagatggatgatggcctggccgagggcggcccccagaggagcaacacctacgtgatcaagctgtttgacagatctgtggacctggcccagttcagcgagaacacccccctgtaccccatctgccgggcctggatgaggaacagccccagcgtgcgggagagagaatgtagccccagcagccccctgccccccctgcctgaagatgaggagggcagcgaggtgaccaacagcaagagcagagatgtgtacaagctgcccccacccaccccacctggccccccaggagatgcctgccgcagccgcatccccagccccctgcagcctgagatgcagggcaccccagatgatgagcccagcgagcctgagcccagccccagcaccctcatctacagaaacatgcagcgctggaagaggatccggcagcgctggaaggaggccagccacaggaaccagctgcgctacagcgagagcatgaagatcctgcgggagatgtatgagcggcagtag

SEQ ID NO: 39781 - DNA, 351 bp, Artificial Sequence
  Description of Artificial Sequence: Synthetic coding sequence
atgggctggaagatggccagccccacagatggaacagacctggaggccagcctgctgagctttgagaagctggaccgggccagcccagacctgtggccagagcagctgcccggggtggccgagtttgctgccagcttcaagagccccatcaccagcagcccccccaagtggatggccgagattgaaagagatgacatcgacatgctgaaggagctgggcagcctgaccacagccaacctgatggagaaggtgcggggcctgcagaacctggcctaccagctgggcctggatgagagccgggagatgacccggggcaagttcctgaacatcctggagaagcccaagaagtag

SEQ ID NO: 39782 - DNA, 447 bp, Artificial Sequence
  Description of Artificial Sequence: Synthetic coding sequence
atgaggctgggctgtgagctgggcatcggcttcctgtttggaggagtggcctacggcaccagcttcagcagaagaaggctggccaccagccgggacatgggctggaagatggccagccccacagatggaacagacctggaggccagcctgctgagctttgagaagctggaccgggccagcccagacctgtggccagagcagctgcccggggtggccgagtttgctgccagcttcaagagccccatcaccagcagcccccccaagtggatggccgagattgaaagagatgacatcgacatgctgaaggagctgggcagcctgaccacagccaacctgatggagaaggtgcggggcctgcagaacctggcctaccagctgggcctggatgagagccgggagatgacccggggcaagttcctgaacatcctggagaagcccaagaagtag

SEQ ID NO: 39783 - DNA, 2598 bp, Artificial Sequence
  Description of Artificial Sequence: Synthetic coding sequence
atgtctgatgtgtccacctctgtgcagagcaagtttgcccggctggccaagaagaaggagaacatcacctacatgaagcgggagcagctgacagaaacagacaaggacatcgcccctgtgctggacctgaagtgcaaggatgtgtctgccatcatgaacaagttcaaggtgctgatggagatccaggacctgatgtttgaggagatgagggagaccctgaagaatgacctgaaggctgtgctgggcggcaaggccaccatccctgaggtgaagaacagcgagaacagcagcagcaggacagagttccagcagatcatcaacctggccctgcagaagacaggcatggtgggcaagattgaaggagagaacagcaagattggagatgacaatgaaaacctgaccttcaagctggaggtgaatgagctgagcggcaagctggacaacaccaatgagtacaacagcaatgatggcaagaagctgccccagggcgagagccgctcctatgaggtgatgggctccatggaggagaccctgtgcaacattgatgacagagatggcaacagaaatgtgcacctggagttcacagagcgggagagcaggaaggatggagaagatgaatttgtgaaggagatgagggaggagaggaagttccagaagctgaagaacaaggaggaggtgctgaaggccagccgggaggagaaggtgctgatggatgagggcgctgtgctgaccctggtggccgacctgagcagcgccaccctggacatcagcaagcagtggagcaatgtgttcaacatcctgagagaaaatgactttgagcccaagttcctgtgtgaggtgaagctggccttcaagtgtgatggagagatcaagaccttcagtgacctgcagagcctgaggaagtttgccagccagaagagctctgtgaaggagctgctgaaggatgtgctgccccagaaggaggagatcaaccagggcggcaggaaatatggcatccaggagaagagggacaagaccctgattgacagcaagcacagagctggggagatcaccagtgatggcctgtccttcctgttcctgaaggaggtgaaggtggccaagccagaggagatgaagaacctggagacccaggaggaggagttcagcgagctggaggagctggatgaggaggccagcggcatggaggatgatgaggacaccagcggcctggaggaggaggaggaggagcccagcggcctggaggaggaggaggaggaggaggccagcggcctggaggaggatgaggccagcggcctggaggaggaggaggagcagaccagcgagcaggacagcaccttccagggccacaccctggtggatgccaagcatgaggtggagatcaccagtgatggcatggagaccaccttcatcgacagcgtggaggacagcgagagcgaggaggaggaggagggcaagagcagcgagaccgggaaggtgaagaccaccagcctgacagagaagaaggccagccggcggcagaaggagatccccttctcctacctggtgggggacagcggcaagaagaagctggtgaagcaccaggtggtgcacaagacccaggaggaggaggagacagctgtgcccaccagccagggcaccggcaccccctgcctgaccctgtgcctggccagccccagcaagagcctggagatgagccatgatgagcacaagaagcacagccacaccaacctgagcatcagcactggagtgaccaagctgaagaagacagaggagaagaagcacaggaccctgcacacagaggagctgaccagcaaggaggccgacctgacagaggagacagaggagaacctgcggagcagcgtcatcaacagcatccgggagatcaaggaggagatcggcaacctgaagagcagccacagcggcgtgctggagattgagaacagcgtggatgacctgagcagcaggatggacatcctggaggagagaattgacagcctggaggaccagatcgaggagttcagcaaggacaccatgcagatgaccaagcagatcatcagcaaggagcggcagagggacatcgaggagaggagccgcagctgcaacatccggctgattggcatccctgagaaggagagctatgagaacagagctgaggacatcatcaaggagatcattgatgaaaattttgctgagctgaagaagggcagcagcctggagatcgtgtctgcctgccgggtgcccagcaagattgatgagaagaggctgacccccaggcacatcctggtgaagttctggaacagcagtgacaaggagaagatcatccgggccagccgggagcggcgggagatcacctaccagggcacccgcatccggctgacagctgacctgagcctggacaccctggatgcccggagcaagtggagcaatgtgttcaaggtgctgctggagaagggcttcaacccccgcatcctgtacccagccaagatggcctttgacttccggggcaagaccaaggtgttcctgagcattgaggagttccgggactatgtgctgcacatgcccaccctgcgggagctgctgggcaacaacatcccctag

SEQ ID NO: 39784 - DNA, 2274 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtggacagcaagctgatctgcatgttccagaacagcgacaagctgctgagccacatggccgcccagtgcctggccctgctgctgtacttccagctgcgggagaagatcaccctgagcaacagctggatcgccttctgccagaagaacctgtctgagtacagcgagagcaacaaggccatctactgcctgtggaccctgacagccatcatcaaggagatcttcaaggacagctgcagccagaagacagagatcctgaagcagttcctgacccactttgacaccatctttgaggtgttctacaacagcctcttcagccagcactttgagaactgccgggacaccagcaagatcgtgaacatcctgatgtgcttcctggacctgctggagctgctgattgccagccgcatccacctgaagctgcacttcacctgccagaggatcctcttcctgaagcccagctgcatgctggaggtgatcacctggcccatccaggcctttgtgaagaggaaggtgatcatcttcctgaagaagtgcctgctgtgcaaggtgggggaggacctgtgccggggctctgtgcctgccctgatgcccccagaccaccacgtggccgtggacatgctggccctggccaatgctgtgctgcaggccgtgaacagcggcctgctgaagaccctgtctgtgtatgagaagcacagcttctttggaggagatgaggtgcagccagaatgtgagctgatcaccagcccagaccacgtgatcctgcgggccgccagcctggtgatcatgaagagcctggagatcaagttccagaactacagcagcgccagcgaggtgaaggtggacctgcagcgcttcatgtctgagctgctgaccttcctgaagccccacctgcagcccagcctgcagctgcacaacccctgcaagtggctgagcagggtcttcatcgagcaggatgatgacatgctggaggccgccaaggccagcctgggcatctacctgaccctgacccggggctgtgaggccacagagagcctgacccagggcaaggagatgtgggaccaccacacccatgaaaatggctacaacccccactgcatcttcctgttcttcctgaagaacatcggctttgacagcacagtgctgctggacttcctgatcagcagcgagacctgcttcctggagtactttgtgcgctacctgaagctgctgcagaaggactgggacaacttcttcaccatctgcaacaactttgatgccacagagagcaaatatgacatcagcatctgtggctgtgtgcccagcctggtgcaggaccagagcagcaaccagaccatcccccaccggctgacagccccccacagccacagagatgtgtgtgcccggcacagctgggccagtgatgcccccagcgagcccctgaaggctgtgatgagcaaaggagcccacaccatgtgtgccagcagcctgagcagcccccgggccagccagagcctggtggactatgacagcagtgatgacagtgatgtggagagcacagagcagtgcctggccaacagcaagcagaccagcctgcaccagcaggccaccaaggagatccaggatgctgctggcaccagccgggacaagaaggagttcagcctggagccccccagccggcccctggtgctgaaggagtttgacacagccttctcctttgactgtgaggtggccccaaatgatgtggtgtctgaggtgggcatcttctaccgcatcgtgaagtgcttccaggagctgcaggatgccatctgccgcctgcagaagaagaacctcttcccctacaaccccacagccctgctgaagctgctgaagtacatcgaggtgatcagcaacaagaccatgaacaccctgtag

SEQ ID NO: 39785 - DNA, 576 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtggacagcaagctgatctgcatgttccagaacagcgacaagctgctgagccacatggccgcccagtgcctggccctgctgctgtacttccagctgcgggagaagatcaccctgagcaacagctggatcgccttctgccagaagaacctgtctgagtacagcgagagcaacaaggccatctactgcctgtag

SEQ ID NO: 39786 - DNA, 597 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtggacagcaagctgatctgcatgttccagaacagcgacaagctgctgagccacatggccgcccagtgcctggccctgctgctgtacttccagctgcgggagaagatcaccctgagcaacagctggatcgccttctgccagaagaacctgtctgagtacagcgagagcaacaaggccatctactgcctgtggaccctgacagccatcatctag

SEQ ID NO: 39787 - DNA, 390 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtgtag

SEQ ID NO: 39788 - DNA, 435 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtggacagcaagctgatctgcatgttccagaacagcgacaagctgctgtag

SEQ ID NO: 39789 - DNA, 1311 bp, Artificial Sequence
  Description of Artificial Sequence: Synthetic coding sequence
atgaaggtgttctgtgaggtgctggaggagctgtacaagaaggtgctgctgggcgccaccctggagaatgacagccatgactacatcttctacctgaacccagctgtgtctgaccaggactgcagcacagccaccagcctggagtgggccaacacctgtggcatccagggccgccaccagcccatctctgtgggcgtggcccccatcgctgtggcccctgtgtgcctgaagaccaacagccagatgagcggcagccgggaggtgatgctgctgcagctgaccgtcatcaaggtgatgaccacccgcatcctgtctgtgaagacagagttccacgccaaggagcagtacagagatgtgatcaagatcctgctggagagcgccaaggtggacagcaagctgatctgcatgttccagaacagcgacaagctgctgagccacatggccgcccagtgcctggccctgctgctgtacttccagctgcgggagaagatcaccctgagcaacagctggatcgccttctgccagaagaacctgtctgagtacagcgagagcaacaaggccatctactgcctgtggaccctgacagccatcatcaaggagatcttcaaggacagctgcagccagaagacagagatcctgaagcagttcctgacccactttgacaccatctttgaggtgttctacaacagcctcttcagccagcactttgagaactgccgggacaccagcaagatcgtgaacatcctgatgtgcttcctggacctgctggagctgctgattgccagccgcatccacctgaagctgcacttcacctgccagaggatcctcttcctgaagcccagctgcatgctggaggtgatcacctggcccatccaggcctttgtgaagaggaaggtgatcatcttcctgaagaagtgcctgctgtgcaaggtgggggaggacctgtgccggggctctgtgcctgccctgatgcccccagaccaccacgtggccgtggacatgctggccctggccaatgctgtgctgcaggccgtgaacagcggcctgctgaagaccctgtctgtgtatgagaagcacagcttctttggaggagatgaggtgcagccagaatgtgagctgatcaccagcccagaccacgtgatcctgcgggccgccagcctggtgatcatgaagagcctggagatcaagttccagaactacagcagcgccagcgaggtgaagggcaacagccccaacagcttctgcatgcagtgtgtgatcatctacctgagcaccgtcatccacaactaccagatcagcggcctggtgtag

SEQ ID NO: 39790 - DNA, 732 bp, Artificial Sequence
  Description of Artificial Sequence: Synthetic coding sequence
atgagcagcggcacagagctgctgtggccaggggccgccctgctggtgctgctgggcgtggccgccagcctgtgtgtgcgctgcagcaggcctggggccaagaggtctgagaagatctaccagcagaggagcctgcgggaggaccagcagagcttcaccggcagcaggacctacagcctggtgggccaggcctggccaggccccctggccgacatggcccccaccaggaaggacaagctgctgcagttctaccccagcctggaggaccctgccagcagccgctaccagaacttcagcaagggcagccgccacggcagcgaggaggcctacatcgaccccatcgccatggagtactacaactggggccgcttcagcaagcccccagaagatgatgatgccaacagctatgaaaatgtgctgatctgcaagcagaagaccacagaaacaggagcccagcaggagggcatcggcggcctgtgccgcggggacctgagcctgagcctggccctgaagacaggccccaccagcggcctgtgccccagcgccagccctgaggaggatgaggagagcgaggactaccagaacagcgccagcatccaccagtggagggagagcaggaaggtgatgggccagctgcagcgggaggccagccctggccctgtgggcagcccagatgaagaagatggagagccagactatgtgaatggagaggtggccgccacagaggcctag

SEQ ID NO: 39791 - DNA, 732 bp, Artificial Sequence; identical to SEQ ID NO: 39790
  Description of Artificial Sequence: Synthetic coding sequence

SEQ ID NO: 39792 - DNA, 732 bp, Artificial Sequence; identical to SEQ ID NO: 39790
  Description of Artificial Sequence: Synthetic coding sequence

SEQ ID NO: 39793 - DNA, 495 bp, Artificial Sequence
  Description of Artificial Sequence: Synthetic coding sequence
atggtgggcgtggtgtctgatgaccaggacttcctggacagcaaggacaccatgaagatggctgtggtgctggtgacccccctgggcaatggagacctggccctgaagtttggctaccccacccctcatggaggctgccagaagatggacaccaccttcacagagggcgctgtgcccggccagttcagcaacccagccatggccctgagtgacatccgggtggccttcagtgactaccagcactttgccctgctgtacctggagatgaggaaaggaggcctgaggaaccagtggctgcagctgtatggaggccgggctgctggaagaagacccaggcacccccgcttcggcagcggcatgagccccctgtgcctgcaccagcccttcctgcacgccgagggcggcacagctggctcctggtgcctgtggccccgggtgcctgccccaccctgccccagcctgcccctgtttgcccccccagcccccagcctgtag

SEQ ID NO: 39794 - DNA, 696 bp, Artificial Sequence
  Description of Artificial Sequence: Synthetic coding sequence
atgaggcagcctgctgtgcggctggtgcggctgggccgggtgccctatgcagagctgctgggcctgcaggaccgctggctgcggcggctgcaggccgagcccggcatcgaggcccccagcggcacagaggccggggccctgctgctgtgtgagcctgctggccctgtgtacacagctggcctgcggggcggcctgaccccagaggagacagcccggctgcgggccctgggcgctgaggtgcgggtgacaggccggggcggcctggccaccttccacggccctggccagctgctgtgccaccctgtgctggacctgcggcggctgggcctgcggctgaggatgcacgtggccagcctggaggcctgtgctgtgcggctgtgtgagctgcagggcctgcaggatgcccgggcccggcccccaccctacacaggagtgtggctggatgacaggaagatctgtgccatcggcgtgcgctgtggccgccacatcaccagccacggcctggccctgaactgcagcacagacctgacctggtttgagcacatcgtgccctgtggcctggtgggcaccggggtgaccagcctgagcaaggagctgcagagacatgtgacagtggaggaggtgatgccacccttcctggtggccttcaaggagatctacaagtgcaccctcatcagcgaggacagccccaactag

SEQ ID NO: 39795 - DNA, 849 bp, Artificial Sequence
  Description of Artificial Sequence: Synthetic coding sequence
atggacaggaccctggagagcctgcggcacatcatcgcccaggtgctgccccaccgggaccctgccctggtgttcaaggacctgaatgtggtgtccatgctgcaggagttctgggagagcaagcagcagcagaaggccgccttccccagcgagggcgtggtggtgtatgagagcctgcctgcccctggccccccatttgtgtcctatgtgaccctgcccggcggcagctgcttcggcaacttccagtgctgcctgagcagagctgaggccaggagagatgctgccaaggtggccctgatcaacagcctcttcaatgagctgcccagccgccgcatcaccaaggagttcatcatggagagcgtgcaggaggccgtggccagcaccagcggcaccctggatgatgctgatgaccccagcacctctgtgggcgcctaccactacatgctggagagcaacatgggcaagaccatgctggagttccaggagctgatgaccatcttccagctgctgcactggaatggcagcctgaaggccctgcgggagaccaagtgcagccggcaggaggtgatctcctactacagccagtacagcctggatgagaagatgaggagccacatggccctggactggatcatgaaggagcgggacagccctggcatcgtgtcccaggagctgaggatggccctgcggcagctggaggaggccaggaaggccggccaggagctgcgcttctacaaggagaagaaggagatcctgagcctggccctgacccagatctgcagcgaccctgacaccagcagccccagtgatgaccagctgagcctgacagccctgtgtggctaccactag

SEQ ID NO: 39796 - DNA, 1014 bp, Artificial Sequence
  Description of Artificial Sequence: Synthetic coding sequence
atggagaccatgagggcccagaggctgcagcccggggtgggcaccagcggccggggcaccctgcgggccctgcggcctggggtgactggagctgctgctgccacagccaccccacctgctggccccccaccagcccctcctcctccagcccctcctcctccacccctgctgctgagcggggcccctggcctgcccctgcccccaggagctgctggcagccctgctgtgctgcgggaggccgtggaggccgtggtgcgcagctttgccaagcacacccagggctacggccgggtgaatgtggtggaggccctgcaggagttctggcagatgaagcagagcagaggagctgacctgaagaatggagccctggtggtgtatgagatggtgcccagcaacagccccccctacgtgtgctacgtgaccctgcccggcggcagctgcttcggcagcttccagttctgccccaccaaggccgaggccaggagatctgctgccaagatcgccctgatgaacagcgtcttcaatgagcaccccagccgccgcatcacagatgagttcatcgagaagtctgtgtctgaggccctggccagcttcaatggaaaccgggaggaggccgacaaccccaacacaggcatcggggccttccgcttcatgctggagagcaacaagggcaagtccatgctggagttccaggagctgatgacagtgttccagctgctgcactggaatggcagcctgaaggccatgagggagcggcagtgcagccggcaggaggtgctggcccactacagccaccgggccctggatgatgacatccgccaccagatggccctggactgggtgtcccgggagcagagcgtgcctggggccctgagccgggagctggccagcacagagcgggagctggatgaggcccggctggccggcaaggagctgcgcttccacaaggagaagaaggacatcctggtgctggccgccggccagctgggcaacatgcacagcagcaactgctag

SEQ ID NO: 39797 - DNA, 855 bp, Artificial Sequence
  Description of Artificial Sequence: Synthetic coding sequence
atggagaccatgagggcccagaggctgcagcccggggtgggcaccagcggccggggcaccctgcgggccctgcggcctggggtgactggagctgctgctgccacagccacccacacccagggctacggccgggtgaatgtggtggaggccctgcaggagttctggcagatgaagcagagcagaggagctgacctgaagaatggagccctggtggtgtatgagatggtgcccagcaacagccccccctacgtgtgctacgtgaccctgcccggcggcagctgcttcggcagcttccagttctgccccaccaaggccgaggcccggcgctctgctgccaagatcgccctgatgaacagcgtcttcaatgagcaccccagccgccgcatcacagatgagttcatcgagaagtctgtgtctgaggccctggccagcttcaacggcaaccgggaggaggccgacaaccccaacacaggaattggagccttccgcttcatgctggagagcaacaagggcaagtccatgctggagttccaggagctgatgaccgtcttccagctgctgcactggaatggcagcctgaaggccatgagggagcggcagtgcagccggcaggaggtgctggcccactacagccaccgggccctggatgatgacatccgccaccagatggccctggactgggtgtcccgggagcagagcgtgcctggggccctgagccgggagctggccagcacagagcgggagctggatgaggcccggctggccggcaaggagctgcgcttccacaaggagaagaaggacatcctggtgctggccgccggccagctgggcaacatgcacagcagcaactgctag

SEQ ID NO: 39798 - DNA, 390 bp, Artificial Sequence
  Description of Artificial Sequence: Synthetic coding sequence
atggccaagagcctgcggagcaagtggaagaggaagatgagagctgagaagaggaagaagaatgcccccaaggaggccagccggctgaagagcatcctgaagctggatggagatgtgctgatgaaggatgtgcaggagatcgccaccgtggtggtgcccaagcccaagcactgccaggagaagatgcagtgtgaggtgaaggatgagaaggatgacatgaagatggagacagacatcaagaggaacaagaagaccctgctggaccagcacggccagtaccccatctggatgaaccagaggcagaggaagaggctgaaggccaagcgggagaagaggaagggcaagagcaaggccaaggctgtgaaggtggccaagggcctggcctggtag

SEQ ID NO: 39799 - DNA, 390 bp, Artificial Sequence; identical to SEQ ID NO: 39798
  Description of Artificial Sequence: Synthetic coding sequence

SEQ ID NO: 39800 - DNA, 414 bp, Artificial Sequence
  Description of Artificial Sequence: Synthetic coding sequence
atgagccagttccagggcaagggcccccgctggacagtgctgatcatgagcaaggtgggcctgcggggcggcctgagtgaccagatggccatgaaggtgctggaccccctgcggcaggccctggacagctccatgcagagcaacaacctgtgccagcacccccagcccctggccctgcacgtgtctgctgctgtggccagcgctggggcccaggccagcagcctgctgggccccctgccccacctgagcagctttgccttccagcctgcccacagcctgctgagcctgctgggcagccacggggctgaggtgtccaagaagatggccctgctggcccgggagaggagccctgcccacctggtggccttccctggccgcctgacagccaccccacctggcctgcccaccttctag

SEQ ID NO: 39801 - DNA, 198 bp, Artificial Sequence
  Description of Artificial Sequence: Synthetic coding sequence
atgaagaaggacagccagggcgccttcagcggcttctgccacggcggagatgccctgcacgagggccgggtgagaagacccctgtggctgaaggacatgtacaagcccctgagcgccaccagggtgaacaaccacgcctggaagctgcacaagaagagcagcaatgaagatgagatcctgaacagagaccccggctag

SEQ ID NO: 39802 - DNA, 1818 bp, Artificial Sequence
  Description of Artificial Sequence: Synthetic coding sequence
atgagctctgtgagccccatccagatccccagccggctgcccctgctgctgacccatgaaggagtgctgctgcccggcagcaccatgaggacctctgtggacagcgccaggaacctgcagctggtgcgcagccggctgctgaagggcaccagcctgcagagcaccatcctgggcgtcatccccaacaccccagaccctgccagtgatgcccaggacctgccccccctgcacagaattggaacagctgccctggccgtgcaggtggtgggcagcaactggcccaagccccactacaccctgctgatcaccggcctgtgccgcttccagatcgtgcaggtgctgaaggagaagccctaccccatcgccgaggtggagcagctggaccggctggaggagttccccaacacctgcaagatgagggaggagctgggggagctgtctgagcagttctacaagtatgctgtgcagatcctggatgctgtgtccctggaggagcgcttcaagatgaccatccccctgctggtgcggcagatcgagggcctgaagctgctgcagaagaccaggaagcccaagcaggatgatgacaagagggtgattgccatccggcccatccgccgcatcacccacatcagcggcaccctggaggatgaagatgaagatgaagataatgatgacatcgtgatgctggagaagaagatccgcaccagctccatgcctgagcaggcccacaaggtgtgtgtgaaggagatcaagaggctgaagaagatgccccagagcatgccagaatatgccctgaccaggaactacctggagctgatggtggagctgccctggaacaagagcaccacagaccggctggacatccgggccgcccgcatcctgctggacaatgaccactacgccatggagaagctgaagaagagggtgctggagtacctggccgtgcggcagctgaagaacaacctgaagggccccatcctgtgctttgtgggccccccaggagtgggcaagacctctgtgggccgctctgtggccaagaccctgggccgggagttccacagaattgccctgggcggcgtgtgtgaccagagcgacatccggggccacaggaggacctacgtgggctccatgcctggccgcatcatcaatggcctgaagacagtgggcgtgaacaaccctgtgttcctgctggatgaggtggacaagctgggcaagagcctgcagggcgaccctgctgctgccctgctggaggtgctggaccctgagcagaaccacaacttcacagaccactacctgaatgtggcctttgacctgagccaggtgctcttcatcgccacagccaacaccacagccaccatcccagctgccctgctggacaggatggagatcatccaggtgcccggctacacccaggaggagaagattgaaattgcccaccgccacctgatccccaagcagctggagcagcacggcctgaccccccagcagatccagatcccccaggtgaccaccctggacatcatcacccgctacacccgggaggccggcgtgcgcagcctggacaggaagctgggcgccatctgcagagctgtggccgtgaaggtggccgagggccagcacaaggaggccaagctggacagaagtgatgtgacagagcgggagggctgccgggagcacatcctggaggatgagaagccagagagcatcagtgacaccacagacctggccctgcccccagagatgcccatcctgattgacttccacgccctgaaggacatcctgggcccccccatgtatgagatggagatcgccagctag

SEQ ID NO: 39803 - DNA, 2427 bp, Artificial Sequence
  Description of Artificial Sequence: Synthetic coding sequence
atgagctctgtgagccccatccagatccccagccggctgcccctgctgctgacccatgaaggagtgctgctgcccggcagcaccatgaggacctctgtggacagcgccaggaacctgcagctggtgcgcagccggctgctgaagggcaccagcctgcagagcaccatcctgggcgtcatccccaacaccccagaccctgccagtgatgcccaggacctgccccccctgcacagaattggaacagctgccctggccgtgcaggtggtgggcagcaactggcccaagccccactacaccctgctgatcaccggcctgtgccgcttccagatcgtgcaggtgctgaaggagaagccctaccccatcgccgaggtggagcagctggaccggctggaggagttccccaacacctgcaagatgagggaggagctgggggagctgtctgagcagttctacaagtatgctgtgcagatcctggatgctgtgtccctggaggagcgcttcaagatgaccatccccctgctggtgcggcagatcgagggcctgaagctgctgcagaagaccaggaagcccaagcaggatgatgacaagagggtgattgccatccggcccatccgccgcatcacccacatcagcggcaccctggaggatgaagatgaagatgaagataatgatgacatcgtgatgctggagaagaagatccgcaccagctccatgcctgagcaggcccacaaggtgtgtgtgaaggagatcaagaggctgaagaagatgccccagagcatgccagaatatgccctgaccaggaactacctggagctgatggtggagctgccctggaacaagagcaccacagaccggctggacatccgggccgcccgcatcctgctggacaatgaccactacgccatggagaagctgaagaagagggtgctggagtacctggccgtgcggcagctgaagaacaacctgaagggccccatcctgtgctttgtgggccccccaggagtgggcaagacctctgtgggccgctctgtggccaagaccctgggccgggagttccacagaattgccctgggcggcgtgtgtgaccagagcgacatccggggccacaggaggacctacgtgggctccatgcctggccgcatcatcaatggcctgaagacagtgggcgtgaacaaccctgtgttcctgctggatgaggtggacaagctgggcaagagcctgcagggcgaccctgctgctgccctgctggaggtgctggaccctgagcagaaccacaacttcacagaccactacctgaatgtggcctttgacctgagccaggtgctcttcatcgccacagccaacaccacagccaccatcccagctgccctgctggacaggatggagatcatccaggtgcccggctacacccaggaggagaagattgaaattgcccaccgccacctgatccccaagcagctggagcagcacggcctgaccccccagcagatccagatcccccaggtgaccaccctggacatcatcacccgctacacccgggaggccggcgtgcgcagcctggacaggaagctgggcgccatctgcagagctgtggccgtgaaggtggccgagggccagcacaaggaggccaagctggacagaagtgatgtgacagagcgggagggctgccgggagcacatcctggaggatgagaagccagagagcatcagtgacaccacagacctggccctgcccccagagatgcccatcctgattgacttccacgccctgaaggacatcctgggcccccccatgtatgagatggaggtgtcccagaggctgagccagcccggggtggccatcggcctggcctggacccccctgggcggggagatcatgtttgtggaggccagcaggatggatggagagggccagctgaccctgaccggccagctgggagatgtgatgaaggagagcgcccacctggccatctcctggctgcggagcaatgccaagaagtaccagctgaccaatgccttcggcagctttgacctgctggacaacacagacatccacctgcacttccctgctggagctgtgaccaaggatggccccagcgctggggtgaccatcgtgacctgcctggccagcctcttcagcggccgcctggtgcggagtgatgtggccatgaccggggagatcaccctgcggggcctggtgctgcctgtgggcggcatcaaggacaaggtgctggccgcccacagagctggcctgaagcaggtgatcatccccaggagaaatgagaaggacctggagggcatccctggaaatgtgcggcaggacctgagctttgtgacagccagctgcctggatgaggtgctgaatgctgcctttgatggcggcttcaccgtgaagaccaggcctggcctgctgaacagcaagctgtag

SEQ ID NO: 39804 - DNA, 1746 bp, Artificial Sequence
  Description of Artificial Sequence: Synthetic coding sequence
atgctggagaagaagatccgcaccagctccatgcctgagcaggcccacaaggtgtgtgtgaaggagatcaagaggctgaagaagatgccccagagcatgccagaatatgccctgaccaggaactacctggagctgatggtggagctgccctggaacaagagcaccacagaccggctggacatccgggccgcccgcatcctgctggacaatgaccactacgccatggagaagctgaagaagagggtgctggagtacctggccgtgcggcagctgaagaacaacctgaagggccccatcctgtgctttgtgggccccccaggagtgggcaagacctctgtgggccgctctgtggccaagaccctgggccgggagttccaccgcatcgccctgggcggcgtgtgtgaccagagcgacatccggggccacaggaggacctacgtgggctccatgcctggccgcatcatcaatggcctgaagacagtgggcgtgaacaaccctgtgttcctgctggatgaggtggacaagctgggcaagagcctgcagggcgaccctgctgctgccctgctggaggtgctggaccctgagcagaaccacaacttcacagaccactacctgaatgtggcctttgacctgagccaggtgctcttcatcgccacagccaacaccacagccaccatcccagctgccctgctggacaggatggagatcatccaggtgcccggctacacccaggaggagaagattgagatcgcccaccgccacctgatccccaagcagctggagcagcacggcctgaccccccagcagatccagatcccccaggtgaccaccctggacatcatcacccgctacacccgggaggccggcgtgcgcagcctggacaggaagctgggcgccatctgcagagctgtggccgtgaaggtggccgagggccagcacaaggaggccaagctggacagaagtgatgtgacagagcgggagggctgccgggagcacatcctggaggatgagaagccagagagcatcagtgacaccacagacctggccctgcccccagagatgcccatcctgattgacttccacgccctgaaggacatcctgggcccccccatgtatgagatggaggtgtcccagaggctgagccagcccggggtggccatcggcctggcctggacccccctgggcggggagatcatgtttgtggaggccagcaggatggatggagagggccagctgaccctgaccggccagctgggagatgtgatgaaggagagcgcccacctggccatctcctggctgcggagcaatgccaagaagtaccagctgaccaatgccttcggcagctttgacctgctggacaacacagacatccacctgcacttccctgctggagctgtgaccaaggatggccccagcgctggggtgaccatcgtgacctgcctggccagcctcttcagcggccgcctggtgcggagtgatgtggccatgactggagagatcaccctgcggggcctggtgctgcctgtgggcggcatcaaggacaaggtgctggccgcccaccgggccggcctgaagcaggtgatcatccccaggagaaatgagaaggacctggagggcatccctggaaatgtgcggcaggacctgagctttgtgacagccagctgcctggatgaggtgctgaatgctgcctttgatggcggcttcaccgtgaagacccggcccggcctgctgaacagcaagctgtag

SEQ ID NO: 39805 - DNA, 2322 bp, Artificial Sequence
  Description of Artificial Sequence: Synthetic coding sequence
atgagcagccctgctgtggcccggaccagccctgggggcagccgggagatggccccagccccccagggccggggccgcttctgggaggtgggcggcggcagcggccaccggctggagagagctgctgctgagagcgagcgctgggagctgctgctgcggcggggggagctgctggccctgggcggccacctgaagggggccctggaggcctttgctgctgccctgcggcggggggccccagcccggcctgagtgcctgggcgccctggtggactgcctggtgttcaactaccgcctgcggcacggcctgggctggagcgctgcccctgtggccggggctgatggaggagctgggggcctgctgcgctgcctgggctgccggggcttcctgtctgagcctgtgacagtgccctgtggccacagctactgccgccgctgcctgcggcgggagctgcgggcccgctgccgcctgtgccgggaccggctgcccccagccacagccagcgccacagatgctgagggcacagccccccggcccccacccctggccgccgccatcgccgccagtgacttccgcacctctgtggtgctgaaccacctggccgagaagtggttccctggccagcgggagcgggcccgggctgctggccgcctgggggagctgctgcaccagggccgctaccgggaggccctggccgccgcctgtgaggccctgcgggcagagcccagcgacctgattgtgaagatctacagagctgagagctatgccggcctgcaggagttcaaggccgccatcgaggacctgaatgctgtgctcttccagctgcctgactggccagaggtgtacttcaggaagggcaaggtgctgtgtgatgctggcttcctgggagatgccctgcagctgttcctgcagtgcctggccctggatgaggactttgccccagccaagctgcaggtgcagaagatcctgtgtgacctgctgctgcctgagaacctgaaggagggcctgaaggagagctcctggagcagcctgccctgcaccaagaaccggccctttgacttccacagcgtgatggaggagagccagagcctgaatgagcccagccccaagcagagcgaggagatccctgaggtgaccagcgagcctgtgaagggcagcctgaacagagcccagagcgcccagagcatcaacagcacagagatgcctgcccgggaggactgcctgaagagggtgtcctctgagcctgtgctgtctgtgcaggagaagggcgtgctgctgaagaggaagctgagcctgctggagcaggacgtcatcgtgaatgaagatggcaggaacaagctgaagaagcagggcgagaccccaaatgaggtgtgcatgttcagcctggcctacggggacatccctgaggagctgattgatgtgtctgactttgagtgcagcctgtgcatgaggctcttctttgagcctgtgaccaccccctgtggccacagcttctgcaagaactgcctggagcgctgcctggaccacgccccctactgccccctgtgcaaggagagcctgaaggagtacctggccgaccggcgctactgtgtgacccagctgctggaggagctgattgtgaagtacctgcctgatgagctgtctgagaggaagaagatctatgatgaggagacagctgagctgagccacctgaccaagaatgtgcccatctttgtgtgcaccatggcctaccccaccgtgccctgccccctgcacgtgtttgagccccgctaccgcctgatgatccgccgcagcatccagacaggcaccaagcagtttggcatgtgtgtgtctgacacccagaacagctttgctgactatggctgcatgctgcagatcagaaatgtgcacttcctgcctgatggccgctctgtggtggacacagtgggcggcaagcgcttccgggtgctgaagaggggcatgaaggatggctactgcacagctgacatcgagtacctggaggatgtgaaggtggagaatgaagatgagatcaagaacctgcgggagctgcatgacctggtgtacagccaggcctgctcctggttccagaacctgcgggaccgcttccgcagccagatcctgcagcacttcggctccatgcctgagcgggaggagaacctgcaggccgccccaaatggacctgcctggtgctggtggctgctggccgtgctgcctgtggacccccgctaccagctgtctgtgctgtccatgaagagcctgaaggagcggctgaccaagatccagcacatcctgacctacttcagccgggaccagagcaagtag

SEQ ID NO: 39806 - DNA, 2265 bp, Artificial Sequence
  Description of Artificial Sequence: Synthetic coding sequence
atgagccctgagcctgtgcccccacctcctccaccccagtgccccggctgtgacagagctgagcccatcgcccagaggctggaggagggagatgaggccttccgggccggggactatgagatggctgctgagctgttccgctccatgctggccggcctggcccagcctgaccggggcctgtgcctgcggctgggagatgccctggcccgggccggccgcctgcctgaggccctgggcgccttccggggggccgcccggctgggcgccctgcggcctgaggagctggaggagctggccggcggcctggtgcgggctgtgggcctgcgggaccggcccctgtctgctgagaaccctggaggagagcctgaggcccctggagagggcggccctgcccctgagccccgggccccccgggacctgctgggctgcccccgctgccggcggctgctgcacaagcctgtgaccctgccctgtggcctgactgtgtgcaagagatgtgtggagcccggccctgcccggccccaggtgagaagagtgaatgtggtgctgagcggcctgctggagaagtgcttccctgctgagtgccgcctgcggcggctggccggccaggcccggagcctgcagaggcagcagcagcctgaggccgccctgctgcgctgtgaccaggccctggagctggccccagatgacaacagcctgctgctgctgcgggcagagctgtacctgaccatgaagaactatgagcaggccctgcaggatgccagcgctgcctgccagaatgagcccctgctgatcaagggccaccaggtgaaggcccaggccctgagcggcctgggccgcagcaaggaggtgctgaaggagttcctgtactgcctggccctgaaccctgagtgcaacagcgtgaagaaggaggcccagaaggtgatgtgtgaggtgctcttcagcgccacagccaacgtgcatgagaacctgaccagcagcatccagagccggctgaaggcccagggccacagccacatgaatgcccaggccctgctggaggagggagatgctggcagcagcgagaacagcagcgagaagagtgacatgctgggcaacaccaacagctctgtgctgtacttcatcctgggcctgcactttgaggaggacaagaaggccctggagagcatcctgcccacagcccccagcgctggcctgaagaggcagttcccagatgatgtggaggatgccccagacctgaatgcccctgggaagatccccaagaaggacctgagcctgcagaggagccccaacagcgagacagaggagagccagggcctgagcctggatgtgacagactttgaatgtgccctgtgcatgaggctgctgtttgagcctgtgaccaccccctgtggccacaccttctgcctgaagtgcctggagcgctgcctggaccacgccccccactgccccctgtgcaaggacaagctgtctgagctgctggccagcaggaacttcaacatcaccgtgctggccgaggagctgatcttccgctacctgcctgatgagctgagtgacaggaagaggatctatgatgaggagatgtctgagctgagcaacctgaccagagatgtgcccatctttgtgtgtgccatggccttccccaccgtgccctgccccctgcacgtgtttgagccccgctaccgcctgatgatccgccgctgcatggagaccggcaccaagcgcttcggcatgtgcctgtctgctgagcacgccggcctgtctgaatatggctgcatgctggagatcaaggatgtgaggaccttcccagatggcagctctgtggtggatgccatcggcatcagccgcttccgggtgctgagccaccgccacagagatggctacaacacagctgacatcgagtacctggaggatgagaaggtggagggcccagaatatgaggagctggccgccctgcatgattctgtgcaccagcagagcgtgtcctggtttgccagcctgcaggacaggatgaaggagcagatcctgagccactttggagtgatgccagaccgggagcctgagccccagagcaaccccagcggccctgcctggagctggtggatcctggccgtgctgcccctggagaggaaggcccagctggccatcctgggcatgaccagcctgaaggagcggctgctggccatccgccgcatcctggtgatcatcaccaggaagatgaacagccggcaggagctggccaatgcccgggagaggaacaactag

SEQ ID NO: 39807 - DNA, 1536 bp, Artificial Sequence
  Description of Artificial Sequence: Synthetic coding sequence
atgaagaactatgagcaggccctgcaggatgccagcgctgcctgccagaatgagcccctgctgatcaagggccaccaggtgaaggcccaggccctgagcggcctgggccgcagcaaggaggtgctgaaggagttcctgtactgcctggccctgaaccctgagtgcaacagcgtgaagaaggaggcccagaaggtgatgtgtgaggtgctcttcagcgccacagccaacgtgcatgagaacctgaccagcagcatccagagccggctgaaggcccagggccacagccacatgaatgcccaggccctgctggaggagggagatgctggcagcagcgagaacagcagcgagaagagtgacatgctgggcaacaccaacagctctgtgctgtacttcatcctgggcctgcactttgaggaggacaagaaggccctggagagcatcctgcccacagcccccagcgctggcctgaagaggcagttcccagatgatgtggaggatgccccagacctgaatgcccctgggaagatccccaagaaggacctgagcctgcagaggagccccaacagcgagacagaggagagccagggcctgagcctggatgtgacagactttgaatgtgccctgtgcatgaggctgctgtttgagcctgtgaccaccccctgtggccacaccttctgcctgaagtgcctggagcgctgcctggaccacgccccccactgccccctgtgcaaggacaagctgtctgagctgctggccagcaggaacttcaacatcaccgtgctggccgaggagctgatcttccgctacctgcctgatgagctgagtgacaggaagaggatctatgatgaggagatgtctgagctgagcaacctgaccagagatgtgcccatctttgtgtgtgccatggccttccccaccgtgccctgccccctgcacgtgtttgagccccgctaccgcctgatgatccgccgctgcatggagaccggcaccaagagatttggcatgtgcctgtctgctgagcacgccggcctgtctgaatatggctgcatgctggagatcaaggatgtgaggaccttcccagatggcagctctgtggtggatgccatcggcatcagccgcttccgggtgctgagccaccgccacagagatggctacaacacagctgacatcgagtacctggaggatgagaaggtggagggcccagaatatgaggagctggccgccctgcatgacagcgtgcaccagcagagcgtgtcctggtttgccagcctgcaggacaggatgaaggagcagatcctgagccactttggagtgatgccagaccgggagcctgagccccagagcaaccccagcggccctgcctggagctggtggatcctggccgtgctgcccctggagaggaaggcccagctggccatcctgggcatgaccagcctgaaggagcggctgctggccatccgccgcatcctggtgatcatcaccaggaagatgaacagccggcaggagctggccaatgcccgggagaggaacaactag

SEQ ID NO: 39808 - DNA, 2157 bp, Artificial Sequence
  Description of Artificial Sequence: Synthetic coding sequence
atggagagcgtgcgcatcgagcagatgctgagcctgcctgctgaggtgtccagtgacaacctggagagcgctgagcggggggccagcgctgcccaggtggacatgggcccccaccccaaggtggccgctgagggccctgcccccctgcccacccgggagcctgagcaggagcagagccctggcaccagcaccccagagagcaaggtgctgctgacccaggctgatgccctggccagccggggccgcatccgggaggccctggaggtgtaccggcagctgtctgagcggcagcagctggtggccgagcagctggagcagctggtgcgctgcctggccgagaaggtgccccagggcgaggccctggccccagcccccccagatgagggcagcacagccagcggcaccgtggccgctgaggagactggagctgctgctgctgctgctgccacagaggtgtgggatggcttcaagtgcaggaagtgccacggcttcctgagtgaccctgtgtccctgagctgtggccacaccttctgcaagctgtgcctggagcggggccgggctgctgaccggcgctgtgccctgtgtggggtgaagctgagcgccctgatggtggccaccggccgggcccggggggccaggagagctggccagcagcccccaccacccctgcgggtgaatgtggtgctgagcggcctgctgggcaagctgtttcctggccctgcccgggccagccagctgcggcatgagggcaacagactctaccgggagcggcaggtggaggccgccctgctgaagtacaatgaagctgtgaagctggccccaaatgaccacctgctgtacagcaacagaagccagatctacttcaccctggagagccatgaaaatgccctgcatgatgctgagatcgcctgcaagctgcggcccatgggcttcaaggacaacctggagctgccccactgcagcagccaggaggaggccgccgcccggggagatggcagcagcctgatggaccctgccaaggtgaagggagatggccagcagcaccacatgaaggaccaggaggaggaggaggagaagtgggatgccaccagccccaaggccgccagcagcaagacaggcaagtgccaggagaagaagaggaagcactgccagatcgagagccaggaggagaccggcatgcccaacaaggccagcaagcaggaccccccaacagaccagggcgacaagccagccctgagcctgcccctggccagctttgatgccagtgacctggagtgtgccctgtgcatgaggctcttctatgagcctgtgaccaccccctgtggccacaccttctgcctgaagtgcctggagcgctgcctggaccacaatgccaagtgccccctgtgcaaggatggcctgagccagtgcctggccagcaggaagtacagcaagaatgtcatcatggaggagctgattgccaagttcctgcctgaggagctgaaggagaggaggaagctgtatgaggaggagatggaggagctgagcaacctgaacaagaatgtgcccatctttgtgtgcaccatggcctaccccaccgtgccctgccccctgcacatctttgagccctgctaccgcctgatgatccgccgctgcatcgagaccggcacccggcagtttggcatgtgcctgggggaccctgtgaagggctttgctgaatatggctgcatcctggagatcagaaatgtgcagttctttgctgatggccgctctgtggtggacagcatcggcaagaggcgcttccgggtgctgcaccagagccagagagatggctacaacacagctgacatcgagtacatcgaggaccagaaggtgcagggcgaggactgtgccgagctgatgggcctgcacaactgtgtgtaccagcaggccagcctgtggttccacagcctgaagctgagcctgaagaaccgcatcctgaaccacttcggccccatgcctgagaaggatgctgacccccagatgaaccccaatggacctgcctggtgctggtggatgctggccgtgctgcccctggagagccgggcccagctgcccttcctggccatgaggagcctgaaggaccggctgaatggcatcagaagagtgctggccttcatcagcaggaaccagaactag

SEQ ID NO: 39809 - DNA, 2157 bp, Artificial Sequence; identical to SEQ ID NO: 39808
  Description of Artificial Sequence: Synthetic coding sequence

SEQ ID NO: 39810 - DNA, 2280 bp, Artificial Sequence
  Description of Artificial Sequence: Synthetic coding sequence
atggagagcgtgcgcatcgagcagatgctgagcctgcctgctgaggtgtccagtgacaacctggagagcgctgagcggggggccagcgctgcccaggtggacatgggcccccaccccaaggtggccgctgagggccctgcccccctgcccacccgggagcctgagcaggagcagagccctggcaccagcaccccagagagcaaggtgctgctgacccaggctgatgccctggccagccggggccgcatccgggaggccctggaggtgtaccggcagctgtctgagcggcagcagctggtggccgagcagctggagcagctggtgcgctgcctggccgagaaggtgccccagggcgaggccctggccccagcccccccagatgagggcagcacagccagcggcaccgtggccgctgaggagactggagctgctgctgctgctgctgccacagaggtgtgggatggcttcaagtgcaggaagtgccacggcttcctgagtgaccctgtgtccctgagctgtggccacaccttctgcaagctgtgcctggagcggggccgggctgctgaccggcgctgtgccctgtgtggggtgaagctgagcgccctgatggtggccaccggccgggcccggggggccaggagagctggccagcagcccccaccacccctgcgggtgaatgtggtgctgagcggcctgctgggcaagctgtttcctggccctgcccgggccagccagctgcggcatgagggcaacagactctaccgggagcggcaggtggaggccgccctgctgaagtacaatgaagctgtgaagctggccccaaatgaccacctgctgtacagcaacagaagccagatctacttcaccctggagagccatgaaaatgccctgcatgatgctgagatcgcctgcaagctgcggcccatgggcttcaaggcccacttcaggaaggcccaggccctggccaccctgggcaaggtggaggaggccctgcgggagttcctgtactgtgtgtccctggatggcaagaacaagagggcccgctgtgaggcccagagggacaacctggagctgccccactgcagcagccaggaggaggccgccgcccggggagatggcagcagcctgatggaccctgccaaggtgaagggagatggccagcagcaccacatgaaggaccaggaggaggaggaggagaagtgggatgccaccagccccaaggccgccagcagcaagacaggcaagtgccaggagaagaagaggaagcactgccagatcgagagccaggaggagaccggcatgcccaacaaggccagcaagcaggaccccccaacagaccagggcgacaagccagccctgagcctgcccctggccagctttgatgccagtgacctggagtgtgccctgtgcatgaggctcttctatgagcctgtgaccaccccctgtggccacaccttctgcctgaagtgcctggagcgctgcctggaccacaatgccaagtgccccctgtgcaaggatggcctgagccagtgcctggccagcaggaagtacagcaagaatgtcatcatggaggagctgattgccaagttcctgcctgaggagctgaaggagaggaggaagctgtatgaggaggagatggaggagctgagcaacctgaacaagaatgtgcccatctttgtgtgcaccatggcctaccccaccgtgccctgccccctgcacatctttgagccctgctaccgcctgatgatccgccgctgcattgaaacaggcacccggcagtttggcatgtgcctgggggaccctgtgaagggctttgctgaatatggctgcatcctggagatcagaaatgtgcagttctttgctgatggccgctctgtggtggacagcatcggcaagaggcgcttccgggtgctgcaccagagccagagagatggctacaacacagctgacatcgagtacatcgaggaccagaaggtgcagggcgaggactgtgccgagctgatgggcctgcacaactgtgtgtaccagcaggccagcctgtggttccacagcctgaagctgagcctgaagaaccgcatcctgaaccacttcggccccatgcctgagaaggatgctgacccccagatgaaccccaacggccctgcctggtgctggtggatgctggccgtgctgcccctggagagccgggcccagctgcccttcctggccatgaggagcctgaaggaccggctgaatggcatccggcgggtgctggccttcatcagcaggaaccagaactag

SEQ ID NO: 39811 - DNA, 1512 bp, Artificial Sequence
  Description of Artificial Sequence: Synthetic coding sequence
atgggcttcaaggcccacttcaggaaggcccaggccctggccaccctgggcaaggtggaggaggccctgcgggagttcctgtactgtgtgtccctggatggcaagaacaagagggcccgctgtgaggcccagaggctgctgctgtccttcttcagccccagcgtgcctggggacagccaggagcacagcccagacatcctgaagctgctggccccccacccccggctgaaggaaaatgtggagagcatgaccacagaggtgaccagccacaacctgccccggctgctgcaggacaacctggagctgccccactgcagcagccaggaggaggccgccgcccggggagatggcagcagcctgatggaccctgccaaggtgaagggagatggccagcagcaccacatgaaggaccaggaggaggaggaggagaagtgggatgccaccagccccaaggccgccagcagcaagacaggcaagtgccaggagaagaagaggaagcactgccagatcgagagccaggaggagaccggcatgcccaacaaggccagcaagcaggaccccccaacagaccagggcgacaagccagccctgagcctgcccctggccagctttgatgccagtgacctggagtgtgccctgtgcatgaggctcttctatgagcctgtgaccaccccctgtggccacaccttctgcctgaagtgcctggagcgctgcctggaccacaatgccaagtgccccctgtgcaaggatggcctgagccagtgcctggccagcaggaagtacagcaagaatgtcatcatggaggagctgattgccaagttcctgcctgaggagctgaaggagaggaggaagctgtatgaggaggagatggaggagctgagcaacctgaacaagaatgtgcccatctttgtgtgcaccatggcctaccccaccgtgccctgccccctgcacatctttgagccctgctaccgcctgatgatccgccgctgcattgaaacaggcacccggcagtttggcatgtgcctgggggaccctgtgaagggctttgctgaatatggctgcatcctggagatcagaaatgtgcagttctttgctgatggccgctctgtggtggacagcatcggcaagaggcgcttccgggtgctgcaccagagccagagagatggctacaacacagctgacatcgagtacatcgaggaccagaaggtgcagggcgaggactgtgccgagctgatgggcctgcacaactgtgtgtaccagcaggccagcctgtggttccacagcctgaagctgagcctgaagaaccgcatcctgaaccacttcggccccatgcctgagaaggatgctgacccccagatgaaccccaacggccctgcctggtgctggtggatgctggccgtgctgcccctggagagccgggcccagctgcccttcctggccatgaggagcctgaaggaccggctgaatggcatccggcgggtgctggccttcatcagcaggaaccagaactag

SEQ ID NO: 39812 - DNA, 1578 bp, Artificial Sequence
  Description of Artificial Sequence: Synthetic coding sequence
tgatgtggggtgaagctgagcgccctgatggtggccaccggccgggcccggggggcccggcgggccggccagcagcccccaccacccctgcgggtgaatgtggtgctgagcggcctgctgggcaagctgtttcctggccctgcccgggccagccagctgcggcatgagggcaaccggctgtaccgggagcggcaggtggaggccgccctgctgaagtacaatgaggccgtgaagctggccccaaatgaccacctgctgtacagcaacagaagccagatctacttcaccctggagagccatgaaaatgccctgcatgatgctgagatcgcctgcaagctgcggcccatgggcttcaaggacaacctggagctgccccactgcagcagccaggaggaggccgccgcccggggagatggcagcagcctgatggaccctgccaaggtgaagggagatggccagcagcaccacatgaaggaccaggaggaggaggaggagaagtgggatgccaccagccccaaggccgccagcagcaagacaggcaagtgccaggagaagaagaggaagcactgccagatcgagagccaggaggagaccggcatgcccaacaaggccagcaagcaggaccccccaacagaccagggcgacaagccagccctgagcctgcccctggccagctttgatgccagtgacctggagtgtgccctgtgcatgaggctcttctatgagcctgtgaccaccccctgtggccacaccttctgcctgaagtgcctggagcgctgcctggaccacaatgccaagtgccccctgtgcaaggatggcctgagccagtgcctggccagcaggaagtacagcaagaatgtcatcatggaggagctgattgccaagttcctgcctgaggagctgaaggagaggaggaagctgtatgaggaggagatggaggagctgagcaacctgaacaagaatgtgcccatctttgtgtgcaccatggcctaccccaccgtgccctgccccctgcacatctttgagccctgctaccgcctgatgatccgccgctgcattgaaacaggcacccggcagtttggcatgtgcctgggggaccctgtgaagggctttgctgaatatggctgcatcctggagatcagaaatgtgcagttctttgctgatggccgctctgtggtggacagcatcggcaagaggcgcttccgggtgctgcaccagagccagagagatggctacaacacagctgacatcgagtacatcgaggaccagaaggtgcagggcgaggactgtgccgagctgatgggcctgcacaactgtgtgtaccagcaggccagcctgtggttccacagcctgaagctgagcctgaagaaccgcatcctgaaccacttcggccccatgcctgagaaggatgctgacccccagatgaaccccaacggccctgcctggtgctggtggatgctggccgtgctgcccctggagagccgggcccagctgcccttcctggccatgaggagcctgaaggaccggctgaatggcatccggcgggtgctggccttcatcagcaggaaccagaactag

SEQ ID NO: 39813 - DNA, 1389 bp, Artificial Sequence
  Description of Artificial Sequence: Synthetic coding sequence
atgggcgccgccggccgggccacccggctggtgggcggccgggagcagagaggagctgtgggcggcggctggtggggcggggagccagacatcccctacacccacaccacagagcacccccccatgggcagccccctgcccaacctgcgggcccacgtgaggacaggccggcccccagacccctgcacagctgctgcccgggacagaagacccctgggccggggcggcagaggagctgcccagaccttcggccagaggacccggggcggcccccgctgccccggcagccaccggcagaggcctccttccatgaaggccgccccccggctgccccaccggctgcggcaccggggccagcccccagagcccagcagcctgcgggccctgcatgctgaccccatccccagcggcctgagccctggcccctgtggggccccacccacctggagcggccggcgggcccctggggaccgggacaaccggcccaccagcggcccctggcagaggcacacccggcgcagccgggtgtggagccagaggggccccccccagcccaagctggtgagccgcagcggccgggaggacacccgggccggccgcggggcccagacaggcaaggcccgggacaggaagggcaagggcacccgggagcctgctgagggccgcctgggcaagaagccccaggccaagccaggccaccaggagaacacagccaccggcagccaccgccacagatatgagggcggccctgctgccccccggctgggcagcaggacagcccctggcacccaccgggacccccctcatgagcccggcagccgccaccgggaccctgaggccaccagcgccaccaaccccaccccaggcccccgctgctggttcctggtgcacccccccaccctgagcagcagcggccgcccagcccggccccccctgggcatgctgcccatggcccggcaccccaaccctgtgcccaggaagaggggctgccgccacaggagcctgctgctgcggggggccggcggggagcccgcccggtctggagctggccacgccccagatggcaccccaggcacagccacagcccgggccgccagccagcccctgggcagaagacctggccctgctggcagcagcccagacagcgagggcggcggggccggccacacagtgggagatgagcccccatctgtgcccacagctgaggacagcctgaagcgggagagcgtgcgggacagcagcttcagccctgagagcagcgaggtggatggcggcctgtgcagcgagctgctgtggttccagctggccgccaggagaagagagatcagcaatgtgtcccgggaggcccgggccaccgtcatcgagcccaggaagtggaggctgcagtag

SEQ ID NO: 39814 - DNA, 495 bp, Artificial Sequence
  Description of Artificial Sequence: Synthetic coding sequence
atgaggccccagccccggggcggcagcggcaggaaagaaaatactggagaggagcgggagggccgggcagagcgctaccacgccatctctgcagatggagagcggcggctgcagcctggaacagctgtgctgaccaggcatgtgtccttcctgtttggaggccgggaggccgaggagcacgtgatggagacagacagagtggagggcgccagagatggagacaagaggaaggaggtgtgctttgtgcccatccagggcagcttctgcttcatgaggctgacctgtgcccggctggtggccgccctggacatccacggcctgtccttcagcctgcgcttctgtggcagccgggacaccaagcatgaggacatcaccggccgggagggccaggtgacccccctgccccggggcaccccccagctgtgcacagcccgggtgggcctgagcagccccaggacccggggccagggcgtgcccatcagctgcaagacctag

SEQ ID NO: 39815 - DNA, 261 bp, Artificial Sequence
  Description of Artificial Sequence: Synthetic coding sequence
atggtgcgccacccctacagcgtgcagacccagctgagcacagaggccaaggccatctggaggtccatgcagcagcaggagaccaacctgctggccaacctgaccaccaatgatgcccgggacaacagcaaggacttccagaacagcaaggtgggcgccgccgccaccagcagagatgagggctgcaactgccccatcattggagagatcgtcatcagctgctactggctgtttgagatccccccactcatcagcaggtag

SEQ ID NO: 39816 - DNA, 192 bp, Artificial Sequence
  Description of Artificial Sequence: Synthetic coding sequence
cagcagcaggagaccaacctgctggccaacctgaccaccaatgatgcccgggacaacagcaaggacttccagaacagcaaggtgggcgctgctgccaccagcagagatgagggctgcaactgccccatcatcggggagatcgtcatcagctgctactggctgtttgagatccccccactcatcagcgagtag

SEQ ID NO: 39817 - DNA, 249 bp, Artificial Sequence
  Description of Artificial Sequence: Synthetic coding sequence
atgcagtgcctgtacttcatcctgatcctgaagggctacttccaccagcagcaccacaccctgctgatcaccatcgccctgtgcttcctgcagcagcagcaggagaccaacctgctggccaacctgaccaccaatgatgcccgggacaacagcaaggacttccagaacagcaaggtgggcgccgccgccaccagcagagatgaaggagagacccagaagtgcatccagaagcccctgcacgagaagtag

SEQ ID NO: 39818 - DNA, 795 bp, Artificial Sequence
  Description of Artificial Sequence: Synthetic coding sequence
atgcccaggagcctgaagagggcccagctgcggagcctgctgcccaggcctcctgctgtgagccacacccagccctggtacagagctgcccaccccaccaccagccccacagctgccagcagagatgtgcacccagccagcggggctgtgcccggcccctggctggtggagggcacagctgtgcgggagggcccccagctgcaggatgctgtgccccagaggcccacccggcccagcaaggccctgtggccagcccagatgtctgctgccccagccatccggctgggccagatggtgcctggggacacccggggcctgtggggcccccagggcaccctgctgacctggacctaccggggcggccagggcggccgctggacccggcgggcagagggcccccgggagggcacctttgctgagcagaggccccacttccagagcagcggggcccagcaggagagccggctggccatgggccccccacccctgggcctgggagatgctgctggagatggccggggccagacaggccaggagaagggccgggcagagggccggcaggccaggaagagcgcctgcaagtgccccaggaagggccccaaccctggcccctggaccagggctgctgcctggtggggccgcctggagggcgccaaggccagcgccaagggggagcaggtgcgggaccccggcggccacctgtgggagcagggccacgtgagcccctgtgcccgcttcaaccagggccacagctgtggcagccccaaggtgagccacaccacctgggtgtcctag

SEQ ID NO: 39819 - DNA, 447 bp, Artificial Sequence
  Description of Artificial Sequence: Synthetic coding sequence
atgggcagcgagcagagcagcgaggccgagagccggcccaatgacctgaacagcagcggcctgctgagcggccagaccagccccaccaatgccaagctggagaagctggacagccagcaggtgctgcagctgtgcctgcgctaccaggaccacctgcaccagtgtgccgaggccgtggcctttgaccagaatgccctggtgaagaggatcaaggagatggacctgtctgtggagaccctcttctccttcatgcaggagcggcagaagagatatgccaagtatgcagagcagatccagaaggtgaatgagatgtctgccatcctgcggcgcatccagatgggcatcgaccagacagtgcccctgctggaccggctgaacagcatgctgcctgagggggagcggctggagcccttctccatgaagccagaccgggagctgcggctgtag

SEQ ID NO: 39820 - DNA, 591 bp, Artificial Sequence
  Description of Artificial Sequence: Synthetic coding sequence
atgggcagcgagcagagcagcgaggccgagagccggcccaatgacctgaacagctctgtgacccccagccctgccaagcaccgggccaagatggatgacatcgtggtggtggcccagggcagccaggccagcagaaatgtgtccaatgaccctgatgtgatcaagctgcaggagatccccaccttccagcccctgctgaagggcctgctgagcggccagaccagccccaccaatgccaagctggagaagctggacagccagcaggtgctgcagctgtgcctgcgctaccaggaccacctgcaccagtgtgccgaggccgtggcctttgaccagaatgccctggtgaagaggatcaaggagatggacctgtctgtggagaccctcttctccttcatgcaggagcggcagaagagatatgccaagtatgcagagcagatccagaaggtgaatgagatgtctgccatcctgcggcgcatccagatgggcatcgaccagacagtgcccctgctggaccggctgaacagcatgctgcctgagggggagcggctggagcccttctccatgaagccagaccgggagctgcggctgtag

SEQ ID NO: 39821 - DNA, 501 bp, Artificial Sequence
  Description of Artificial Sequence: Synthetic coding sequence
atgcagggcaccagggctgagctgagcgcccacagccccagcagagctgctggcaacagaagacatgagcagggcctgcccccaggggcccaggcctgcatcaccctgaccaacagaacaggcttcctgtgccacgaccagaggagctgcatcccagccagcggcgtgtgtgatggagtgaggacctgcacccatggagaagatgaagatgagagcctgtgcagagatgtgccccagagcctgccccacttcctggtggcccactgtggggaccctgcctcctggatctacagcgaccagaagtgtgatggcaccaacaactgtggggactgcagtgatgagctgagccctgtgacagtgtgccccccctgtggccctggctggtggcgctgccccagcaccttcttcaagtactgtgactgcatccccaggcacctgtgccgggaccacgtgcagcactgcagcgactggagcgatgaatatgcctgccccggcccctag

SEQ ID NO: 39822 - DNA, 489 bp, Artificial Sequence
  Description of Artificial Sequence: Synthetic coding sequence
atgaacaaggtgttcccccagggagaaaatggctacacagctgctgagagcaaggcccaccctggaggagagggcgcccaggcctgcatcaccctgaccaacagaacaggcttcctgtgccacgaccagaggagctgcatcccagccagcggcgtgtgtgatggagtgaggacctgcacccatggagaagatgaagatgagagcctgtgcagagatgtgccccagagcctgccccacttcctggtggcccactgtggggaccctgcctcctggatctacagcgaccagaagtgtgatggcaccaacaactgtggggactgcagtgatgagctgagccctgtgacagtgtgccccccctgtggccctggctggtggcgctgccccagcaccttcttcaagtactgtgactgcatccccaggcacctgtgccgggaccacgtgcagcactgcagcgactggagcgatgaatatgcctgccccggcccctag

SEQ ID NO: 39823 - DNA, 759 bp, Artificial Sequence
  Description of Artificial Sequence: Synthetic coding sequence
atggagggccacgtgtactggacagatgatgaggtgtgggccatccggcgggcctacctggatggcagcggggcccagaccctcatcaacaccaagatcaatgaccctgatgacattgctgtgaactgggtggcccggagcctgtactggacccacactggaacagagcacatcgaggtgacctgcctgaacagcaccagccacaagatcctggtgtctgaggacatggatgagccccgggccatcgccctgcaccctgagatgggcctgacctactggattgactggggcgagaaccctgagatcaagagggccaacctggaccggcaggagctgcgggtgctggtgaatgccagcctgggctggcccaacggcctggccctggacctgcaggagggcaagctgtactggggagatgccaagacagacaagattgaggccatctctgtggatgagaccaagaggcagaccctgctgaaggacaagctgccccacatcttccgcttcaccctgctgggggacttcatctactggacagcctggcagcaccacagcatcaagagggtgcacaaggtgaaggccaacagagatgtgatcatcgaccagctgcctgacctgatgggcctgaaggctgtgaatgtggacaaggtggtgggcaccaacccccacgccgacagaaatggaggagctgccacctgtgccagcagccggcccacccagcccggcctggccgcccccagccgggcctggaactgctag

SEQ ID NO: 39824 - DNA, 759 bp, Artificial Sequence; identical to SEQ ID NO: 39823
  Description of Artificial Sequence: Synthetic coding sequence

SEQ ID NO: 39825 - DNA, 675 bp, Artificial Sequence
  Description of Artificial Sequence: Synthetic coding sequence
atggagggccacgtgtactggacagatgatgaggtgtgggccatccggcgggcctacctggatggcagcggggcccagaccctcatcaacaccaagatcaatgaccctgatgacattgctgtgaactgggtggcccggagcctgtactggacccacactggaacagagcacatcgaggtgacctgcctgaacagcaccagccacaagatcctggtgtctgaggacatggatgagccccgggccatcgccctgcaccctgagatgggcctgacctactggattgactggggcgagaaccctgagatcaagagggccaacctggaccggcaggagctgcgggtgctggtgaatgccagcctgggctggcccaacggcctggccctggacctgcaggagggcaagctgtactggggagatgccaagacagacaagattgaggccatctctgtggatgagaccaagaggcagaccctgctgaaggacaagctgccccacatcttccgcttcaccctgctgggggacttcatctactggacagcctggcagcaccacagcatcaagagggtgcacaaggtgaaggccaacagagatgtgatcatcgaccagctgcctgacctgatgggcctgaaggctgtgaatgtggacaaggtggtgggccctggaacagctgagtag

SEQ ID NO: 39826 - DNA, 12 bp, Artificial Sequence
  Description of Artificial Sequence: Synthetic coding sequence
atggagggctag

SEQ ID NO: 39827 - DNA, 1158 bp, Artificial Sequence
  Description of Artificial Sequence: Synthetic coding sequence
atgagcggcagcagcggcaccccctacctgggcagcaagatcagcctcatcagcaaggcccagatccgctatgagggcatcctgtacaccatcgacacagacaacagcacagtggccctggccaaggtgcgcagctttggaacagaagatcggcccacagacaggcctgccccaccccgggaggagatctatgagtacatcatcttccggggcagtgacatcaaggacatcaccgtgtgtgagccccccaaggcccagcacaccctgccccaggaccctgccatcgtgcagagcagcctgggcagcgccagcgccagccccttccagccccacgtgccctacagccccttccggggcatggccccctacggccccctggccgccagcagcctgctgagccagcagtatgctgccagcctgggcctggagaagctggtgagccccccagccagcgctgctgccagcagccccagcagcagccccagcccccagcctgtgtctgagctggacctgagcagcgagccccagcagctgacagccaagggcaacagcagcctgggggagctgcatgctgtgctgcagaccatcctgcgggcccggggcaaggctgctgacaggatgacagtggccgtggccgaccacctgcccagcccctgcagcagaagaagaagtggcaacagaaggaccaggaacagaagccggggccagaaccggcccaccaacgtgaaggagaacaccatcaagtttgaaggagactttgattttgaaagtgccaatgcccagttcaaccgggaggagctggacaaggagttcaagaagaagctgaacttcaaggatgacaaggccgagaagggggaggagaaggacctggccgtggtgacccagagcgctgaggccccagctgaggaggacctgctgggccccaactgctactatgacaagagcaagagcttctttgacaacatcagcagcgagctgaagaccagcagcaggaggaccacctgggccgaggagaggaagctgaacacagagaccttcggcgtgtctggccgcttcctgcggggccgcagcagccggggcggcttccggggcggcagaggaaatggcaccaccaggaggaaccccaccagccaccgggccggcaccggccgggtgtag

SEQ ID NO: 39828 - DNA, 1158 bp, Artificial Sequence
  Description of Artificial Sequence: Synthetic coding sequence
atgagcggcagcagcggcaccccctacctgggcagcaagatcagcctcatcagcaaggcccagatccgctatgagggcatcctgtacaccatcgacacagacaacagcacagtggccctggccaaggtgcgcagctttggaacagaagatcggcccacagacaggcctgccccaccccgggaggagatctatgagtacatcatcttccggggcagtgacatcaaggacatcaccgtgtgtgagccccccaaggcccagcacaccctgccccaggaccctgccatcgtgcagagcagcctgggcagcgccagcgccagccccttccagccccacgtgccctacagccccttccggggcatggccccctacggccccctggccgccagcagcctgctgagccagcagtatgctgccagcctgggcctgggcgccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagtgatgtggtgcagcctgctgctgtgcaggcccagggccaggtgaatgatgaaaatagaagaccccagaggcggcgcagcggcaacagaaggaccaggaacagaagccggggccagaaccggcccaccaacgtgaaggagaacaccatcaagtttgaaggagactttgattttgaaagtgccaatgcccagttcaaccgggaggagctggacaaggagttcaagaagaagctgaacttcaaggatgacaaggccgagaagggggaggagaaggacctggccgtggtgacccagagcgctgaggccccagctgaggaggacctgctgggccccaactgctactatgacaagagcaagagcttctttgacaacatcagcagcgagctgaagaccagcagcaggaggaccacctgggccgaggagaggaagctgaacacagagaccttcggcgtgtctggccgcttcctgcggggccgcagcagccggggcggcttccggggcggcagaggaaatggcaccaccaggaggaaccccaccagccaccgggccggcaccggccgggtgtag

SEQ ID NO: 39829 - DNA, 672 bp, Artificial Sequence
  Description of Artificial Sequence: Synthetic coding sequence
atgagcggcagcagcggcaccccctacctgggcagcaagatcagcctcatcagcaaggcccagatccgctatgagggcatcctgtacaccatcgacacagacaacagcacagtggccctggccaaggtgcgcagctttggaacagaagatcggcccacagacaggcctgccccaccccgggaggagatctatgagtacatcatcttccggggcagtgacatcaaggacatcaccgtgtgtgagccccccaaggcccagcacaccctgccccaggaccctgccatcgtgcagagcagcctgggcagcgccagcgccagccccttccagccccacgtgccctacagccccttccggggcatggccccctacggccccctggccgccagcagcctgctgagccagcagtatgctgccagcctgggcctgggcgccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagcggcaacagaaggaccaggaacagaagccggggccagaaccggcccaccaacgtgaaggagaacaccatcaagttctag

SEQ ID NO: 39830 - DNA, 747 bp, Artificial Sequence
  Description of Artificial Sequence: Synthetic coding sequence
atggccccctacggccccctggccgccagcagcctgctgagccagcagtatgctgccagcctgggcctggagaagctggtgtccccaccagccagcgctgctgccagcagccccagcagcagccccagcccccagcctgtgtctgagctggacctgagcagcgagccccagcagctgacagccaagggggccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagtgatgtggtgcagcctgctgctgtgcaggcccagggccaggtgaatgatgaaaatagaagaccccagaggcggcgcagcggcaacagaaggaccaggaacagaagccggggccagaaccggcccaccaacgtgaaggagaacaccatcaagtttgaaggagactttgattttgaaagtgccaatgcccagttcaaccgggaggagctggacaaggagttcaagaagaagctgaacttcaaggatgacaaggccgagaagggggaggagaaggacctggccgtggtgacccagagcgctgaggccccagctgaggaggacctgctgggccccaactgctactatgacaagagcaagagcttctttgacaacatcagcagcgagctgaagacctag

SEQ ID NO: 39831 - DNA, 720 bp, Artificial Sequence
  Description of Artificial Sequence: Synthetic coding sequence
atggccccctacggccccctggccgccagcagcctgctgagccagcagtatgctgccagcctgggcctggagaagctggtgtccccaccagccagcgctgctgccagcagccccagcagcagccccagcccccagcctgtgtctgagctggacctgagcagcgagccccagcagctgacagccaagggctgcctcttctgcttccgcagcctcttcacctacacccagagccacatcgtgctcttccgggtgcccaccggccctggcaccctggagcgggaggagatggagcggggggccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagtgatgtggtgcagcctgctgctgtgcaggcccagggccaggtgaatgatgaaaatagaagaccccagaggcggcgcagcggcaacagaaggaccaggaacagaagccggggccagaaccggcccaccaacgtgaaggagaacaccatcaagtttgaaggagactttgattttgaaagtgccaatgcccagttcaaccgggaggagctggacaaggagttcaagaagaggcccatcctgctgctggtgttctggacctag

SEQ ID NO: 39832 - DNA, 666 bp, Artificial Sequence
  Description of Artificial Sequence: Synthetic coding sequence
atgagcggcagcagcggcaccccctacctgggcagcaagatcagcctcatcagcaaggcccagatccgctatgagggcatcctgtacaccatcgacacagacaacagcacagtggccctggccaaggtgcgcagctttggaacagaagatcggcccacagacaggcctgccccaccccgggaggagatctatgagtacatcatcttccggggcagtgacatcaaggacatcaccgtgtgtgagccccccaaggcccagcacaccctgccccaggaccctgccatcgtgcagagcagcctgggcagcgccagcgccagccccttccagccccacgtgccctacagccccttccggggcatggccccctacggccccctggccgccagcagcctgctgagccagcagtatgctgccagcctgggcctggagaagctggtgagccccccagccagcgctgctgccagcagccccagcagcagccccagcccccagcctgtgtctgagctggacctgagcagcgagccccagcagctgacagccaagggcaacagcagcctgggggagctgcatgctgtgctgcagaccatcctgcgggcccggggcaaggctgctgacaggatgacagtggccgtggccgaccacctgcccagcccctgcagcaggtag

SEQ ID NO: 39833 - DNA, 891 bp, Artificial Sequence
  Description of Artificial Sequence: Synthetic coding sequence
atgagcggcagcagcggcaccccctacctgggcagcaagatcagcctcatcagcaaggcccagatccgctatgagggcatcctgtacaccatcgacacagacaacagcacagtggccctggccaaggtgcgcagctttggaacagaagatcggcccacagacaggcctgccccaccccgggaggagatctatgagtacatcatcttccggggcagtgacatcaaggacatcaccgtgtgtgagccccccaaggcccagcacaccctgccccaggaccctgccatcgtgcagctgaacaagaggccagatgaaggagtgagaggagatggcatggcctttgctgtgctgacccgctgcctggtggtgcagagcagcctgggcagcgccagcgccagccccttccagccccacgtgccctacagccccttccggggcatggccccctacggccccctggccgccagcagcctgctgagccagcagtatgctgccagcctgggcctgggcgccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagtgatgtggtgcagcctgctgctgtgcaggcccagggccaggtgaatgatgaaaatagaagaccccagaggcggcgcagcggcaacagaaggaccaggaacagaagccggggccagaaccggcccaccaacgtgaaggagaacaccatcaagtttgaaggagactttgattttgaaagtgccaatgcccagttcaaccgggaggagctggacaaggagtag

SEQ ID NO: 39834 - DNA, 693 bp, Artificial Sequence
  Description of Artificial Sequence: Synthetic coding sequence
atggccccctacggccccctggccgccagcagcctgctgagccagcagtatgctgccagcctgggcctggagaagctggtgtccccaccagccagcgctgctgccagcagccccagcagcagccccagcccccagcctgtgtctgagctggacctgagcagcgagccccagcagctgacagccaagggctgcctcttctgcttccgcagcctcttcacctacacccagagccacatcgtgctcttccgggtgcccaccggccctggcaccctggagcgggaggagatggagcggggggccggcttccccagcatccctgtgggcaagagccccatggtggagcaggccgtgcagacaggcagcgctgacaacctgaatgccaagaagctgctgcccgggaagggcaccaccggcacccagctgaatggccggcaggcccagcccagcagcaagacagccagtgatgtggtgcagcctgctgctgtgcaggcccagggccaggtgaatgatgaaaatagaagaccccagaggcggcgcagcggcaacagaaggaccaggaacagaagccggggccagaaccggcccaccaacgtgaaggagaacaccatcaagtttgaaggagactttgattttgaaagtgccaatgcccagttcaaccgggaggagctggacaaggagttcaagaagaagtag

SEQ ID NO: 39835 - DNA, 1158 bp, Artificial Sequence; identical to SEQ ID NO: 39828
  Description of Artificial Sequence: Synthetic coding sequence

SEQ ID NO: 39836 - DNA, 1428 bp, Artificial Sequence
  Description of Artificial Sequence: Synthetic coding sequence
atgccccacaggaagaagaagcccttcatcgagaagaagaaggctgtgtccttccacctggtgcacaggagccagagggaccccctggccgcagatgagagcgccccccagagggtgctgctgcccacccagaagattgacaatgaggagaggagagctgagcagaggaaatatggagtcttctttgatgatgattatgactacctgcagcacctgaaggagcccagcggccccagcgagctgatccccagcagcaccttcagcgcccacaacagaagagaggagaaggaggagaccctggtgatccccagcacaggcatcaagctgcccagctctgtgtttgccagcgagtttgaggaggatgtgggcctgctgaacaaggccgcccctgtgtctggcccccggctggactttgatcctgacatcgtggccgccctggatgatgactttgattttgatgatcctgacaacctgctggaggatgacttcatcctgcaggccaacaaggccactggagaggaggagggcatggacatccagaagtcagaaaatgaagatgacagcgagtgggaggatgtggatgatgagaagggggacagcaatgatgattatgacagcgctggcctgctgagtgatgaggactgcatgtctgtgcctgggaagacccaccgggccatcgctgaccacctgttctggagcgaggagaccaagagccgcttcacagagtacagcatgaccagctctgtgatgagaagaaatgagcagctgaccctgcatgatgaaagatttgagaagttctatgagcagtatgatgatgatgaaattggagccctggacaatgctgagctggagggcagcatccaggtggacagcaaccggctgcaggaggtgctgaatgactactacaaggagaaggccgagaactgtgtgaagctgaacaccctggagcccctggaggaccaggacctgcccatgaatgagctggatgaaagtgaggaggaggagatgatcaccgtggtgctggaggaggccaaggagaagtgggactgtgagagcatctgcagcacctacagcaacctgtacaaccacccccagctgatcaagtaccagcccaagcccaagcagatccgcatcagcagcaagacaggcatccccctgaatgtgctgcccaagaagggcctgacagccaagcagacagagcgcatccagatgatcaatggaagtgacctgcccaaggtgtccacccagcccaggagcaagaatgaaagcaaagaagacaagagggccaggaagcaggccatcaaggaggagaggaaggagaggagagtggagaagaaggccaacaagctggccttcaagctggagaagaggcggcaggagaaggagctgctgaacctgaagaagaatgtggagggcctgaagctgtag

SEQ ID NO: 39837 - DNA, 714 bp, Artificial Sequence
  Description of Artificial Sequence: Synthetic coding sequence
atgaagggcatcctggtggccggcatcacagctgtgctggtggccgctgtggagagcctgagctgtgtgcagtgcaacagctgggagaagagctgtgtgaacagcatcgcctctgaatgtcccagccacgccaacaccagctgcatcagcagcagcgccagcagcagcctggagacccctgtgcggctgtaccagaacatgttctgcagcgctgagaactgcagcgaggagacccacatcacagccttcaccgtgcacgtgtctgctgaggagcacttccactttgtgtcccagtgctgccagggcaaggagtgcagcaacaccagtgatgccctggacccccccctgaagaatgtgagcagcaatgctgagtgcccagcctgctatgagagcaatggcaccagctgccacggcaagccctggaagtgctatgaggaggagcagtgtgtgttcctggtggccgagctgaagaatgacatcgagagcaagagcctggtgctgaagggctgcagcaatgtgtccaatgccacctgccagttcctgagcggggagaacaagaccctgggcggcgtcatcttcaggaagtttgaatgtgccaacgtgaacagcctgacccccaccagcgcccccaccaccagccacaacgtgggcagcaaggccagcctgtacctgctggccctggccagcctgctgctgcggggcctgctgccctag

SEQ ID NO: 39838 - DNA, 5622 bp, Artificial Sequence
  Description of Artificial Sequence: Synthetic coding sequence
atgaggacaggctgggccaccccaagaagacctgctggcctgctgatgctgctcttctggttctttgacctggccgagcccagcggccgggccgccaatgaccccttcaccatcgtgcacggcaacacaggcaagtgcatcaagcctgtgtatggctggatcgtggctgatgactgtgatgaaacagaggacaagctgtggaagtgggtgtcccagcacaggctcttccacctgcacagccagaagtgcctgggcctggacatcaccaagtctgtgaatgagctgaggatgttcagctgtgacagcagcgccatgctgtggtggaagtgtgagcaccacagcctgtatggagctgcccgctaccgcctggccctgaaggatggccatggaacagccatcagcaatgccagtgatgtgtggaagaagggcggcagcgaggagagcctgtgtgaccagccctaccacgagatctacaccagagatggcaacagctatggccggccctgtgagttccccttcctgattgatggcacctggcaccacgactgcatcctggatgaggaccacagcggcccctggtgtgccaccaccctgaactatgaatatgacaggaagtggggcatctgcctgaagccagaaaatggctgtgaggacaactgggagaagaatgagcagtttggcagctgctaccagttcaacacccagacagccctgtcctggaaggaggcctacgtgtcctgccagaaccagggcgctgacctgctgagcatcaacagcgctgctgagctgacctacctgaaggagaaggagggcatcgccaagatcttctggattggcctgaaccagctgtacagcgcccggggctgggagtggagcgaccacaagcccctgaacttcctgaactgggaccctgaccggcccagcgcccccaccatcggcggcagcagctgtgccaggatggatgctgagagcggcctgtggcagagcttcagctgtgaggcccagctgccctacgtgtgcaggaagcccctgaacaacacagtggagctgacagatgtgtggacctacagcgacacccgctgtgatgctggctggctgcccaacaacggcttctgctacctgctggtgaatgaaagcaacagctgggacaaggcccacgccaagtgcaaggccttcagcagtgacctgatcagcatccacagcctggctgatgtggaggtggtggtgaccaagctgcacaatgaagacatcaaggaggaggtgtggattggcctgaagaacatcaacatccccaccctcttccagtggagcgatggaacagaggtgaccctgacctactgggatgaaaatgagcccaacgtgccctacaacaagacccccaactgtgtgtcctacctgggggagctgggccagtggaaggtgcagagctgtgaggagaagctgaagtatgtgtgcaagaggaagggggagaagctgaatgatgccagcagtgacaagatgtgccccccagatgagggctggaagagacatggagagacctgctacaagatctatgaagatgaggtgcccttcggcaccaactgcaacctgaccatcaccagcagatttgagcaggagtacctgaatgacctgatgaagaagtatgacaagagcctgaggaagtacttctggacaggcctgagagatgtggacagctgtggggagtacaactgggccaccgtgggcggcagaagaagagctgtgaccttcagcaactggaacttcctggagcccgccagccctgggggctgtgtggccatgagcacaggcaagtctgtgggcaagtgggaggtgaaggactgccgctccttcaaggccctgagcatctgcaagaagatgagcggccccctgggccctgaggaggccagccccaagccagatgacccctgcccagagggctggcagagcttccctgccagcctgagctgctacaaggtgttccacgccgagagaattgtgaggaagaggaactgggaggaggccgagcgcttctgccaggccctgggcgcccacctgagcagcttcagccacgtggatgagatcaaggagttcctgcacttcctgacagaccagttcagcggccagcactggctgtggattggcctgaacaagaggagcccagacctgcagggctcctggcagtggagcgacaggacccctgtgtccaccatcatcatgcccaatgagttccagcaggactatgacatccgggactgtgccgctgtgaaggtgttccaccggccctggaggcggggctggcacttctatgatgaccgggagttcatctacctgcggccctttgcctgtgacaccaagctggagtgggtgtgccagatccccaagggccgcacccccaagaccccagactggtacaacccagacagagctggcatccacggccccccactcatcatcgagggcagcgagtactggtttgtggccgacctgcacctgaactatgaggaggccgtgctgtactgtgccagcaaccacagcttcctggccaccatcaccagctttgtgggcctgaaggccatcaagaacaagatcgccaacatctctggagatggccagaagtggtggatccgcatcagcgagtggcccattgatgaccacttcacctacagccgctacccctggcaccgcttccctgtgaccttcggggaggagtgcctgtacatgtctgccaagacctggctgattgacctgggcaagcccacagactgcagcaccaagctgcccttcatctgtgagaagtacaacgtgagcagcctggagaagtacagcccagattctgctgccaaggtgcagtgcagcgagcagtggatccccttccagaacaagtgcttcctgaagatcaagcctgtgtccctgaccttcagccaggccagtgacacctgccacagctatggaggcaccctgcccagcgtgctgagccagatcgagcaggacttcatcaccagcctgctgcctgacatggaggccaccctgtggattggcctgcgctggacagcctatgagaagatcaacaagtggacagacaaccgggagctgacctacagcaacttccaccccctgctggtgtctggccgcctgcgcatccctgagaacttctttgaggaggagagccgctaccactgtgccctgatcctgaacctgcagaagagccccttcaccggcacctggaacttcaccagctgcagcgagcggcactttgtgtccctgtgccagaagtacagcgaggtgaagagccggcagaccctgcagaatgccagcgagaccgtgaagtacctgaacaacctgtacaagatcatccccaagaccctgacctggcacagcgccaagcgggagtgcctgaagagcaacatgcagctggtgtccatcacagacccctaccagcaggccttcctgtctgtgcaggccctgctgcacaacagcagcctgtggattggcctcttcagccaggatgatgagctgaactttggctggagcgatggcaagaggctgcacttcagccgctgggccgagaccaacggccagctggaggactgtgtggtgctggacacagatggcttctggaagacagtggactgcaatgacaaccagcccggggccatctgctactacagcggaaatgaaacagagaaggaggtgaagcctgtggacagcgtgaagtgccccagccctgtgctgaacaccccctggatccccttccagaactgctgctacaacttcatcatcaccaagaacagacacatggccaccacccaggatgaggtgcacaccaagtgccagaagctgaaccccaagagccacatcctgagcatcagagatgagaaggagaacaactttgtgctggagcagctgctgtacttcaactacatggcctcctgggtgatgctgggcatcacctacagaaacaagagcctgatgtggtttgacaagacccccctgagctacacccactggagggctggccggcccaccatcaagaatgagaagttcctggccggcctgagcacagatggcttctgggacatccagaccttcaaggtgattgaggaggccgtgtacttccaccagcacagcatcctggcctgcaagattgagatggtggactacaaggaggagtacaacaccaccctgccccagttcatgccctatgaagatggcatctacagcgtcatccagaagaaggtgacctggtatgaggccctgaacatgtgcagccagagcggcggccacctggcctctgtgcacaaccagaatggccagctgttcctggaggacatcgtgaagagagatggcttccccctgtgggtgggcctgagcagccatgatggcagcgagagcagctttgagtggagcgatggcagcacctttgactacatcccctggaagggccagaccagccctggcaactgtgtgctgctggaccccaagggcacctggaagcatgagaagtgcaacagcgtgaaggatggagccatctgctacaagcccaccaagagcaagaagctgagccggctgacctacagcagccgctgcccagctgccaaggaaaatggcagccgctggatccagtacaagggccactgctacaagagtgaccaggccctgcacagcttcagcgaggccaagaagctgtgcagcaagcatgaccacagcgccaccatcgtgtccatcaaggatgaagatgagaacaagtttgtgtcccggctgatgagggagaacaacaacatcaccatgagggtgtggctgggcctgagccagcacagcgtggaccagagctggagctggctggatggcagcgaggtgacctttgtgaagtgggagaacaagagcaagagcggcgtgggccgctgcagcatgctgattgccagcaatgagacctggaagaaggtggagtgtgagcacggcttcggccgggtggtgtgcaaggtgcccctggactgccccagcagcacctggatccagttccaggacagctgctacatcttcctgcaggaggccatcaaggtggagagcattgaagatgtgaggaaccagtgcacagaccacggggctgacatgatcagcatccacaatgaggaggagaatgccttcatcctggacaccctgaagaagcagtggaagggcccagatgacatcctgctgggcatgttttatgacacagatgatgccagcttcaagtggtttgacaacagcaacatgacctttgacaagtggacagaccaggatgatgatgaggacctggtggacacctgtgccttcctgcacatcaagacaggagagtggaagaagggcaactgtgaggtgtcctctgtggagggcaccctgtgcaagacagccatcccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 39839 - DNA, 5454 bp, Artificial Sequence
  Description of Artificial Sequence: Synthetic coding sequence
atgaggacaggctgggccaccccaagaagacctgctggcctgctgatgctgctcttctggttctttgacctggccgagcccagcggccgggccgccaatgaccccttcaccatcgtgcacggcaacacaggcaagtgcatcaagcctgtgtatggctggatcgtggctgatgactgtgatgaaacagaggacaagctgtggaagtgggtgtcccagcacaggctcttccacctgcacagccagaagtgcctgggcctggacatcaccaagtctgtgaatgagctgaggatgttcagctgtgacagcagcgccatgctgtggtggaagtgtgagcaccacagcctgtatggagctgcccgctaccgcctggccctgaaggatggccatggaacagccatcagcaatgccagtgatgtgtggaagaagggcggcagcgaggagagcctgtgtgaccagccctaccacgagatctacaccagagatggcaacagctatggccggccctgtgagttccccttcctgattgatggcacctggcaccacgactgcatcctggatgaggaccacagcggcccctggtgtgccaccaccctgaactatgaatatgacaggaagtggggcatctgcctgaagccagaaaatggctgtgaggacaactgggagaagaatgagcagtttggcagctgctaccagttcaacacccagacagccctgtcctggaaggaggcctacgtgtcctgccagaaccagggcgctgacctgctgagcatcaacagcgctgctgagctgacctacctgaaggagaaggagggcatcgccaagatcttctggattggcctgaaccagctgtacagcgcccggggctgggagtggagcgaccacaagcccctgaacttcctgaactgggaccctgaccggcccagcgcccccaccatcggcggcagcagctgtgccaggatggatgctgagagcggcctgtggcagagcttcagctgtgaggcccagctgccctacgtgtgcaggaagcccctgaacaacacagtggagctgacagatgtgtggacctacagcgacacccgctgtgatgctggctggctgcccaacaacggcttctgctacctgctggtgaatgaaagcaacagctgggacaaggcccacgccaagtgcaaggccttcagcagtgacctgatcagcatccacagcctggctgatgtggaggtggtggtgaccaagctgcacaatgaagacatcaaggaggaggtgtggattggcctgaagaacatcaacatccccaccctcttccagtggagcgatggaacagaggtgaccctgacctactgggatgaaaatgagcccaacgtgccctacaacaagacccccaactgtgtgtcctacctgggggagctgggccagtggaaggtgcagagctgtgaggagaagctgaagtatgtgtgcaagaggaagggggagaagctgaatgatgccagcagtgacaagatgtgccccccagatgagggctggaagagacatggagagacctgctacaagatctatgaagatgaggtgcccttcggcaccaactgcaacctgaccatcaccagcagatttgagcaggagtacctgaatgacctgatgaagaagtatgacaagagcctgaggaagtacttctggacaggcctgagagatgtggacagctgtggggagtacaactgggccaccgtgggcggcagaagaagagctgtgaccttcagcaactggaacttcctggagcccgccagccctgggggctgtgtggccatgagcacaggcaagtctgtgggcaagtgggaggtgaaggactgccgctccttcaaggccctgagcatctgcaagaagatgagcggccccctgggccctgaggaggccagccccaagccagatgacccctgcccagagggctggcagagcttccctgccagcctgagctgctacaaggtgttccacgccgagagaattgtgaggaagaggaactgggaggaggccgagcgcttctgccaggccctgggcgcccacctgagcagcttcagccacgtggatgagatcaaggagttcctgcacttcctgacagaccagttcagcggccagcactggctgtggattggcctgaacaagaggagcccagacctgcagggctcctggcagtggagcgacaggacccctgtgtccaccatcatcatgcccaatgagttccagcaggactatgacatccgggactgtgccgctgtgaaggtgttccaccggccctggaggcggggctggcacttctatgatgaccgggagttcatctacctgcggccctttgcctgtgacaccaagctggagtgggtgtgccagatccccaagggccgcacccccaagaccccagactggtacaacccagacagagctggcatccacggccccccactcatcatcgagggcagcgagtactggtttgtggccgacctgcacctgaactatgaggaggccgtgctgtactgtgccagcaaccacagcttcctggccaccatcaccagctttgtgggcctgaaggccatcaagaacaagatcgccaacatctctggagatggccagaagtggtggatccgcatcagcgagtggcccattgatgaccacttcacctacagccgctacccctggcaccgcttccctgtgaccttcggggaggagtgcctgtacatgtctgccaagacctggctgattgacctgggcaagcccacagactgcagcaccaagctgcccttcatctgtgagaagtacaacgtgagcagcctggagaagtacagcccagattctgctgccaaggtgcagtgcagcgagcagtggatccccttccagaacaagtgcttcctgaagatcaagcctgtgtccctgaccttcagccaggccagtgacacctgccacagctatggaggcaccctgcccagcgtgctgagccagatcgagcaggacttcatcaccagcctgctgcctgacatggaggccaccctgtggattggcctgcgctggacagcctatgagaagatcaacaagtggacagacaaccgggagctgacctacagcaacttccaccccctgctggtgtctggccgcctgcgcatccctgagaacttctttgaggaggagagccgctaccactgtgccctgatcctgaacctgcagaagagccccttcaccggcacctggaacttcaccagctgcagcgagcggcactttgtgtccctgtgccagaagtacagcgaggtgaagagccggcagaccctgcagaatgccagcgagaccgtgaagtacctgaacaacctgtacaagatcatccccaagaccctgacctggcacagcgccaagcgggagtgcctgaagagcaacatgcagctggtgtccatcacagacccctaccagcaggccttcctgtctgtgcaggccctgctgcacaacagcagcctgtggattggcctcttcagccaggatgatgagctgaactttggctggagcgatggcaagaggctgcacttcagccgctgggccgagaccaacggccagctggaggactgtgtggtgctggacacagatggcttctggaagacagtggactgcaatgacaaccagcccggggccatctgctactacagcggaaatgaaacagagaaggaggtgaagcctgtggacagcgtgaagtgccccagccctgtgctgaacaccccctggatccccttccagaactgctgctacaacttcatcatcaccaagaacagacacatggccaccacccaggatgaggtgcacaccaagtgccagaagctgaaccccaagagccacatcctgagcatcagagatgagaaggagaacaactttgtgctggagcagctgctgtacttcaactacatggcctcctgggtgatgctgggcatcacctacagaaacaagagcctgatgtggtttgacaagacccccctgagctacacccactggagggctggccggcccaccatcaagaatgagaagttcctggccggcctgagcacagatggcttctgggacatccagaccttcaaggtgattgaggaggccgtgtacttccaccagcacagcatcctggcctgcaagattgagatggtggactacaaggaggagtacaacaccaccctgccccagttcatgccctatgaagatggcatctacagcgtcatccagaagaaggtgacctggtatgaggccctgaacatgtgcagccagagcggcggccacctggcctctgtgcacaaccagaatggccagctgttcctggaggacatcgtgaagagagatggcttccccctgtgggtgggcctgagcagccatgatggcagcgagagcagctttgagtggagcgatggcagcacctttgactacatcccctggaagggccagaccagccctggcaactgtgtgctgctggaccccaagggcacctggaagcatgagaagtgcaacagcgtgaaggatggagccatctgctacaagcccaccaagagcaagaagctgagccggctgacctacagcagccgctgcccagctgccaaggaaaatggcagccgctggatccagtacaagggccactgctacaagagtgaccaggccctgcacagcttcagcgaggccaagaagctgtgcagcaagcatgaccacagcgccaccatcgtgtccatcaaggatgaagatgagaacaagtttgtgtcccggctgatgagggagaacaacaacatcaccatgagggtgtggctgggcctgagccagcacagcgtggactgccccagcagcacctggatccagttccaggacagctgctacatcttcctgcaggaggccatcaaggtggagagcattgaagatgtgaggaaccagtgcacagaccacggggctgacatgatcagcatccacaatgaggaggagaatgccttcatcctggacaccctgaagaagcagtggaagggcccagatgacatcctgctgggcatgttttatgacacagatgatgccagcttcaagtggtttgacaacagcaacatgacctttgacaagtggacagaccaggatgatgatgaggacctggtggacacctgtgccttcctgcacatcaagacaggagagtggaagaagggcaactgtgaggtgtcctctgtggagggcaccctgtgcaagacagccatcccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 39840 - DNA, 498 bp, Artificial Sequence
  Description of Artificial Sequence: Synthetic coding sequence
atggccctgctggccctgctgctggtggtggccctgccccgggtgtggacagatgccaacctgacagcccggcagagggaccctgaggacagccagaggacagatgaaggagacaacagagtgtggtgccacgtgtgtgaaagagagaacacctttgagtgccagaacccccggcgctgcaagtggacagagccctactgtgtgattgctgctgtgaagatcttcccccgcttcttcatggtggccaagcagtgcagcgctggctgtgccgccatggagcggcccaagccagaggagaagcgcttcctgctggaggagcccatgcccttcttctacctgaagtgctgcaagatccgctactgcaacctggagggcccccccatcaacagctctgtgttcaaggagtatgccggctccatgggagagagctgtggcggcctgtggctggccatcctgctgctgctggccagcattgctgctggcctgagcctgtcctag

SEQ ID NO: 39841 - DNA, 639 bp, Artificial Sequence
  Description of Artificial Sequence: Synthetic coding sequence
gactttggctactgcccccgggtgtactgtgagaaccagcccatgctgcccatcggcgtgctggtgatggtgggcttcaccgtgggcaaggtgcctgtgcctgacatccgcacctgccacttctgcctggtggaggaccccagcgtgggctgcatcagcggcagcgagaagtgcaccatcagcagcagcagcctgtgcatggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgtgcaggatgtacctgttcctgaacagcagcggcctgctggtgctgccccaggccggcctgctgaccccccaccccagctag

SEQ ID NO: 39842 - DNA, 639 bp, Artificial Sequence
  Description of Artificial Sequence: Synthetic coding sequence
gactttggctactgcccccgggtgtactgtgagaaccagcccatgctgcccatcggcgtgctggtgatggtgggcttcaccgtgggcaaggtgcctgtgcctgacatccgcacctgccacttctgcctggtggaggaccccagcgtgggctgcatcagcggcagcgagaagtgcaccatcagcagcagcagcctgtgcatggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgcggaggatgtacctgttcctgaacagcagcggcctgctggtgctgccccaggccggcctgctgaccccccaccccagctag

SEQ ID NO: 39843 - DNA, 687 bp, Artificial Sequence
  Description of Artificial Sequence: Synthetic coding sequence
atgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggcatcgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctactttggaacaggcttcccccacatgctgttcatggtgcaccctgagtaccggcccaagaggcctgccaaccagtttgtgcccagcagctgcagccgccacccagatgtgcccctgctgccccggcggcggcccttctgcaggatgcacttccggctgcgggaggtgtaccaccagcagctgatccctgtgcacggggaccaccacctgctgtag

SEQ ID NO: 39844 - DNA, 639 bp, Artificial Sequence; identical to SEQ ID NO: 39842
  Description of Artificial Sequence: Synthetic coding sequence

SEQ ID NO: 39845 - DNA, 639 bp, Artificial Sequence; identical to SEQ ID NO: 39841
  Description of Artificial Sequence: Synthetic coding sequence

SEQ ID NO: 39846 - DNA, 687 bp, Artificial Sequence; identical to SEQ ID NO: 39843
  Description of Artificial Sequence: Synthetic coding sequence

SEQ ID NO: 39847 - DNA, 606 bp, Artificial Sequence
  Description of Artificial Sequence: Synthetic coding sequence
atgaaggtgcacatgctggtgggcgtgctggtgatggtgggcttcaccgtgggcaaggtgcctgtgcctgacatccgcacctgccacttctgcctggtggaggaccccagcgtgggctgcatcagcggcagcgagaagtgcaccatcagcagcagcagcctgtgcatggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgtgcaggatgtacctgttcctgaacagcagcggcctgctggtgctgccccaggccggcctgctgaccccccaccccagctag

SEQ ID NO: 39848 - DNA, 606 bp, Artificial Sequence; identical to SEQ ID NO: 39847
  Description of Artificial Sequence: Synthetic coding sequence

SEQ ID NO: 39849 - DNA, 303 bp, Artificial Sequence
  Description of Artificial Sequence: Synthetic coding sequence
atgggcaccagcagcatcttcctgtgtgtgctcttcctgtgtggggccctgggcctgaccatgagccctgcccggggccgcctgcgctgctacatctgtggcttcaccaagccctgccaccctgtgcccacagaatgtagagatgatgaggcctgtggcatcagcatcggcaccagcggccgcaccctggtgcagtggcccttcagccggcggctgcccaccagcatccacccagccttccctgtggccccagccagcgcctgcctcttccaccccacagaccagagcgagatcacagaatag

SEQ ID NO: 39850 - DNA, 378 bp, Artificial Sequence
  Description of Artificial Sequence: Synthetic coding sequence
atgggcaccagcagcatcttcctgtgtgtgctcttcctgtgtggggccctgggcctgaccatgagccctgcccggggccgcctgcgctgctacatctgtggcttcaccaagccctgccaccctgtgcccacagaatgtagagatgatgaggcctgtggcatcagcatcggcaccagcggcaagagctgcctgagccgggcccagtgccccctgcccggctacgccacctactggctgcacagctacaccctgtggcaccactgctgtgagcaggacctgtgcaacattgctgccagcccccagcagctgaccagcctgctggccagcctgcccctgtttgtggccagctttgctggccggggccacctgctgcactag

SEQ ID NO: 39851 - DNA, 303 bp, Artificial Sequence; identical to SEQ ID NO: 39849
  Description of Artificial Sequence: Synthetic coding sequence

SEQ ID NO: 39852 - DNA, 201 bp, Artificial Sequence
  Description of Artificial Sequence: Synthetic coding sequence
atgggcaccagcagcatcttcctgtgtgtgctcttcctgtgtggggccctgggcctgaccatgagccctgcccggggccgcctgcgctgctacatctgtggcttcaccaagccctgccaccctgtgcccacagaatgtagagatgatgaggcctgtggcatcagcatcggcaccagtgaccagagcgagatcacagaatag

SEQ ID NO: 39853 - DNA, 201 bp, Artificial Sequence; identical to SEQ ID NO: 39852
  Description of Artificial Sequence: Synthetic coding sequence

SEQ ID NO: 39854 - DNA, 201 bp, Artificial Sequence; identical to SEQ ID NO: 39852
  Description of Artificial Sequence: Synthetic coding sequence

SEQ ID NO: 39855 - DNA, 303 bp, Artificial Sequence; identical to SEQ ID NO: 39849
  Description of Artificial Sequence: Synthetic coding sequence

SEQ ID NO: 39856 - DNA, 303 bp, Artificial Sequence; identical to SEQ ID NO: 39849
  Description of Artificial Sequence: Synthetic coding sequence

SEQ ID NO: 39857 - DNA, 201 bp, Artificial Sequence; identical to SEQ ID NO: 39852
  Description of Artificial Sequence: Synthetic coding sequence

SEQ ID NO: 39858 - DNA, 201 bp, Artificial Sequence; identical to SEQ ID NO: 39852
  Description of Artificial Sequence: Synthetic coding sequence

SEQ ID NO: 39859 - DNA, 303 bp, Artificial Sequence; identical to SEQ ID NO: 39849
  Description of Artificial Sequence: Synthetic coding sequence

SEQ ID NO: 39860 - DNA, 201 bp, Artificial Sequence; identical to SEQ ID NO: 39852
  Description of Artificial Sequence: Synthetic coding sequence

SEQ ID NO: 39861 - DNA, 303 bp, Artificial Sequence; identical to SEQ ID NO: 39849
  Description of Artificial Sequence: Synthetic coding sequence

SEQ ID NO: 39862 - DNA, 387 bp, Artificial Sequence
  Description of Artificial Sequence: Synthetic coding sequence
atgggcaccagcagcatcttcctgtgtgtgctcttcctgtgtggggccctgggcctgaccatgagccctgcccggggccgcctgcgctgctacatctgtggcttcaccaagccctgccaccctgtgcccacagaatgtagagatgatgaggcctgtggcatcagcatcggcacctctgtgaagaagctgcccctgaagggccctgtgcccagcgcccggctgtgccacctgctggccgccctgctgcacagcgtggcccccctgctgcgggccggccctgtgcagcacagccgcttccccacagctgcccaccagcccccccggctgcctgcccccctgtgtggccagctgcgctgggagaggaccccaccacccctggccagctag

SEQ ID NO: 39863 - DNA, 378 bp, Artificial Sequence; identical to SEQ ID NO: 39850
  Description of Artificial Sequence: Synthetic coding sequence

SEQ ID NO: 39864 - DNA, 378 bp, Artificial Sequence; identical to SEQ ID NO: 39850
  Description of Artificial Sequence: Synthetic coding sequence

SEQ ID NO: 39865 - DNA, 378 bp, Artificial Sequence; identical to SEQ ID NO: 39850
  Description of Artificial Sequence: Synthetic coding sequence

SEQ ID NO: 39866 - DNA, 378 bp, Artificial Sequence; identical to SEQ ID NO: 39850
  Description of Artificial Sequence: Synthetic coding sequence

SEQ ID NO: 39867 - DNA, 378 bp, Artificial Sequence; identical to SEQ ID NO: 39850
  Description of Artificial Sequence: Synthetic coding sequence

SEQ ID NO: 39868 - DNA, 378 bp, Artificial Sequence; identical to SEQ ID NO: 39850
  Description of Artificial Sequence: Synthetic coding sequence

SEQ ID NO: 39869 - DNA, 894 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgcaccgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggaagagatgccagcatcccccagttcaagccagagatccaggtgtatgagaacatccacctggcccggctgggccccccagcccacaagcccaggtag

SEQ ID NO: 39870 - DNA, 894 bp, Artificial Sequence; identical to SEQ ID NO: 39869
  Description of Artificial Sequence: Synthetic coding sequence

SEQ ID NO: 39871 - DNA, 1149 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgcaccgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggccggggcaacaggatgcgctgctacaactgtggcggcagccccagcagcacctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagaatctgtgggagatgtgacctacccagcccaccgggactgctacctgggggacctgtgcaacagcgctgtggccagccacgtggccccagctggcatcctggccgccgccgccacagccctgacctgcctgctgcccggcctgtggagcggctag

SEQ ID NO: 39872 - DNA, 237 bp, Artificial Sequence; identical to SEQ ID NO: 36492
  Description of Artificial Sequence: Synthetic coding sequence

SEQ ID NO: 39873 - DNA, 1572 bp, Artificial Sequence
  Description of Artificial Sequence: Synthetic coding sequence
atggagaccatgaagagcaaggccaactgtgcccagaaccccaactgcaacatcatgatcttccaccccaccaaggaggagttcaatgactttgacaagtacatcgcctacatggagagccagggcgcccaccgggccggcctggccaagatcatcccccccaaggagtggaaggcccgggagacctatgacaacatcagcgagatcctgattgccacccccctgcagcaggtggccagcggccgggccggggtcttcacccagtaccacaagaagaagaaggccatgacagtgggggagtaccgccacctggccaacagcaagaagtaccagaccccaccccaccagaactttgaggacctggagaggaagtactggaagaaccgcatctacaacagccccatctacggggctgacatcagcggcagcctgtttgatgagaacaccaagcagtggaacctgggccacctgggcaccatccaggacctgctggagaaggaatgtggggtggtgattgagggcgtgaacaccccctacctgtacttcggcatgtggaagaccacctttgcctggcacacagaggacatggacctgtacagcatcaactacctgcacctgggggagcccaagacctggtacgtggtgcccccagagcacggccagaggctggagcggctggcccgggagctgtttcctggcagcagccggggctgtggggccttcctgcggcacaaggtggccctgatcagccccaccgtgctgaaggaaaatggcatccccttcaaccgcatcacccaggaggccggggagttcatggtgaccttcccctacggctaccacgccggcttcaaccacggcttcaactgtgccgaggccatcaactttgccaccccccgctggattgattatggcaagatggccagccagtgcagctgtggggaggcccgggtgaccttctccatggatgcctttgtgcgcatcctgcagcctgagagatatgacctgtggaagaggggccaggacagagctgtggtggaccacatggagccccgggtgcctgccagccaggagctgagcacccagaaggaggtgcagctgccccggcgggccgccctgggcctgcggcagctgcccagccactgggcccggcacagcccctggcccatggccgcccggagcggcacccgctgccacaccctggtgtgcagcagcctgcccaggagatctgctgtgtctggaacagccacccagcccagggctgctgctgtgcacagcagcaagaagcccagcagcacccccagcagcaccccaggccccagcgcccagatcatccaccccagcaatggccggcggggccggggccggcccccccagaagctgcgggcccaggagctgaccctgcagaccccagccaagaggcccctgctggccggcaccacctgcacagccagcggccctgagcctgagcccctgcctgaagatggagccctgatggacaagcctgtgcccctgagccctggcctgcagcaccctgtgaaggccagcggctgctcctgggcccctgtgccctag

SEQ ID NO: 39874 - DNA, 780 bp, Artificial Sequence
  Description of Artificial Sequence: Synthetic coding sequence
atgaagcacagcaagaagacctatgacagcttccaggatgagctggaggactacatcaaggtgcagaaggcccggggcctggagcccaagacctgcttcaggaagatgaagggggactacctggagacctgtggctacaagggggaggtgaacagccggcccacctacaggatgtttgaccagaggctgcccagcgagaccatccagacctaccccaggagctgcaacatcccccagacagtggagaaccggctgccccagtggctgcctgcccatgacagccggctgcggctggacagcctgagctactgccagttcacccgggactgcttcagcgagaagcctgtgcccctgaacttcaaccagcaggagtacatctgtggcagccacggcgtggagcaccgggtgtacaagcacttcagcagtgacaacagcaccagcacccaccaggccagccacaagcagatccaccagaagaggaagaggcaccctgaggagggccgggagaagtctgaggaggagaggagcaagcacaagaggaagaagagctgtgaggagattgacctggacaagcacaagagcatccagaggaagaagacagaggtggagattgagaccgtgcacgtgtccacagagaagctgaagaacaggaaggagaagaagagcagagatgtggtgtccaagaaggaggagaggaagaggaccaagaagaagaaggagcagggccaggagaggacagaggaggagatgctgtgggaccagagcatcctgggcttctag

SEQ ID NO: 39875 - DNA, 684 bp, Artificial Sequence
  Description of Artificial Sequence: Synthetic coding sequence
atggccagccccagccggcagcccccacctgggggcagcggcctgctgcagggcagccgggcccggagctatggcagcctggtgcagagcgcctgcagccctgtgcgggagcggcggctggagcaccagctggagcccggggacaccctggccggcctggccctgaagtatggagtgaccatggagcagatcaagagggccaaccggctgtacaccaatgacagcatcttcctgaagaagaccctgtacatccccatcctgacagagccccgggacctcttcaacggcctggacagcgaggaggagaaggatggagaggagaaggtgcaccccagcaacagcgaggtgtggccccacagcacagagaggaagaagcaggagaccggggccggccgggccaacggggaggtgctgcccaccccaggccaggagacccccacccccatccatgacctgagcgccagtgacttcctgaagaagctggacagccagatcagcctgagcaagaaggccgccgcccagaagctgaagaagggggagaatggagtgcctggagaagatgctggcctgcacctgagcagcccctggatgcagcagagagctgtgctgggccctgtgcccctgaccaggaccagcaggaccaggaccctgcgggaccaggaggatgagatcttcaagctgtag

SEQ ID NO: 39876 - DNA, 540 bp, Artificial Sequence
  Description of Artificial Sequence: Synthetic coding sequence
atgaggagcggccccctgcgcatcagcgagtggaagatggagcagatcaagagggccaaccggctgtacaccaatgacagcatcttcctgaagaagaccctgtacatccccatcctgacagagccccgggacctcttcaacggcctggacagcgaggaggagaaggatggagaggagaaggtgcaccccagcaacagcgaggtgtggccccacagcacagagaggaagaagcaggagaccggggccggccgggccaacggggaggtgctgcccaccccaggccaggagacccccacccccatccatgacctgagcgccagtgacttcctgaagaagctggacagccagatcagcctgagcaagaaggccgccgcccagaagctgaagaagggggagaatggagtgcctggagaagatgctggcctgcacctgagcagcccctggatgcagcagagagctgtgctgggccctgtgcccctgaccaggaccagcaggaccaggaccctgcgggaccaggaggatgagatcttcaagctgtag

SEQ ID NO: 39877 - DNA, 648 bp, Artificial Sequence
  Description of Artificial Sequence: Synthetic coding sequence
atggctgacagcagccctgccctgagcctgcgggagggcggcccccgggccccccggcccagcgcccccagccccccacccaggagccgcagcggcagcgagagcgaggaggccgagctgagcctgagcctggcccggaccaagaccaggagctatggcagcacagcctctgtgcgggcccccctgggcgctggggtgattgagcggcacgtggagcaccgggtgcgggccggggacaccctgcagggcatcgccctgaagtatggagtgaccatggagcagatcaagagggccaacaagctgttcaccaatgactgcatcttcctgaagaagaccctgaacatccctgtgatcagcgagaagcccctgctcttcaacggcctgaacagcattgacagcccagaaaatgaaacagctgacaacagcttcagccaggaggaggagcctgtggtggccggggaggacctgcccccacccagcccccaggagagtgatgtgcagcctgtgcagcctgaggaggtgtctgcccgggacttcctgcagaggctggacctgcagatcaagctgagcacccaggccgccaagaagctgaaggaggagagcagagatgaggagagcccctatgccaccagcctgtaccacagctag

SEQ ID NO: 39878 - DNA, 375 bp, Artificial Sequence
  Description of Artificial Sequence: Synthetic coding sequence
atggagcagatcaagagggccaacaagctgttcaccaatgactgcatcttcctgaagaagaccctgaacatccctgtgatcagcgagaagcccctgctcttcaacggcctgaacagcattgacagcccagaaaatgaaacagctgacaacagcttcagccaggaggaggagcctgtggtggccggggaggacctgcccccacccagcccccaggagagtgatgtgcagcctgtgcagcctgaggaggtgtctgcccgggacttcctgcagaggctggacctgcagatcaagctgagcacccaggccgccaagaagctgaaggaggagagcagagatgaggagagcccctatgccaccagcctgtaccacagctag

SEQ ID NO: 39879 - DNA, 375 bp, Artificial Sequence; identical to SEQ ID NO: 39878
  Description of Artificial Sequence: Synthetic coding sequence

SEQ ID NO: 39880 - DNA, 495 bp, Artificial Sequence
  Description of Artificial Sequence: Synthetic coding sequence
atgaagatggtgatgcccagctggtttgacctgatgggcctgagcccagatgccccagaagatgaagctggcatcaagaaggctgctgagaacatcaaggccctgattgagcacgagatgaagaatggcatcccagccaacagaattgtgctgggcggcttcagccagggcggggccctgagcctgtacacagccctgacctgcccccaccccctggccggcatcgtggccctgagctgctggctgcccctgcaccgggccttcccccaggccgccaatggaagtgccaaggacctggccatcctgcagtgccacggggagctggaccccatggtgcctgtgcgctttggagccctgacagctgagaagctgcggtctgtggtgaccccagcccgggtgcagttcaagacctacccaggagtgatgcacagcagctgcccccaggagatggctgctgtgaaggagttcctggagaagctgctgccccctgtgtag

SEQ ID NO: 39881 - DNA, 543 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggcatcaagaaggctgctgagaacatcaaggccctgattgaacatgagatgaagaatggcatcccagccaaccgcatcgtgctgggcggcttcagccagggcggggccctgagcctgtacacagccctgacctgcccccaccccctggccggcatcgtggccctgagctgctggctgcccctgcaccgggccttcccccaggtgaatgtgcccacagaccccccagccctgtgtgtgtgcatcctggtggcctggggcctgctgcagcactag

SEQ ID NO: 39882 - DNA, 549 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggcatcaagaaggctgctgagaacatcaaggccctgattgaacatgagatgaagaatggcatcccagccaaccgcatcgtgctgggcggcttcagccagggcggggccctgagcctgtacacagccctgacctgcccccaccccctggccggcatcgtggccctgagctgctggctgcccctgcaccgggccttcccccagggccctgtgcaggacatccctggctgccacgcccagctgctgagcagtggagatggcagctgtgagggcatctcctag

SEQ ID NO: 39883 - DNA, 414 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggcatcaagaaggccgcagaaaatagaagaggccctgtgcccctgcacggcccccacctgcccccacccagcggctggcacagaggagtggagctgctggccgccagcgcccctggcctgcccccaggagagtgcccccactag

SEQ ID NO: 39884 - DNA, 627 bp, Artificial Sequence
  Description of Artificial Sequence: Synthetic coding sequence
atgctgcccccctgcctggagctgagcggcaagaggcccaggcacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaagctggcatcaagaaggctgctgagaacatcaaggccctgattgagcacgagatgaagaatggcatcccagccaacagaattgtgctgggcggcttcagccagggcggggccctgagcctgtacacagccctgacctgcccccaccccctggccggcatcgtggccctgagctgctggctgcccctgcaccgggccttcccccaggccgccaatggaagtgccaaggacctggccatcctgcagtgccacggggagctggaccccatggtgcctgtgcgctttggagccctgacagctgagaagctgcggtctgtggtgaccccagcccgggtgcagttcaagacctacccaggagtgatgcacagcagctgcccccaggagatggctgctgtgaaggagttcctggagaagctgctgccccctgtgtag

SEQ ID NO: 39885 - DNA, 696 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggcatcaagaaggctgctgagaacatcaaggccctgattgaacatgagatgaagaatggcatcccagccaaccgcatcgtgctgggcggcttcagccagggcggggccctgagcctgtacacagccctgacctgcccccaccccctggccggcatcgtggccctgagctgctggctgcccctgcaccgggccttcccccaggccgccaacggcagcgccaaggacctggccatcctgcagtgccacggggagctggaccccatggtgcctgtgcgctttggagccctgacagctgagaagctgcggtctgtggtgaccccagcccgggtgcagttcaagacctacccaggagtgatgcacagcagctgcccccaggagatggctgctgtgaaggagttcctggagaagctgctgccccctgtgtag

SEQ ID NO: 39886 - DNA, 405 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggcatcaagaaggccgcagaaaatagaagaggccctgtgcccctgcacggcccccacctgcccccacccagcggctggcacagaggagtggagctgctggccgccagcgcccctggcctgcccccaggcagctag

SEQ ID NO: 39887 - DNA, 489 bp, Artificial Sequence
  Description of Artificial Sequence: Synthetic coding sequence
atgctgcccccctgcctggagctgagcggcaagaggcccaggcacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaagctggcatcaagaaggctgctgagaacatcaaggccctgattgagcacgagatgaagaatggcatcccagccaacagaattgtgctgggcggcttcagccagggcggggccctgagcctgtacacagccctgacctgcccccaccccctggccggcatcgtggccctgagctgctggctgcccctgcaccgggccttcccccaggccgccaatggaagtgccaaggacctggccatcctgcagtgccacggggagctggaccccatggtgcctgtgcgctttggagcctag

SEQ ID NO: 39888 - DNA, 276 bp, Artificial Sequence
  Description of Artificial Sequence: Synthetic coding sequence
atgtgtggcaacaccatgtctgtgcccctgctgacagatgctgccaccgtgtctggagctgagcgggagacagctgctgtgatcttcctgcacggcctgggggacaccggccacagctgggcagatgccctgagcaccatccggctgccccacgtgaagtacatctgcccccacgccccccgcatccctgtgaccctgaacatgaagatggtgatgcccagctggtttgacctgatgggcctgagcccagatgccccagaagatgaggccggctag

SEQ ID NO: 39889 - DNA, 1476 bp, Artificial Sequence
  Description of Artificial Sequence: Synthetic coding sequence
atgaagatggccgcccccacagccaacaaggccgccagcctgggctgcaacaacaagccagccttccctgagctggacttccgcagcggggcccgggtggaggagctgaacaagctgatccaggagttcaccaagcatgaccagcgggagtatgatgaccagagggccctggagatccacacagccaaggacttcatcttctccatgctgggcatggtgcagaagctggaccagaagctgcctgtggccaatgagtacctgctgctgagcggcggcgtgcgggagggcgtggtggacctggacctggatgagctgaatgtgtatgcccggggcacagattatgacatggacttcaccctgctggtgcctgccctgaagctgcatgacaggaaccagcctgtgaccctggacatgaggcacagcgccctgtgccacagctggctgagcctgcggctgtttgatgagggcaccatcagcaagtggaaggactgctgcaccatcgtggaccacatcaacggggccaccaactacttcttcagccccaccaaggtggccgactggttctatgacagcatcagcatcgtgctgtctgagatccagaagaagccccagaggggcatgcccaaggtggagaaggtggagaagaatggcaccatcatcagcatcatcctgggcgtgggcagcagcaggatgctgtatgacatcgtgcctgtggtgtccttcaagggctggccagctgtggcccagagctggctgatggagaaccacttctgggatggcaagatcacagaggaggaggtgatcagcggcttctacctggtgcctgcctgcagctacaagggcaagaaggacaatgagtggaggctgagctttgcccggtctgaggtgcagctgaagaagtgcatcagcagcagcctgatgcaggcctaccaggcctgcaaggccatcatcatcaagctgctgagccggcccaaggccatcagcccctaccacctgcgctccatgatgctgtgggcctgtgaccggctgcctgccaactacctggcccaggaggactatgctgcccacttcctgctgggcctgattgatgacctgcagcactgcctggtgaacaagatgtgccccaactacttcatcccccagtgcaacatgctggagcacctgtctgaggagaccgtgatgctgcacgccaggaagctgagctctgtgcggagtgaccctgctgagcacctgaggacagccattgaacatgtgaaggccgccaaccggctgaccctggagctgcagaggcggggcagcaccaccagcatccccagcccccagagtgatggaggagaccccaaccagccagatgaccggctggccaagaagctgcagcagctggtgacagagaaccctgggaagagcatctctgtgttcatcaacccagatgatgtgacccggccccacttcagaattgatgacaagttcttctag

SEQ ID NO: 39890 - DNA, 1089 bp, Artificial Sequence
  Description of Artificial Sequence: Synthetic coding sequence
atgaagtacctgactgtgggggacctggaggactgcctgctgaacaaggtggacctgcggcggcagcagatcagccaggccgtggaggaggtgcagaaggtggtgcaccacctgaccaccaacatcagcaaccaggacatccgcttccaggccgtgccctacagcgacacctacaatgaaaacatcaaggtgctggcccccagccagttcctggtgacagtgcccatcaagggcctggccggctaccgggaggcccgggagcagcactggagatactacaccctgcagggcacccggctgccctgccccctgcgggaccctgagggcctgcagcagtggctggaggtggagcagttcatgaagagcctgtggcagtggcatgaaacagatgtgaacattgatggagacatcgtgcctgccaaggtgctgctggtgttcaggaagctggtggagaatgctgtgaggacctgccacctgagcggcaaggtgtccctgctgggcaacagatctgctgtgtgggtggccgtggagaccagcgcctaccaggtggagctggagctggtgcctgctgtggagatccccaccacctggagcaagaaggcccgctggccccgctgcctgcagcgctggcccagccaggagcgggtggagtgcatcaagagctttggcttcaacctgctggcctgcagcaactaccactggcagctgtccttcctgcgggcagagcaggtgctgctggagcagctggatgaagatggcggctgcaggaggaagtgcttccaggtgatgaggcacctgaaggaggacatctggtgccccggcaacagacctgtgatcaccagccaccacctgcagacagtgctcttctggacctgtgagaagtacccccacttcaaggactggcaggtgttcagcaaggccttcctgcggctggtgaggaagctgcacaagtgtgtgtcccagcacttcctgaagcactactttgtgaggaacagcaacctcttccagtgcaccaaccccacagagctggacacagtggcccagaagctggccaccttcctgaagaacccccagatcggccccccatag

SEQ ID NO: 39891 - DNA, 4371 bp, Artificial Sequence
  Description of Artificial Sequence: Synthetic coding sequence
atgaggctgcccctgctgctggtgtttgccagcgtcatccctggagctgtgctgctgctggacacccggcagttcctgatctacaatgaagaccacaagagatgtgtggatgctgtgagccccagcgctgtgcagacagctgcctgcaaccaggatgctgagagccagaagttccgctgggtgtctgagagccagatcatgtctgtggccttcaagctgtgcctgggcgtgcccagcaagacagactgggtggccatcaccctgtatgcctgtgacagcaagtctgagttccagaagtgggagtgcaagaatgacaccctgctgggcatcaagggagaagatctcttcttcaactacggcaaccggcaggagaagaacatcatgctgtacaagggcagcggcctgtggagccgctggaagatctacggcaccacagacaacctgtgcagccggggctatgaggccatgtacaccctgctgggcaatgccaacggggccacctgtgccttccccttcaagtttgagaacaagtggtacgccgactgcaccagcgctggccgcagtgatggctggctgtggtgtggcaccaccacagattatgacacagacaagctgtttggctactgccccctgaagtttgagggcagcgagagcctgtggaacaaggaccccctgacctctgtgtcctaccagatcaacagcaagagcgccctgacctggcaccaggccaggaagagctgccagcagcagaatgctgagctgctgagcatcacagagatccacgagcagacctacctgaccggcctgaccagcagcctgaccagcggcctgtggattggcctgaacagcctgtccttcaacagcggctggcagtggagcgacaggagccccttccgctacctgaactggctgcccggcagccccagcgctgagcccgggaagagctgtgtgtccctgaaccctgggaagaatgccaagtgggagaacctggagtgtgtgcagaagctgggctacatctgcaagaagggcaacaccaccctgaacagctttgtgatccccagcgagagtgatgtgcccacccactgccccagccagtggtggccctatgccggccactgctacaagatccacagagatgagaagaagatccagagagatgccctgaccacctgcaggaaggagggcagtgacctggccagcatccacaccatcgaggagtttgacttcatcatcagccagctgggctatgagcccaatgatgagctgtggattggcctgaatgacatcaagatccagatgtactttgagtggagcgatggcacccctgtgaccttcaccaagtggctgcggggggagcccagccatgagaacaaccggcaggaggactgtgtggtgatgaagggcaaggatggctactgggccgaccggggctgtgagtggcccctgggctacatctgcaagatgaagagccgcagccagggccctgagatcgtggaggtggagaagggctgcaggaagggctggaagaagcaccacttctactgctacatgattggccacaccctgagcacctttgctgaggccaaccagacctgcaacaatgaaaatgcctacctgaccaccattgaagatagatatgagcaggccttcctgaccagctttgtgggcctgcggcctgagaagtacttctggacaggcctgagtgacatccagaccaagggcaccttccagtggaccatcgaggaggaggtgcgcttcacccactggaacagcgacatgcctggcaggaagccaggctgtgtggccatgaggactggaattgctgggggcctgtgggatgtgctgaagtgtgatgagaaggccaagtttgtgtgcaagcactgggccgagggcgtgacccacccccccaagcccaccaccaccccagagcccaagtgcccagaggactggggcgccagcagcaggaccagcctgtgcttcaagctgtatgccaagggcaagcatgagaagaagacctggtttgagagccgggacttctgccgggccctgggcggggacctggccagcatcaacaacaaggaggagcagcagaccatctggaggctcatcacagccagcggcagctaccacaagctgttctggctgggcctgacctacggcagccccagcgagggcttcacctggagcgatggcagccctgtgtcctatgagaactgggcctatggagagcccaacaactaccagaatgtggagtactgtggggagctgaagggggaccccaccatgtcctggaatgacatcaactgtgagcacctgaacaactggatctgccagatccagaagggccagacccccaagccagagcccaccccagccccccaggacaacccccctgtgacagaagatggctgggtgatctacaaggactaccagtactacttcagcaaggagaaggagaccatggacaatgcccgggccttctgcaagaggaactttggagacctggtgtccatccagagcgagagcgagaagaagttcctgtggaagtatgtgaacagaaatgatgcccagagcgcctacttcatcggcctgctgatcagcctggacaagaagtttgcctggatggatggcagcaaggtggactatgtgtcctgggccactggagagcccaactttgccaatgaagatgagaactgtgtgaccatgtacagcaacagcggcttctggaatgacatcaactgtggctacccaaatgccttcatctgccagaggcacaacagcagcatcaatgccaccaccgtgatgcccaccatgcccagcgtgcccagcggctgcaaggagggctggaacttctacagcaacaagtgcttcaagatcttcggcttcatggaggaggagaggaagaactggcaggaggccaggaaggcctgcatcggctttggaggcaacctggtgtccatccagaatgagaaggagcaggccttcctgacctaccacatgaaggacagcaccttcagcgcctggacaggcctgaatgatgtgaacagcgagcacaccttcctgtggacagatggccggggcgtgcactacaccaactggggcaagggctacccaggcggcagaagaagcagcctgtcctatgaagatgctgactgtgtggtgatcatcggcggggccagcaatgaagctgggaagtggatggatgacacctgtgacagcaagaggggctacatctgccagaccaggagtgaccccagcctgaccaaccccccagccaccatccagacagatggctttgtgaagtatggcaagagcagctacagcctgatgaggcagaagttccagtggcatgaagctgagacctactgcaagctgcacaacagcctcatcgccagcatcctggacccctacagcaatgcctttgcctggctgcagatggagaccagcaatgaaagagtgtggatcgccctgaacagcaacctgacagacaaccagtacacctggacagacaagtggagggtgcgctacaccaactgggccgcagatgagcccaagctgaagagcgcctgtgtgtacctggacctggatggctactggaagacagcccactgcaatgaaagcttctacttcctgtgcaagagaagtgatgagatcccagccacagagcccccccagctgcccggccgctgcccagagagtgaccacacagcctggatccccttccacggccactgctactacatcgagagcagctacaccaggaactggggccaggccagcctggagtgcctgaggatgggcagcagcctggtgtccattgaatctgctgctgagagcagcttcctgagctacagagtggagcccctgaagagcaagaccaacttctggattggcctcttcagaaatgtggagggcacctggctgtggatcaacaacagccctgtgtcctttgtgaactggaacacaggagaccccagcggggagagaaatgactgtgtggccctgcacgccagcagcggcttctggagcaacatccactgcagcagctacaagggctacatctgcaagaggcccaagatcattgatgccaagcccacccatgagctgctgaccaccaaggctgacaccaggaagatggaccccagcaagcccagcagcaatgtggccggcgtggtgatcatcgtcatcctgctgatcctgactggagctggcctggccgcctacttcttctacaagaagagaagagtgcacctgccccaggagggcgcctttgagaacaccctgtacttcaacagccagagcagccctggcaccagtgacatgaaggacctggtgggcaacatcgagcagaatgagcacagcgtcatctag

SEQ ID NO: 39892 - DNA, 1497 bp, Artificial Sequence
  Description of Artificial Sequence: Synthetic coding sequence
atgaggctgcccctgctgctggtgtttgccagcgtcatccctggagctgtgctgctgctggacacccggcagttcctgatctacaatgaagaccacaagagatgtgtggatgctgtgagccccagcgctgtgcagacagctgcctgcaaccaggatgctgagagccagaagttccgctgggtgtctgagagccagatcatgtctgtggccttcaagctgtgcctgggcgtgcccagcaagacagactgggtggccatcaccctgtatgcctgtgacagcaagtctgagttccagaagtgggagtgcaagaatgacaccctgctgggcatcaagggagaagatctcttcttcaactacggcaaccggcaggagaagaacatcatgctgtacaagggcagcggcctgtggagccgctggaagatctacggcaccacagacaacctgtgcagccggggctatgaggccatgtacaccctgctgggcaatgccaacggggccacctgtgccttccccttcaagtttgagaacaagtggtacgccgactgcaccagcgctggccgcagtgatggctggctgtggtgtggcaccaccacagattatgacacagacaagctgtttggctactgccccctgaagtttgagggcagcgagagcctgtggaacaaggaccccctgacctctgtgtcctaccagatcaacagcaagagcgccctgacctggcaccaggccaggaagagctgccagcagcagaatgctgagctgctgagcatcacagagatccacgagcagacctacctgaccggcctgaccagcagcctgaccagcggcctgtggattggcctgaacagcctgtccttcaacagcggctggcagtggagcgacaggagccccttccgctacctgaactggctgcccggcagccccagcgctgagcccgggaagagctgtgtgtccctgaaccctgggaagaatgccaagtgggagaacctggagtgtgtgcagaagctgggctacatctgcaagaagggcaacaccaccctgaacagctttgtgatccccagcgagagtgatgtgcccacccactgccccagccagtggtggccctatgccggccactgctacaagatccacagagatgagaagaagatccagagagatgccctgaccacctgcaggaaggagggcagtgacctggccagcatccacaccatcgaggagtttgacttcatcatcagccagctgggctatgagcccaatgatgagctgtggattggcctgaatgacatcaagatccagatgtactttgagtggagcgatggcacccctgtgaccttcaccaagtggctgcggggggagcccagccatgagaacaaccggcaggaggactgtgtggtgatgaagggcaaggccggcgtgcagtggcacaacctgggctccatgcagcccctgccccgggagttcaagcgcttcagctgcctgagcctgcccagcagctag

SEQ ID NO: 39893 - DNA, 507 bp, Artificial Sequence
  Description of Artificial Sequence: Synthetic coding sequence
actggccagggcggcgtgcgcagcgcccctggcaccggcagaattgccttcccccccaaggccagccggggcagcaccaacacagcccacctgagcatcgccaacagctggcccaggtctgccagcaccccagagaccaggaccaagttcacccaggacaacctgtgccacgcccagcgggagcggctggacagcgccaacctgtgggtgctggtggactgcatcctgcgggacaccagcgaggacctgggcctgcagtgtgatgctgtgaacctggccttcggccgccgctgtgaggagctggaggatgcccggcacaagctgcagcaccacctgcacaaggtgggccaccctgagccccggcggcggctgcggcggctgcccaccaccctgcccccactcatcacctggccaggccccagcacccccttcagctctgtgcccctcatcccccgggaccccaggagcaagtgccacctgtctgtgaacctgtgcaagaccaggtag

SEQ ID NO: 39894 - DNA, 1941 bp, Artificial Sequence
  Description of Artificial Sequence: Synthetic coding sequence
atggagttccaggaggtgcagcagacccaggccctggcctggcaggcccagaaggcccccacccacatctggcagcccctgcctgcccaggaggcccagaggcaggccccacccctggtgcagctggagcagcccttccagggcgccccacccagccagaaggctgtgcagatccagctgcccccccagcaggcccaggccagcggcccccaggccgaggtgcccaccctgcccctgcagcccagctggcaggcccccccagctgtgctgcaggcccagcccggcccccctgtggccgccgccaacttccccctgggcagcgccaagagcctgatgaccccatctggagaatgtcgggccagcagcattgacagaagaggcagcagcaaggagaggaggaccagcagcaaggagcggcgggcccccagcaaggacaggatgatctttgctgccaccttctgtgcccccaaggctgtgtctgctgcccgggcccacctgcctgctgcctggaagaacctgcctgccaccccagagacctttgcccccagcagctctgtgtttcctgccaccagccagttccagcctgccagcctgaatgccttcaagggccccagcgctgccagcgagacccccaagagcctgccctatgccctgcaggacccctttgcctgtgtggaggccctgcctgctgtgccctgggtgccccagcccaacatgaatgccagcaaggccagccaggccgtgcccaccttcctgatggccacagctgctgccccccaggccacagccaccacccaggaggccagcaagacctctgtggagcccccaagaagaagtggcaaggccaccaggaagaagaagcacctggaggcccaggaggacagccggggccacaccctggccttccatgactggcagggcccccggccctgggagaacctgaacctgagtgactgggaggtgcagagccccatccaggtgtctggggactgggagcaccccaacaccccccggggcctgagcggctgggagggccccagcaccagccgcatcctgagcggctgggagggccccagcgcctcctgggccctgagcgcctgggagggccccagcaccagccgggccctgggcctgtctgagagccctggcagcagcctgcctgtggtggtgtctgaggtggcctctgtgtccccaggcagcagcgccacccaggacaacagcaaggtggaggcccagcccctgagccccctggatgagcgggccaatgccctggtgcagttcctgctggtgaaggaccaggccaaggtgcctgtgcagaggtctgagatggtgaaggtgatcctgcgggagtacaaggatgagtgcctggacatcatcaacagagccaacaacaagctggagtgtgccttcggctaccagctgaaggagattgacaccaagaaccacgcctacatcatcatcaacaagctgggctaccacacaggcaacctggtggccagctacctggaccggcccaagtttggcctgctgatggtggtgctgagcctcatcttcatgaagggcaactgtgtgcgggaggacctgatcttcaacttcctgttcaagctgggcctggatgtgcgggagaccaacggcctgtttggaaacaccaagaagctgatcacagaggtgtttgtgcggcagaagtacctggagtaccgccgcatcccctacacagagccagcagaatatgagttcctgtggggcccccgggccttcctggagaccagcaagatgctggtgctgcgcttcctggccaagctgcacaagaaggacccccagagctggcccttccactacctggaggccctggctgaatgtgagtgggaggacacagatgaagatgagccagacaccggggacagcgcccacggccccaccagccggcccccacccaggtag

SEQ ID NO: 39895 - DNA, 828 bp, Artificial Sequence
  Description of Artificial Sequence: Synthetic coding sequence
atgcccctgctgtggatcaccggcccccgctaccacctgatcctgctgtctgaggccagctgcctgcgggccaactacgtgcacctgtgccccctcttccagcaccgctggctggagacctgcaatgccccaccccagctgatccagggcaaggcccacagcgcccccaagcccagccaggccagcggccacttctctgtggagctggtgcggggctacgccggcttcggcctgaccctgggcggcggcagagatgtggccggggacacccccctggccgtgcggggcctgctgaaggatggccctgcccagagatgtggccgcctggaggtgggagatgtggtgctgcacatcaatggagagagcacccagggcctgacccacgcccaggccgtggagcgcatccgggccggcggcccccagctgcacctggtgatcagaagacccctggagacccaccctgggaagccccggggcgtgggggagcccaggaaaggagtggtgcccagctggccagacaggagcccagaccccggcggccctgaggtgacaggcagccgcagcagcagcaccagcctggtgcagcacccccccagcaggaccaccctgaagaagacccggggcagccctgagcccagccctgaggccgctgctgatggccccaccgtgtccccacctgagcggcgggcagaggaccccaatgaccagatccctggcagccctggcccctggctggtgcccagcgaggagcggctgagccgggccctgggcgtgagaggagctgcccagtttgcccaggagatggccgccggcagaagaagacactag

SEQ ID NO: 39896 - DNA, 813 bp, Artificial Sequence
  Description of Artificial Sequence: Synthetic coding sequence
atgcccctgctgtggatcaccggcccccgctaccacctgatcctgctgtctgaggccagctgcctgcgggccaactacgtgcacctgtgccccctcttccagcaccgctggctggagacctgcaatgccccaccccagctgatccagggcaaggcccacagcgcccccaagcccagccaggccagcggccacttctctgtggagctggtgcggggctacgccggcttcggcctgaccctgggcggcggcagagatgtggccggggacacccccctggccgtgcggggcctgctgaaggatggccctgcccagagatgtggccgcctggaggtgggagatgtggtgctgcacatcaatggagagagcacccagggcctgacccacgcccaggccgtggagcgcatccgggccggcggcccccagctgcacctggtgatcagaagacccctggagacccaccctgggaagccccggggcgtgggggagcccaggaaaggagtggacaggagcccagaccccggcggccctgaggtgacaggcagccgcagcagcagcaccagcctggtgcagcacccccccagcaggaccaccctgaagaagacccggggcagccctgagcccagccctgaggccgctgctgatggccccaccgtgagccccccagagaggagagctgaggaccccaatgaccagatccctggcagccctggcccctggctggtgcccagcgaggagcggctgagccgggccctgggcgtgcggggggccgcccagtttgcccaggagatggctgctggaagaagaagacactag

SEQ ID NO: 39897 - DNA, 1005 bp, Artificial Sequence
  Description of Artificial Sequence: Synthetic coding sequence
atggagcccaggactggaggagctgccaaccccaagggcagccggggcagccggggccccagccccctggccggccccagcgcccggcagctgctggcccggctggatgcccggcccctggccgcccgggctgctgtggatgtggccgccctggtgagaagagctggggccaccctgcggctgcggaggaaggaggccgtgtctgtgctggacagcgctgacatcgaggtgacagacagccggctgccccacgccaccatcgtggaccaccggccccagcaccgctggctggagacctgcaatgccccaccccagctgatccagggcaaggcccacagcgcccccaagcccagccaggccagcggccacttctctgtggagctggtgcggggctacgccggcttcggcctgaccctgggcggcggcagagatgtggccggggacacccccctggccgtgcggggcctgctgaaggatggccctgcccagagatgtggccgcctggaggtgggagatgtggtgctgcacatcaacggggagagcacccagggcctgacccacgcccaggccgtggagcgcatccgggccggcggcccccagctgcacctggtgatccggcggcccctggagacccaccctgggaagccccggggcgtgggggagcccaggaagggcgtggtgcccagctggccagacaggagcccagaccccggcggccctgaggtgacaggcagccgcagcagcagcaccagcctggtgcagcacccccccagcaggaccaccctgaagaagacccggggcagccctgagcccagccctgaggccgctgctgatggccccaccgtgagccccccagagaggagagctgaggaccccaatgaccagatccctggcagccctggcccctggctggtgcccagcgaggagcggctgagccgggccctgggcgtgcggggggccgcccagtttgcccaggagatggctgctggaagaagaagacactag

SEQ ID NO: 39898 - DNA, 714 bp, Artificial Sequence
  Description of Artificial Sequence: Synthetic coding sequence
tgaagaggccccagccccctggccggccccagcgcccggcagctgctggcccggctggatgcccggcccctggccgcccgggctgctgtggatgtggccgccctggtgagaagagctggggccaccctgcggctgcggaggaaggaggccgtgtctgtgctggacagcgctgacatcgaggtgacagacagccggctgccccacgccaccatcgtggaccaccggccccagggcaaggcccacagcgcccccaagcccagccaggccagcggccacttctctgtggagctggtgcggggctacgccggcttcggcctgaccctgggcggcggcagagatgtggccggggacacccccctggccgtgcggggcctgctgaaggatggccctgcccagagatgtggccgcctggaggtgggagatgtggtgctgcacatcaatggagagagcacccagggcctgacccacgcccaggccgtggagcgcatccgggccggcggcccccagctgcacctggtgatcagaagacccctggagacccaccctgggaagccccggggcgtgggggagcccaggaaaggagtggacaggagcccagaccccggcggccctgaggtgacaggcagccgcagcagcagcaccagcctggtgcagcacccccccagcaggaccaccctgaagaagacccggggcagccctgagcccagcccctag

SEQ ID NO: 39899 - DNA, 645 bp, Artificial Sequence
  Description of Artificial Sequence: Synthetic coding sequence
gcctggggcgtgagcagctactgccctgtgctggccgtgtctgtgctggacagcgctgacatcgaggtgacagacagccggctgccccacgccaccatcgtggaccaccggccccagcaccgctggctggagacctgcaatgccccaccccagctgatccagggcaaggcccacagcgcccccaagcccagccaggccagcggccacttctctgtggagctggtgcggggctacgccggcttcggcctgaccctgggcggcggcagagatgtggccggggacacccccctggccgtgcggggcctgctgaaggatggccctgcccagagatgtggccgcctggaggtgggagatgtggtgctgcacatcaacggggagagcacccagggcctgacccacgcccaggccgtggagcgcatccgggccggcggcccccagctgcacctggtgatccggcggcccctggagacccaccctgggaagccccggggcgtgggggagcccaggaagggcgtggacaggagcccagaccccggcggccctgaggtgacaggcagccgcagcagcagcaccagcctggtgcagcacccccccagcaggaccaccctgaagaagacccggggcagccctgagcccagcccctag

SEQ ID NO: 39900 - DNA, 777 bp, Artificial Sequence
  Description of Artificial Sequence: Synthetic coding sequence
atggagcccaggactggaggagctgccaaccccaagggcagccggggcagccggggccccagccccctggccggccccagcgcccggcagctgctggcccggctggatgcccggcccctggccgcccgggctgctgtggatgtggccgccctggtgagaagagctggggccaccctgcggctgcggaggaaggaggccgtgtctgtgctggacagcgctgacatcgaggtgacagacagccggctgccccacgccaccatcgtggaccaccggccccaggtgggagatgtggtgctgcacatcaacggggagagcacccagggcctgacccacgcccaggccgtggagcgcatccgggccggcggcccccagctgcacctggtgatccggcggcccctggagacccaccctgggaagccccggggcgtgggggagcccaggaagggcgtggtgcccagctggccagacaggagcccagaccccggcggccctgaggtgacaggcagccgcagcagcagcaccagcctggtgcagcacccccccagcaggaccaccctgaagaagacccggggcagccctgagcccagccctgaggccgctgctgatggccccaccgtgagccccccagagaggagagctgaggaccccaatgaccagatccctggcagccctggcccctggctggtgcccagcgaggagcggctgagccgggccctgggcgtgcggggggccgcccagtttgcccaggagatggctgctggaagaagaagacactag

SEQ ID NO: 39901 - DNA, 432 bp, Artificial Sequence
  Description of Artificial Sequence: Synthetic coding sequence
atgagccccaacagccccctgcactgcttctacctgcctgctgtgtctgtgctggacagcgctgacatcgaggtgacagacagccggctgccccacgccaccatcgtggaccaccggccccaggtgggagatgtggtgctgcacatcaacggggagagcacccagggcctgacccacgcccaggccgtggagcgcatccgggccggcggcccccagctgcacctggtgatccggcggcccctggagacccaccctgggaagccccggggcgtgggggagcccaggaagggcgtggacaggagcccagaccccggcggccctgaggtgacaggcagccgcagcagcagcaccagcctggtgcagcacccccccagcaggaccaccctgaagaagacccggggcagccctgagcccagccctgaggccgcctag

SEQ ID NO: 39902 - DNA, 606 bp, Artificial Sequence
  Description of Artificial Sequence: Synthetic coding sequence
tgaggacggctgctggccatggagcccaggactggaggagctgccaaccccaagggcagccggggcagccggggccccagccccctggccggccccagcgcccggcagctgctggcccggctggatgcccggcccctggccgcccgggctgctgtggatgtggccgccctggtgagaagagctggggccaccctgcggctgcggaggaaggaggccgtgtctgtgctggacagcgctgacatcgaggtgacagacagccggctgccccacgccaccatcgtggaccaccggccccaggtgggagatgtggtgctgcacatcaacggggagagcacccagggcctgacccacgcccaggccgtggagcgcatccgggccggcggcccccagctgcacctggtgatccggcggcccctggagacccaccctgggaagccccggggcgtgggggagcccaggaagggcgtggacaggagcccagaccccggcggccctgaggtgacaggcagccgcagcagcagcaccagcctggtgcagcacccccccagcaggaccaccctgaagaagacccggggcagccctgagcccagccctgaggccgcctag

SEQ ID NO: 39903 - DNA, 531 bp, Artificial Sequence
  Description of Artificial Sequence: Synthetic coding sequence
atggcccggctgcccaagctggccgtgtttgacctggactacaccctgtggcccttctgggtggacacccacgtggacccccccttccacaagagcagtgatggcaccgtgcgggaccggcggggccaggatgtgcggctgtacccagaggtgcctgaggtgctgaagaggctgcagagcctgggcgtgcctggagctgctgccagcaggaccagcgagattgagggcgccaaccagctgctggagctgtttgacctcttccgctactttgtgcaccgggagatctacccaggcagcaagatcacccactttgagcggctgcagcagaagacaggcatccccttcagccagatgatcttctttgatgatgaaagaagaaacatcgtggatgtgtccaagctgggcgtgacctgcatccacatccagaatggcatgaacctgcagaccctgagccagggcctggagacctttgccaaggcccagacaggccccctgcggagcagcctggaggagagcccctttgaggcctag

SEQ ID NO: 39904 - DNA, 369 bp, Artificial Sequence
  Description of Artificial Sequence: Synthetic coding sequence
atggcccggctgcccaagctggccgtgtttgacctggactacaccctgtggcccttctgggtggacacccacgtggacccccccttccacaagagcagtgatggcaccgtgcgggaccggcggggccaggatgtgcggctgtacccagaggtgcctgaggtgctgaagaggctgcagagcctgggcgtgcctggagctgctgccagcaggaccagcgagattgagggcgccaaccagctgctggagctgtttgacctcttccgctgctacctgcacagccaccctgagtggaatgaaagcagcaacagcaagagccgggtgcgggacatctgtgagggccccaactgggcctttgaggtgcagccctag

SEQ ID NO: 39905 - DNA, 1515 bp, Artificial Sequence
  Description of Artificial Sequence: Synthetic coding sequence
atggccgcccccccagccccagctgccaagggcagcccccagcctgagccccacgcccctgagcccggccctggcagcgccaagaggggccgggaggacagccgggccggccgcctgtccttctgcaccaaggtgtgctatggaattggaggagtgcccaaccagatcgccagcagcgccacagccttctacctgcagctgttcctgctggacatcgcccagatcccagctgcccaggtgtccctggtgctgtttggaggcaaggtgtctggagctgctgctgaccctgtggccggcttcttcatcaacagaagccagaggacaggcagcggccgcctgatgccctgggtgctgggctgcacccccttcatcgccctggcctacttcttcctgtggttcctgccccccttcaccagcctgcggggcctgtggtacaccaccttctactgcctcttccaggccctggccaccttcttccaggtgccctacacagccctgaccatgctgctgaccccctgcccccgggagcgggacagcgccacagcctacaggatgacagtggagatggccggcaccctgatgggcgccaccgtgcacggcctcatcgtgtctggggcccaccggccccaccgctgtgaggccacagccaccccaggccctgtgacagtgagccccaatgctgcccacctgtactgcatcgctgctgctgtggtggtggtgacctaccctgtgtgcatcagcctgctgtgcctgggcgtgaaggagaggccagaccccagcgccccagccagcggccctggcctgtccttcctggccggcctgagcctgaccaccaggcaccccccctacctgaagctggtgatctccttcctgttcatctctgctgctgtgcaggtggagcagagctacctggtgctcttctgcacccacgccagccagctgcatgaccacgtgcagggcctggtgctgactgtgctggtgtctgctgtgctgagcacccccctgtgggagtgggtgctgcagagatttgggaagaagaccagcgccttcggcatctttgccatggtgccctttgccatcctgctggccgctgtgcccacagcccctgtggcctacgtggtggcctttgtgtctggagtgtccattgctgtgtccctgctgctgccctggagcatgctgcctgatgtggtggatgacttccagctgcagcaccgccacggccctggcctggagaccatcttctacagcagctatgtgttcttcaccaagctgagcggggcctgtgccctgggcatcagcaccctgagcctggagttcagcggctacaaggccggcgtgtgcaagcaggccgaggaggtggtggtgaccctgaaggtgctgattggagctgtgcccacctgcatgatcctggccggcctgtgcatcctgatggtgggcagcacccccaagacccccagcagagatgccagcagccggctgagcctgcggcggaggaccagctacagcctggcctag

SEQ ID NO: 39906 - DNA, 1494 bp, Artificial Sequence
  Description of Artificial Sequence: Synthetic coding sequence
atggccgcccccccagccccagctgccaagggcagcccccagcctgagccccacgcccctgagcccggccctggcagcgccaagaggggccgggaggacagccgggccggccgcctgtccttctgcaccaaggtgtgctatggaattggaggagtgcccaaccagatcgccagcagcgccacagccttctacctgcagctgttcctgctggacatcgcccagatcccagctgcccaggtgtccctggtgctgtttggaggcaaggtgtctggagctgctgctgaccctgtggccggcttcttcatcaacagaagccagaggacaggcagcggccgcctgatgccctgggtgctgggctgcacccccttcatcgccctggcctacttcttcctgtggttcctgccccccttcaccagcctgcggggcctgtggtacaccaccttctactgcctcttccaggccctggccaccttcttccaggtgccctacacagccctgaccatgctgctgaccccctgcccccgggagcgggacagcgccacagcctacaggatgacagtggagatggccggcaccctgatgggcgccaccgtgcacggcctcatcgtgtctggggcccaccggccccaccgctgtgaggccacagccaccccaggccctgtgacagtgagccccaatgctgcccacctgtactgcatcgctgctgctgtggtggtggtgacctaccctgtgtgcatcagcctgctgtgcctgggcgtgaaggagaggccagaccccagcgccccagccagcggccctggcctgtccttcctggccggcctgagcctgaccaccaggcaccccccctacctgaagctggtgatctccttcctgttcatctctgctgctgtgcaggtggagcagagctacctggtgctcttctgcacccacgccagccagctgcatgaccacgtgcagggcctggtgctgactgtgctggtgtctgctgtgctgagcacccccctgtgggagtgggtgctgcagagatttgggaagaagaccagcgccttcggcatctttgccatggtgccctttgccatcctgctggccgctgtgcccacagcccctgtggcctacgtggtggcctttgtgtctggagtgtccattgctgtgtccctgctgctgccctggagcatgctgcctgatgtggtggatgacttccagctgcagcaccgccacggccctggcctggagaccatcttctacagcagctatgtgttcttcaccaagctgagcggggcctgtgccctgggcatcagcaccctgagcctggagttcagcggctacaaggccggcgtgtgcaagcaggccgaggaggtggtggtgaccctgaaggtgctgattggagctgtgcccacctgcatgatcctggccggcctgtgcatcctgatggtgggcagcacccccaagacccccagcagagatgccagcagccggctgagcctgcggaggtag

SEQ ID NO: 39907 - DNA, 1449 bp, Artificial Sequence
  Description of Artificial Sequence: Synthetic coding sequence
atggccgaggccgccaccccaggcaccacagccaccaccagcggggccggggctgctgctgccacagctgctgctgccagccccacccccatccccaccgtgacagcccccagcctgggcgccggcggcggcggcggcggcagtgatggcagcggcggcggctggaccaagcaggtgacctgccgctacttcatgcacggcgtgtgcaaggagggggacaactgccgctacagccatgacctgagtgacagcccctacagcgtggtgtgcaagtacttccagaggggctactgcatctacggggaccgctgccgctatgagcacagcaagcccctgaagcaggaggaggccacagccacagagctgaccaccaagagcagcctggccgccagcagcagcctgagcagcatcgtgggccccctggtggagatgaacacaggagaggccgagagcaggaacagcaactttgccaccgtgggcgccggcagcgaggactgggtgaatgccatcgagtttgtgcccggccagccctactgcggccgcacagcccccagctgcacagaggcccccctgcagggctctgtgaccaaggaggagagcgagaaggagcagacagctgtggagaccaagaagcagctgtgcccctatgctgctgtgggagaatgtcgctacggggagaactgtgtgtacctgcacggggacagctgtgacatgtgtggcctgcaggtgctgcaccccatggatgctgcccagaggagccagcacatcaagagctgcatcgaggcccacgagaaggacatggagctgagctttgctgtgcagaggagcaaggacatggtgtgtggcatctgcatggaggtggtgtatgagaaggccaaccccagcgagaggagatttggcatcctgagcaactgcaaccacacctactgcctgaagtgcatcaggaagtggaggtctgccaagcagtttgagagcaagatcatcaagagctgcccagaatgtcgcatcaccagcaacttcgtcatccccagcgagtactgggtggaggagaaggaggagaagcagaagctgatcctgaagtacaaggaggccatgagcaacaaggcctgccgctactttgatgagggccggggcagctgcccctttggaggcaactgcttctacaagcacgcctacccagatggccggcgggaggagccccagaggcagaaggtgggcaccagcagccgctaccgggcccagaggaggaaccacttctgggagctgattgaggagcgggagaacagcaacccctttgacaatgatgaggaggaggtggtgacctttgagctgggggagatgctgctgatgctgctggccgctggaggagatgatgagctgacagattctgaagatgagtgggacctcttccatgatgagctggaggacttctatgacctggacctgtag

SEQ ID NO: 39908 - DNA, 651 bp, Artificial Sequence
  Description of Artificial Sequence: Synthetic coding sequence
atggagctgagctttgctgtgcagaggagcaaggacatggtgtgtggcatctgcatggaggtggtgtatgagaaggccaaccccagcgagaggagatttggcatcctgagcaactgcaaccacacctactgcctgaagtgcatcaggaagtggaggtctgccaagcagtttgagagcaagatcatcaagagctgcccagaatgtcgcatcaccagcaacttcgtcatccccagcgagtactgggtggaggagaaggaggagaagcagaagctgatcctgaagtacaaggaggccatgagcaacaaggcctgccgctactttgatgagggccggggcagctgcccctttggaggcaactgcttctacaagcacgcctacccagatggccggcgggaggagccccagaggcagaaggtgggcaccagcagccgctaccgggcccagaggaggaaccacttctgggagctgattgaggagcgggagaacagcaacccctttgacaatgatgaggaggaggtggtgacctttgagctgggggagatgctgctgatgctgctggccgctggaggagatgatgagctgacagattctgaagatgagtgggacctcttccatgatgagctggaggacttctatgacctggacctgtag

SEQ ID NO: 39909 - DNA, 1257 bp, Artificial Sequence
  Description of Artificial Sequence: Synthetic coding sequence
atgcacggcgtgtgcaaggagggggacaactgccgctacagccatgacctgagtgacagcccctacagcgtggtgtgcaagtacttccagaggggctactgcatctacggggaccgctgccgctatgagcacagcaagcccctgaagcaggaggaggccacagccacagagctgaccaccaagagcagcctggccgccagcagcagcctgagcagcatcgtgggccccctggtggagatgaacacaggagaggccgagagcaggaacagcaactttgccaccgtgggcgccggcagcgaggactgggtgaatgccatcgagtttgtgcccggccagccctactgcggccgcacagcccccagctgcacagaggcccccctgcagggctctgtgaccaaggaggagagcgagaaggagcagacagctgtggagaccaagaagcagctgtgcccctatgctgctgtgggagaatgtcgctacggggagaactgtgtgtacctgcacggggacagctgtgacatgtgtggcctgcaggtgctgcaccccatggatgctgcccagaggagccagcacatcaagagctgcatcgaggcccacgagaaggacatggagctgagctttgctgtgcagaggagcaaggacatggtgtgtggcatctgcatggaggtggtgtatgagaaggccaaccccagcgagaggagatttggcatcctgagcaactgcaaccacacctactgcctgaagtgcatcaggaagtggaggtctgccaagcagtttgagagcaagatcatcaagagctgcccagaatgtcgcatcaccagcaacttcgtcatccccagcgagtactgggtggaggagaaggaggagaagcagaagctgatcctgaagtacaaggaggccatgagcaacaaggcctgccgctactttgatgagggccggggcagctgcccctttggaggcaactgcttctacaagcacgcctacccagatggccggcgggaggagccccagaggcagaaggtgggcaccagcagccgctaccgggcccagaggaggaaccacttctgggagctgattgaggagcgggagaacagcaacccctttgacaatgatgaggaggaggtggtgacctttgagctgggggagatgctgctgatgctgctggccgctggaggagatgatgagctgacagattctgaagatgagtgggacctcttccatgatgagctggaggacttctatgacctggacctgtag

SEQ ID NO: 39910 - DNA, 990 bp, Artificial Sequence
  Description of Artificial Sequence: Synthetic coding sequence
atggccgaggccgccaccccaggcaccacagccaccaccagcggggccggggctgctgctgccacagctgctgctgccagccccacccccatccccaccgtgacagcccccagcctgggcgccggcggcggcggcggcggcagtgatggcagcggcggcggctggaccaagcaggtgacctgccgctacttcatgcacggcgtgtgcaaggagggggacaactgccgctacagccatgacctgagtgacagcccctacagcgtggtgtgcaagtacttccagaggggctactgcatctacggggaccgctgccgctatgagcacagcaagcccctgaagcaggaggaggccacagccacagagctgaccaccaagagcagcctggccgccagcagcagcctgagcagcatcgtgggccccctggtggagatgaacacaggagaggccgagagcaggaacagcaactttgccaccgtgggcgccggcagcgaggactgggtgaatgccatcgagtttgtgcccggccagccctactgcggccgcacagcccccagctgcacagaggcccccctgcagggctctgtgaccaaggaggagagcgagaaggagcagacagctgtggagaccaagaagcagctgtgcccctatgctgctgtgggagaatgtcgctacggggagaactgtgtgtacctgcacggggacagctgtgacatgtgtggcctgcaggtgctgcaccccatggatgctgcccagaggagccagcacatcaagagctgcatcgaggcccacgagaaggacatggagctgagctttgctgtgcagaggagcaaggacatggtgtgtggcatctgcatggaggtggtgtatgagaaggccaaccccagcgagaggagatttggcatcctgagcaactgcaaccacacctactgcctgaagtgcatcaggaagtggaggtctgccaagcagtttgagagcaagatcatcaagtag

SEQ ID NO: 39911 - DNA, 1557 bp, Artificial Sequence
  Description of Artificial Sequence: Synthetic coding sequence
atggccaagtttgtgattgctggccgggctgactgcccctactatgccaagacagagctggtggccgactacctgcagaagaacctgcctgacttccgcatccacaagatcacccagaggcctgaggtgtgggaggactggctgaaggatgtgtgtgagaagaacaagtggagccacaagaacagccccatcatctggagggagctgctggacagaggaggcaagggcctgctgctgggcggctacaatgagttcctggagcacgcccagctgtactatgatgtgaccagctccatgaccacagagctgatgatggtgattgcccaggagaacctgggcgcccacatcgagaaggagcaggaggaggaggccctgaagacctgcatcaaccccctgcaggtgtggatcaccagcgccagcgccccagcctgctacaacctgatccccatcctgaccagcggggaggtgtttggcatgcacacagagatcagcatcaccctgtttgacaacaagcaggccgaggagcacctgaagagcctggtggtggagacccaggacctggccagccctgtgctgcggtctgtgtccatctgcaccaaggtggaggaggccttccggcaggcccacgtgattgtggtgctggatgacagcaccaacaaggaggtgttcaccctggaggactgcctgcggagccgggtgcccctgtgccgcctgtatggctacctgattgagaagaatgcccacgagagcgtgcgggtcatcgtgggcggccgcacctttgtgaacctgaagacagtgctgctgatgagatatgcccccagaattgcccacaacatcatcgctgtggccctgggcgtggagggggaggccaaggccatcctggccaggaagctgaagacagcccccagctacatcaaggatgtgatcatctggggcaacatcagcggcaacaactacgtggacctgaggaagaccagggtgtaccgctatgagagcgccatctggggccccctgcactacagcaggcctgtgctgaacctgatctttgattctgagtgggtgaagcgggagtttgtggccatcctgaagaacctgaccaccaccggccggcagtttggaggcatcctggccgcccacagcatcgccaccaccctgaagtactggtaccacggcagccccccaggagaaattgtgtccctgggcatcctgtctgagggccagtttggcatccccaagggcatcgtgttctccatgcctgtgaagtttgaaaatggcacctgggtggtgctgacagacctgaaggatgtggagatcagcgagcagatcatgaccaggatgaccagtgacctgatccaggagaagctggtggccctgggggacaagatccacttccagccctaccagagcggccacaaggacctggtgcctgatgaggagaagaacctggccatgtctgatgctgctgagttccccaaccagatcccccagaccacctttgagaagccccagagcctggagttcctgaatgaatttgagggcaagacagtggagagctag

SEQ ID NO: 39912 - DNA, 852 bp, Artificial Sequence
  Description of Artificial Sequence: Synthetic coding sequence
atggccaagtttgtgattgctggccgggctgactgcccctactatgccaagacagagctggtggccgactacctgcagaagaacctgcctgacttccgcatccacaagatcacccagaggcctgaggtgtgggaggactggctgaaggatgtgtgtgagaagaacaagtggagccacaagaacagccccatcatctggagggagctgctggacagaggaggcaagggcctgctgctgggcggctacaatgagttcctggagcacgcccagctgtactatgatgtgaccagctccatgaccacagagctgatgatggtgattgcccaggagaacctgggcgcccacatcgagaaggagcaggaggaggaggccctgaagacctgcatcaaccccctgcaggtgtggatcaccagcgagtgggtgaagcgggagtttgtggccatcctgaagaacctgaccaccaccggccggcagtttggaggcatcctggccgcccacagcatcgccaccaccctgaagtactggtaccacggcagccccccaggagagatcgtgtccctgggcatcctgtctgagggccagtttggcatccccaagggcatcgtgttctccatgcctgtgaagtttgaaaatggcacctgggtggtgctgacagacctgaaggatgtggagatcagcgagcagatcatgaccaggatgaccagtgacctgatccaggagaagctggtggccctgggggacaagatccacttccagccctaccagagcgacaccccccgcatcaacaccctgcaccccagcatccagagctcctggcacagcgtgctgaccatcaccatcaggaagaggtag

SEQ ID NO: 39913 - DNA, 1554 bp, Artificial Sequence
  Description of Artificial Sequence: Synthetic coding sequence
atggccaagtttgtgattgctggccgggctgactgcccctactatgccaagacagagctggtggccgactacctgcagaagaacctgcctgacttccgcatccacaagatcacccagaggcctgaggtgtgggaggactggctgaaggatgtgtgtgagaagaacaagtggagccacaagaacagccccatcatctggagggagctgctggacagaggaggcaagggcctgctgctgggcggctacaatgagttcctggagcacgcccagctgtactatgatgtgaccagctccatgaccacagagctgatgatggtgattgcccaggagaacctgggcgcccacatcgagaaggagcaggaggaggaggccctgaagacctgcatcaaccccctgcaggtgtggatcaccagcgccagcgccccagcctgctacaacctgatccccatcctgaccagcggggaggtgtttggcatgcacacagagatcagcatcaccctgtttgacaacaagcaggccgaggagcacctgaagagcctggtggtggagacccaggacctggccagccctgtgctgcggtctgtgtccatctgcaccaaggtggaggaggccttccggcaggcccacgtgattgtggtgctggatgacagcaccaacaaggaggtgttcaccctggaggactgcctgcggagccgggtgcccctgtgccgcctgtatggctacctgattgagaagaatgcccacgagagcgtgcgggtcatcgtgggcggccgcacctttgtgaacctgaagacagtgctgctgatgagatatgcccccagaattgcccacaacatcatcgctgtggccctgggcgtggagggggaggccaaggccatcctggccaggaagctgaagacagcccccagctacatcaaggatgtgatcatctggggcaacatcagcggcaacaactacgtggacctgaggaagaccagggtgtaccgctatgagagcgccatctggggccccctgcactacagcaggcctgtgctgaacctgatctttgattctgagtgggtgaagcgggagtttgtggccatcctgaagaacctgaccaccaccggccggcagtttggaggcatcctggccgcccacagcatcgccaccaccctgaagtactggtaccacggcagccccccaggagaaattgtgtccctgggcatcctgtctgagggccagtttggcatccccaagggcatcgtgttctccatgcctgtgaagtttgaaaatggcacctgggtggtgctgacagacctgaaggatgtggagatcagcgagcagatcatgaccaggatgaccagtgacctgatccaggagaagctggtggccctgggggacaagatccacttccagccctaccagagcggccacaaggacctggtgcctgatgaggagaagaacctggccatgtctgatgctgagttccccaaccagatcccccagaccacctttgagaagccccagagcctggagttcctgaatgaatttgagggcaagacagtggagagctag

SEQ ID NO: 39914 - DNA, 705 bp, Artificial Sequence
  Description of Artificial Sequence: Synthetic coding sequence
atggagcggggcggcggcggcagcggcaccggcagcaggcctgagggcacagcccggggcaccagcctgcccgggaagattgctgagcccggggctgtgaggaccagccagcccaactaccggccccagggcatggagggcttcctgaagagtgatgagcggcagaggctggccaaggagcggcgggaggagcgggagaagtgcctggccgcccgggagcagcagatcctggagaagcagaagagggcccggctgcagtatgagaagcagatggaggagcgctggaggaagctggaggagcagaggcagcgggaggaccagaagagagctgctgtggaggagaagaggaagcagaagctgcgggaggaggaggagcggctggaggccatgatgaggaggagcctggagaggacccagcagctggagctgaagaagaagtacagctggggcgcccccctggccatcggccctgggggccatgatggagagagcgagaacaccccacctccacccctgggcctggccgccagcaccctgcccccagatgctggcaccacagctgctgctgctgagagcaccaatgcctgtgacaagctgagcaccagcaccatgagcctgcccaagcccacagagccccccatgaacaagaggctgagcagcagcacagtggccatctcctacagcccagacagagatgagaagtag

SEQ ID NO: 39915 - DNA, 2322 bp, Artificial Sequence
  Description of Artificial Sequence: Synthetic coding sequence
atggagcggggcggcggcggcagcggcaccggcagcaggcctgagggcacagcccggggcaccagcctgcccgggaagattgctgagcccggggctgtgaggaccagccagcccaactaccggccccagggcatggagggcttcctgaagagtgatgagcggcagaggctggccaaggagcggcgggaggagcgggagaagtgcctggccgcccgggagcagcagatcctggagaagcagaagagggcccggctgcagtatgagaagcagatggaggagcgctggaggaagctggaggagcagaggcagcgggaggaccagaagagagctgctgtggaggagaagaggaagcagaagctgcgggaggaggaggagcggctggaggccatgatgaggaggagcctggagaggacccagcagctggagctgaagaagaagtacagctggggcgcccccctggccatcggccctgggggccatgatgcctgtgacaagctgagcaccagcaccatgagcctgcccaagcccacagagccccccatgaacaagaggctgagcagcagcacagtggccatctcctacagcccagaccgggcccaccacatgcacctgagccccatggaggccatcctggtgtcccggctgctgacccccacccagagcagcctggcccggagccgggcctctgtgatgctgagcggccaggccaatgattctgtgttccacgtgtgcccccggctggcccccctgggccccctgaaccccagctacaagagcagccccaccagaaatattgagaagaagaaggccaccagcaccagcaccagcggggctggagatgtgggcaaggaggccctgtctggaggagaggccagcctggtggagaaggtgaagaggggccagaggacagccaccagcctgcctgtggtgaactttggcagccccctgcggcgctgtgagttcagcggcggcatccccaagaggcccagcagccctgtgatcagcaagacagccaccaaggcctacccccagagccccaagaccaccaagccaccctacccaggcagccctgtgaagtaccgcctgcctgccctgagcggccaggacatgcccaagaggaaggccgagaaggagaagagcaacaaggagcgggagggcaccctggcccagcaggccgccggcccccagggcgaggaggccctggagaagcacgtggtggacaagcacgccagcgagaagcatgctgctgctgctgggggcaaggcagaaaattctgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccatgctgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39916 - DNA, 2199 bp, Artificial Sequence
  Description of Artificial Sequence: Synthetic coding sequence
atggagcggggcggcggcggcagcggcaccggcagcaggcctgagggcacagcccggggcaccagcctgcccgggaagattgctgagcccggggctgtgaggaccagccagcccaactaccggccccagggcatggagggcttcctgaagagtgatgagcggcagaggctggccaaggagcggcgggaggagcgggagaagtgcctggccgcccgggagcagcagatcctggagaagcagaagagggcccggctgcagtatgagaagcagatggaggagcgctggaggaagctggaggagcagaggcagcgggaggaccagaagagagctgctgtggaggagaagaggaagcagaagctgcgggaggaggaggagcggctggaggccatgatgaggaggagcctggagaggacccagcagctggagctgaagaagaagtacagctggggcgcccccctggccatcggccctgggggccatgatgcctgtgacaagctgagcaccagcaccatgagcctgcccaagcccacagagccccccatgaacaagaggctgagcagcagcacagtggccatctcctacagcccagacagagtcttccacgtgtgcccccggctggcccccctgggccccctgaaccccagctacaagagcagccccaccaggaacatcgagaagaagaaggccaccagcaccagcaccagcggggctggagatgtgggcaaggaggccctgagcggcggggaggccagcctggtggagaaggtgaagaggggccagaggacagccaccagcctgcctgtggtgaactttggcagccccctgcggcgctgtgagttcagcggcggcatccccaagaggcccagcagccctgtgatcagcaagacagccaccaaggcctacccccagagccccaagaccaccaagccaccctacccaggcagccctgtgaagtaccgcctgcctgccctgagcggccaggacatgcccaagaggaaggccgagaaggagaagagcaacaaggagcgggagggcaccctggcccagcaggccgccggcccccagggcgaggaggccctggagaagcacgtggtggacaagcacgccagcgagaagcacgccgctgctgctgggggcaaggccgagaacagcgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccacgccgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39917 - DNA, 2064 bp, Artificial Sequence
  Description of Artificial Sequence: Synthetic coding sequence
atggagcggggcggcggcggcagcggcaccggcagcaggcctgagggcacagcccggggcaccagcctgcccgggaagattgctgagcccggggctgtgaggaccagccagcccaactaccggccccagggcatggagggcttcctgaagagtgatgagcggcagaggctggccaaggagcggcgggaggagcgggagaagtgcctggccgcccgggagcagcagatcctggagaagcagaagagggcccggctgcagtatgagaagcagatggaggagcgctggaggaagctggaggagcagaggcagcgggaggaccagaagagagctgctgtggaggagaagaggaagcagaagctgcgggaggaggaggagcggctggaggccatgatgaggaggagcctggagaggacccagcagctggagctgaagaagaagtacagctggggcgcccccctggccatcggccctgggggccatgatgcccccctgggccccctgaaccccagctacaagagcagccccaccagaaatattgagaagaagaaggccaccagcaccagcaccagcggggctggagatgtgggcaaggaggccctgtctggaggagaggccagcctggtggagaaggtgaagaggggccagaggacagccaccagcctgcctgtggtgaactttggcagccccctgcggcgctgtgagttcagcggcggcatccccaagaggcccagcagccctgtgatcagcaagacagccaccaaggcctacccccagagccccaagaccaccaagccaccctacccaggcagccctgtgaagtaccgcctgcctgccctgagcggccaggacatgcccaagaggaaggccgagaaggagaagagcaacaaggagcgggagggcaccctggcccagcaggccgccggcccccagggcgaggaggccctggagaagcacgtggtggacaagcacgccagcgagaagcatgctgctgctgctgggggcaaggcagaaaattctgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccatgctgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39918 - DNA, 2043 bp, Artificial Sequence
  Description of Artificial Sequence: Synthetic coding sequence
atggagggcttcctgaagagtgatgagcggcagaggctggccaaggagcggcgggaggagcgggagaagtgcctggccgcccgggagcagcagatcctggagaagcagaagagggcccggctgcagtatgagaagcagatggaggagcgctggaggaagctggaggagcagaggcagcgggaggaccagaagagagctgctgtggaggagaagaggaagcagaagctgcgggaggaggaggagcggctggaggccatgatgaggaggagcctggagaggacccagcagctggagctgaagaagaagtacagctggggcgcccccctggccatcggccctgggggccatgatgcctgtgacaagctgagcaccagcaccatgagcctgcccaagcccacagagccccccatgaacaagaggctgagcagcagcacagtggccatctcctacagcccagaccgggcccccctgggccccctgaaccccagctacaagagcagccccaccaggaacatcgagaagaagaaggccaccagcaccagcaccagcggggctggagatgtgggcaaggaggccctgagcggcggggaggccagcctggtggagaaggtgaagaggggccagaggacagccaccagcctgcctgtggtgaactttggcagccccctgcggcgctgtgagttcagcggcggcatccccaagaggcccagcagccctgtgatcagcaagacagccaccaaggcctacccccagagccccaagaccaccaagccaccctacccaggcagccctgtgaagtaccgcctgcctgccctgagcggccaggacatgcccaagaggaaggccgagaaggagaagagcaacaaggagcgggagggcaccctggcccagcaggccgccggcccccagggcgaggaggccctggagaagcacgtggtggacaagcacgccagcgagaagcacgccgctgctgctgggggcaaggccgagaacagcgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccacgccgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39919 - DNA, 1854 bp, Artificial Sequence
  Description of Artificial Sequence: Synthetic coding sequence
atgatgagaagaagcctggagaggacccagcagctggagctgaagaagaagtacagctggggcgcccccctggccatcggccctgggggccatgatggcctggccgccagcaccctgcccccagatgctggcaccacagctgctgctgctgagagcaccaatgcctgtgacaagctgagcaccagcaccatgagcctgcccaagcccacagagccccccatgaacaagaggctgagcagcagcacagtggccatctcctacagcccagaccgggcccccctgggccccctgaaccccagctacaagagcagccccaccagaaatattgagaagaagaaggccaccagcaccagcaccagcggggctggagatgtgggcaaggaggccctgtctggaggagaggccagcctggtggagaaggtgaagaggggccagaggacagccaccagcctgcctgtggtgaactttggcagccccctgcggcgctgtgagttcagcggcggcatccccaagaggcccagcagccctgtgatcagcaagacagccaccaaggcctacccccagagccccaagaccaccaagccaccctacccaggcagccctgtgaagtaccgcctgcctgccctgagcggccaggacatgcccaagaggaaggccgagaaggagaagagcaacaaggagcgggagggcaccctggcccagcaggccgccggcccccagggcgaggaggccctggagaagcacgtggtggacaagcacgccagcgagaagcatgctgctgctgctgggggcaaggcagaaaattctgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccatgctgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39920 - DNA, 1248 bp, Artificial Sequence
  Description of Artificial Sequence: Synthetic coding sequence
atgaggggccgggactggcccaagaaggatgagaagaaggagaagaatgtgtggctgctgggcagcaacagatcctggaggaacaggaaggagcccggctgcagcaccaagagcaagtggaggagtgatggagagaactggaagagcagcggcagcggccgcaccaagcgggagctgctgtggaagaggaagggcaacagcgctgccctgggcaagcccacagctggcaccacagatgctggggaggccgccaagatcctggccgagaagaggcggcaggcccggctgcagaaggagcaggaggagcaggagcggctggagaaggaggagcaggaccggctggagcgggaggagctgaagaggaaggccgaggaggagcggctgcggctggaggaggaggccaggaagcaggaggaggagaggaagaggcaggaggaggagaagaagaagcaggagggggaggagaagaggaaggccggggaggaggccaagaggaaggccgaggaggagctgctgctgaaggagaagcaggagcaggagaagcaggagaaggccatgattgagaagcagaaggaggccgctgagaccaaggcccgggaggtggccgagcagatgaggctggagcgggagcagatcatgctgcagatcgagcaggagcggctggagaggaagaagagaattgatgagatcatgaagaggaccaggaagagtgatgtgagcccccaggtgaagaaggaggaccccaaggtgggcgtgcagcctgctgtgtgtgtggagaagaagaccaagctggtggtgcccaacaagatggagatcaatggcctgaacacctgccaggaggtgaatggagtggaccatgctgcccctgagacctacccccaggacatcttcagcaatggcctgaagccagctgggggcctcatccacctggatgccctggatggcaagagcaacagcctggatgacagcacagaggaggtgcagagcatggatgtgtcccctgtgtccaaggaggagctgatcagcatccctgagttcagccctgtgtctgagatgatccctggggtgtccctggaccagaatggaactggaaatgcccgggccctgcaggacctgctggacttcaccggcccccccaccttccccaagaggagcagcgagaacctgagcctggatgactgcaacaagaacctgattgagggcttcaacagccctggccaggagacccccctgaacaccttctgctag

SEQ ID NO: 39921 - DNA, 522 bp, Artificial Sequence
  Description of Artificial Sequence: Synthetic coding sequence
atgctgcccccaccaccccggcagcccccaccccaggcccgggccgcccggggagctgtgcggctgcagaggcccttcctgcggagccccctgggcgtgctgcggctgctgcagctgctggccggggccgccttctggatcaccatcgccaccagcaagtaccagggccctgtgcactttgccctgtttgtgtctgtgctcttctggctgctgaccctgggcctgtacttcctgaccctgctgggcaagcatgagctggtgcctgtgctgggcagccgctggctgatggtgaatgtggcccatgatgtgctggccgccgccctgtatggagctgccaccggcatcatgtctgaccagatgcagaggcacagctactgcaacctgaaggactaccccctgccctgtgcctaccacgccttcctggccgctgctgtgtgtggcggcgtgtgccacggcctgtacctgctgagcgccctgtatggctgcggccgccgctgccagggcaagcaggaggtggcctag

SEQ ID NO: 39922 - DNA, 1158 bp, Artificial Sequence
  Description of Artificial Sequence: Synthetic coding sequence
atgcagaccagcagcaagcccagcgacttcctgaacctggccaagaagaagaggaagttcagcgagctgctgaccaccgtggtgctgctgtgcctgctgacccccagctggaccagcacaggccgcatgtggagccacctgaaccggctgctcttctggagcatcttcagctctgtgacctgcaggaaggctgtgctggactgtgaggccatgaagaccaatgagttccccagcccctgcctggacagcaagaccaaggtggtgatgaagggccagaatgtgtccatgttctgcagccacaagaacaagagcctgcagatcacctacagcctcttccggaggaagacccacctgggcacccaggacggcaagggggagcccgccatcttcaacctgagcatcacagaggcccacgagagcggcccctacaagtgcaaggcccaggtgaccagctgcagcaagtacagccgggacttctccttcaccatcgtggaccctgtgaccagccctgtgctgaacatcatggtgatccagacagaaacagacagacacatcaccctgcactgcctgtctgtgaatggcagcctgcccatcaactacaccttctttgagaaccacgtggccatcagccctgccatcagcaaatatgaccgggagcctgctgagttcaacctgaccaagaagaaccctggagaggaggaggagtaccgctgtgaggccaagaaccggctgcccaactatgccacctacagccaccctgtgaccatgcccagcactggaggagacagctgccccttctgcctgaagctgctgctgcccggcctgctgctgctgctggtggtgatcatcctgatcctggccttctgggtgctgcccaagtacaagaccaggaaggccatgagaaataatgtgccccgggacagaggagacacagccatggaggtgggcatctatgccaacatcctggagaagcaggccaaggaggagagcgtgcctgaggtgggcagccggccctgtgtgtccacagcccaggatgaggccaagcacagccaggagctgcagtatgccacccctgtgttccaggaggtggccccccgggagcaggaggcctgtgacagctacaagagcggctacgtgtacagcgagctgaacttctag

SEQ ID NO: 39923 - DNA, 1413 bp, Artificial Sequence
  Description of Artificial Sequence: Synthetic coding sequence
atgaagttcctgctgatcctgctgctgcaggccacagccagcggggccctgcccctgaacagcagcaccagcctggagaagaacaacgtgctgtttggagagcgctacctggagaagttctacggcctggagatcaacaagctgcctgtgaccaagatgaagtacagcggcaacctgatgaaggagaagatccaggagatgcagcacttcctgggcctgaaggtgacaggccagctggacaccagcaccctggagatgatgcacgccccccgctgtggggtgcctgatgtgcaccacttccgggagatgcctgggggccctgtgtggaggaagcactacatcacctaccgcatcaacaactacaccccagacatgaaccgggaggatgtggactatgccatcaggaaggccttccaggtgtggagcaatgtgacccccctgaagttcagcaagatcaacacaggcatggctgacatcctggtggtgtttgcccggggggcccacggggacttccacgcctttgatggaaaaggaggcatcctggcccacgcctttggacctggcagcggcattggaggagatgcccactttgatgaagatgagttctggaccacccacagcggcggcaccaacctcttcctgacagctgtgcatgagatcggccacagcctgggcctgggccacagcagtgaccccaaggctgtgatgttccccacctacaagtatgtggacatcaacaccttccggctgtctgcagatgacatccggggcatccagagcctgtatggagaccccaaggagaaccagaggctgcccaacccagacaacagcgagcccgccctgtgtgaccccaacctgagctttgatgctgtgaccaccgtgggcaacaagatcttcttcttcaaggaccgcttcttctggctgaaggtgtctgagcggcccaagacctctgtgaacctgatcagcagcctgtggcccaccctgcccagcggcatcgaggccgcctatgaaattgaggccaggaaccaggtgttcctgttcaaggatgacaagtactggctgatcagcaacctgcggcctgagcccaactaccccaagagcatccacagctttggcttccccaactttgtgaagaagattgatgctgctgtgttcaacccccgcttctaccgcacctacttctttgtggacaaccagtactggaggtatgatgagcggcggcagatgatggaccccggctaccccaagctgatcaccaagaacttccagggcatcggccccaagattgatgctgtgttctacagcaagaacaagtactactacttcttccagggcagcaaccagtttgaatatgacttcctgctgcagaggatcaccaagaccctgaagagcaacagctggtttggctgctag

SEQ ID NO: 39924 - DNA, 324 bp, Artificial Sequence
  Description of Artificial Sequence: Synthetic coding sequence
atggccggggaggatgtgggcgcccccccagaccacctgtgggtgcaccaggagggcatctacagagatgagtaccagaggacctgggtggccgtggtggaggaggagaccagcttcctgcgggcccgggtgcagcagatccaggtgcccctgggagatgctgcccggcccagccacctgctgaccagccagctgcccctgatgtggcagctgtacccagaggagcgctacatggacaacaacagccggctgtggcagatccagcaccacctgatggtgcggggcgtgcaggagctgctgctgaagctgctgcctgatgactag

SEQ ID NO: 39925 - DNA, 3345 bp, Artificial Sequence
  Description of Artificial Sequence: Synthetic coding sequence
atgctgagctgcctgaaggaggagatgccaccccaggagctgacccggcggctggccaccgtcatcacccacgtggatgagatcatgcagcaggaggtgcggcccctgatggctgtggagatcatcgagcagctgcaccggcagtttgccatcctgagcggcggccgcggggaggatggagcccccatcatcaccttccctgagttcagcggcttcaagcacatcccagatgaggacttcctgaatgtgatgacctacctgaccagcatccccagcgtggaggccgccagcatcggcttcatcgtggtgattgacagaagaagagacaagtggagctctgtgaaggccagcctgaccagaattgctgtggccttccctggcaacctgcagctgatcttcatcctgcggcccagccgcttcatccagaggaccttcacagacatcggcatcaagtactacagaaatgagttcaagaccaaggtgcccatcatcatggtgaacagcgtgtctgacctgcacggctacatcgacaagagccagctgacccgggagctgggcggcaccctggagtacagacatggccagtgggtgaaccacaggacagccatcgagaactttgccctgaccctgaagaccacagcccagatgctgcagaccttcggcagctgcctggccacagctgagctgcccaggtccatgctgagcacagaggacctgctgatgagccacacccggcagagggacaagctgcaggatgagctgaagctgctgggcaagcagggcaccaccctgctgagctgcatccaggagcccgccaccaagtgccccaacagcaagctgaacctgaaccagctggagaatgtgaccaccatggagcggctgctggtgcagctggatgaaacagagaaggccttcagccacttctggagcgagcaccacctgaagctgaaccagtgcctgcagctgcagcactttgaacatgacttctgcaaggccaagctggccctggacaacctgctggaggagcaggccgagttcaccggcattggagacagcgtgatgcacgtggagcagatcctgaaggagcacaagaagctggaggagaagagccaggagcccctggagaaggcccagctgctggccctggtgggggaccagctgatccagagccaccactacgccgcagatgccatccggccccgctgtgtggagctgcggcacctgtgtgatgacttcatcaatggaaacaagaagaagtgggacatcctgggcaagagcctggagttccaccggcagctggacaaggtgtcccagtggtgtgaggccggcatctacctgctggccagccaggccgtggacaagtgccagagccgggagggcgtggacatcgccctgaatgacatcgccaccttcctgggcaccgtgaaggagtaccccctgctgagccccaaggagttctacaatgaatttgagctgctgctgaccctggatgccaaggccaaggcccagaaggtgctgcagaggctggatgatgtgcaggagatcttccacaagaggcaggtgtccctgatgaagctggccgccaagcagaccaggcctgtgcagcctgtggccccccaccctgagagcagccccaagtgggtgagcagcaagaccagccagcccagcacctctgtgcccctggcccggcccctgcggaccagcgaggagccctacacagaaacagagctgaacagccggggcaaggaggatgatgagaccaagtttgaggtgaagtctgaggagatctttgagagccaccacgagcggggcaaccctgagctggagcagcaggcccggctgggggacctgagcccccggcggcgcatcatccgggacctgctggagacagaggagatctacatcaaggagatcaagagcatcattgatggctacatcacccccatggacttcatctggctgaagcacctgatcccagatgtgctgcagaacaacaaggacttcctgtttggaaacatccgggagctgtatgagttccacaacagaaccttcctgaaggagctggagaagtgtgctgaaaatcctgagctgctggcccactgcttcctgaagaggaaagaagacctgcagatctacttcaagtaccacaagaacctgccccgggcccgggccatctggcaggagtgccaggactgtgcctactttggagtgtgccagaggcagctggaccacaacctgcccctcttcaagtacctgaagggccccagccagaggctcatcaagtaccagatgctgctgaagggcctgctggactttgagagccctgaggacatggagattgaccccggggagctgggcggcagcgccaaggatggccccaagaggaccaaggacagcgccttcagcacagagctgcagcaggccctggccgtgattgaagatctcatcaagagctgtgagctggccgtggacctggccgctgtgacagagtgcccagatgacatcggcaagctgggcaagctgctgctgcacggccccttctctgtgtggaccatccacaaggaccgctacaagatgaaggacctgatccgcttcaagcccagccagaggcagatctacctgtttgagcggggcatcgtgttctgcaagatccgcatggagcccggggaccagggcctgagcccccactacagcttcaagaagaccatgaagctgatgaccctgagcatccggcagctgggccggggcagccacaggaagtttgaaattgccagcagaaatggcctggagaagtacatcctgcaggccgccagcaaggagatccgggactgctggttcagcgagatcagcaagctgctgatggagcagcagaacaacatcaaggaccagggcaacccccagtttgagatgagcaccagcaagggcagcggggccggcagcggcccctggatcaagaacatggagcgggccaccaccagcaaagaagatcctgccagcagcactggaggcatcaagggctgcagcagccgggagttcagctccatggacacctttgaggactgtgagggcgctgaggacatggagaaggagagcagcgccctgagcctggccggcctcttccagagtgatgacagccatgagacctgcagcagcaagagcgccttcctggagcggggggagagcagccagggcgagaaggaggagagagatgaggaggagacagccaccaggagcacagaggaggagcgggccggggccagcacaggccgcctggccccagctggggccacagctggcttccaggcccgggccctgcggcccaggaccagcgcccaggagagctag

SEQ ID NO: 39926 - DNA, 1887 bp, Artificial Sequence
  Description of Artificial Sequence: Synthetic coding sequence
atgctgagctgcctgaaggaggagatgccaccccaggagctgacccggcggctggccaccgtcatcacccacgtggatgagatcatgcagcaggaggtgcggcccctgatggctgtggagatcatcgagcagctgcaccggcagtttgccatcctgagcggcggccgcggggaggatggagcccccatcatcaccttccctgagttcagcggcttcaagcacatcccagatgaggacttcctgaatgtgatgacctacctgaccagcatccccagcgtggaggccgccagcatcggcttcatcgtggtgattgacagaagaagagacaagtggagctctgtgaaggccagcctgaccagaattgctgtggccttccctggcaacctgcagctgatcttcatcctgcggcccagccgcttcatccagaggaccttcacagacatcggcatcaagtactacagaaatgagttcaagaccaaggtgcccatcatcatggtgaacagcgtgtctgacctgcacggctacatcgacaagagccagctgacccgggagctgggcggcaccctggagtacagacatggccagtgggtgaaccacaggacagccatcgagaactttgccctgaccctgaagaccacagcccagatgctgcagaccttcggcagctgcctggccacagctgagctgcccaggtccatgctgagcacagaggacctgctgatgagccacacccggcagagggacaagctgcaggatgagctgaagctgctgggcaagcagggcaccaccctgctgagctgcatccaggagcccgccaccaagtgccccaacagcaagctgaacctgaaccagctggagaatgtgaccaccatggagcggctgctggtgcagctggatgaaacagagaaggccttcagccacttctggagcgagcaccacctgaagctgaaccagtgcctgcagctgcagcactttgaacatgacttctgcaaggccaagctggccctggacaacctgctggaggagcaggccgagttcaccggcattggagacagcgtgatgcacgtggagcagatcctgaaggagcacaagaagctggaggagaagagccaggagcccctggagaaggcccagctgctggccctggtgggggaccagctgatccagagccaccactacgccgcagatgccatccggccccgctgtgtggagctgcggcacctgtgtgatgacttcatcaatggaaacaagaagaagtgggacatcctgggcaagagcctggagttccaccggcagctggacaaggtgtcccagtggtgtgaggccggcatctacctgctggccagccaggccgtggacaagtgccagagccgggagggcgtggacatcgccctgaatgacatcgccaccttcctgggcaccgtgaaggagtaccccctgctgagccccaaggagttctacaatgaatttgagctgctgctgaccctggatgccaaggccaaggcccagaaggtgctgcagaggctggatgatgtgcaggagatcttccacaagaggcaggtgtccctgatgaagctggccgccaagcagaccaggcctgtgcagcctgtggccccccaccctgagagcagccccaagtgggtgagcagcaagaccagccagcccagcacctctgtgcccctggcccggcccctgcggaccagcgaggagccctacacagaaacagagctgaacagccggggcaaggaggatgatgagaccaagtttgaggtgaagtctgaggagatctttgagagccaccacgagcggggcaaccctgagctggagcagcaggcccggctgggggacctgagcccccggcgctacagcagccagtacttcaagtag

SEQ ID NO: 39927 - DNA, 519 bp, Artificial Sequence
  Description of Artificial Sequence: Synthetic coding sequence
atgcacgtggagctgcggcacctgtgtgatgacttcatcaatggaaacaagaagaagtgggacatcctgggcaagagcctggagttccaccggcagctggacaaggccaaggcccagaaggtgctgcagaggctggatgatgtgcaggagatcttccacaagaggcaggtgtccctgatgaagctggccgccaagcagaccaggcctgtgcagcctgtggccccccaccctgagagcagccccaagtgggtgagcagcaagaccagccagcccagcacctctgtgcccctggcccggcccctgcggaccagcgaggagccctacacagaaacagagctgaacagccggggcaaggaggatgatgagaccaagtttgaggtgaagtctgaggagatctttgagagccaccacgagcggggcaaccctgagctggagcagcaggcccggctgggggacctgagccccaggagcgtcatcaccgtgtgtgtgtgtgagatgctgaccctgggcgtgcagtag

SEQ ID NO: 39928 - DNA, 2136 bp, Artificial Sequence
  Description of Artificial Sequence: Synthetic coding sequence
atgctgagctgcctgaaggaggagatgccaccccaggagctgacccggcggctggccaccgtcatcacccacgtggatgagatcatgcagcaggaggtgcggcccctgatggctgtggagatcatcgagcagctgcaccggcagtttgccatcctgagcggcggccgcggggaggatggagcccccatcatcaccttccctgagttcagcggcttcaagcacatcccagatgaggacttcctgaatgtgatgacctacctgaccagcatccccagcgtggaggccgccagcatcggcttcatcgtggtgattgacagaagaagagacaagtggagctctgtgaaggccagcctgaccagaattgctgtggccttccctggcaacctgcagctgatcttcatcctgcggcccagccgcttcatccagaggaccttcacagacatcggcatcaagtactacagaaatgagttcaagaccaaggtgcccatcatcatggtgaacagcgtgtctgacctgcacggctacatcgacaagagccagctgacccgggagctgggcggcaccctggagtacagacatggccagtgggtgaaccacaggacagccatcgagaactttgccctgaccctgaagaccacagcccagatgctgcagaccttcggcagctgcctggccacagctgagctgcccaggtccatgctgagcacagaggacctgctgatgagccacacccggcagagggacaagctgcaggatgagctgaagctgctgggcaagcagggcaccaccctgctgagctgcatccaggagcccgccaccaagtgccccaacagcaagctgaacctgaaccagctggagaatgtgaccaccatggagcggctgctggtgcagctggatgaaacagagaaggccttcagccacttctggagcgagcaccacctgaagctgaaccagtgcctgcagctgcagcactttgaacatgacttctgcaaggccaagctggccctggacaacctgctggaggagcaggccgagttcaccggcattggagacagcgtgatgcacgtggagcagatcctgaaggagcacaagaagctggaggagaagagccaggagcccctggagaaggcccagctgctggccctggtgggggaccagctgatccagagccaccactacgccgcagatgccatccggccccgctgtgtggagctgcggcacctgtgtgatgacttcatcaatggaaacaagaagaagtgggacatcctgggcaagagcctggagttccaccggcagctggacaaggtgtcccagtggtgtgaggccggcatctacctgctggccagccaggccgtggacaagtgccagagccgggagggcgtggacatcgccctgaatgacatcgccaccttcctgggcaccgtgaaggagtaccccctgctgagccccaaggagttctacaatgaatttgagctgctgctgaccctggatgccaaggccaaggcccagaaggtgctgcagaggctggatgatgtgcaggagatcttccacaagaggcaggtgtccctgatgaagctggccgccaagcagaccaggcctgtgcagcctgtggccccccaccctgagagcagccccaagtgggtgagcagcaagaccagccagcccagcacctctgtgcccctggcccggcccctgcggaccagcgaggagccctacacagaaacagagctgaacagccggggcaaggaggatgatgagaccaagtttgaggtgaagtctgaggagatctttgagagccaccacgagcggggcaaccctgagctggagcagcaggcccggctgggggacctgagcccccggcggcgcatcatccgggacctgctggagacagaggagatctacatcaaggagatcaagagcatcattgatggctacatcacccccatggacttcatctggctgaagcacctgatcccagatgtgctgcagaacaacaaggacttcctgtttggaaacatccgggagctgtatgagttccacaacagaaccttcctgaaggagctggagaagtgtgctgaaaatcctgagctgctggcccactgcttcctgaagagggtgtccctgtacagccagtag

SEQ ID NO: 39929 - DNA, 3225 bp, Artificial Sequence
  Description of Artificial Sequence: Synthetic coding sequence
atgctgagctgcctgaaggaggagatgccaccccaggagctgacccggcggctggccaccgtcatcacccacgtggatgagatcatgcagcaggaggtgcggcccctgatggctgtggagatcatcgagcagctgcaccggcagtttgccatcctgagcggcggccgcggggaggatggagcccccatcatcaccttccctgagttcagcggcttcaagcacatcccagatgaggacttcctgaatgtgatgacctacctgaccagcatccccagcgtggaggccgccagcatcggcttcatcgtggtgattgacagaagaagagacaagtggagctctgtgaaggccagcctgaccagaattgctgtggccttccctggcaacctgcagctgatcttcatcctgcggcccagccgcttcatccagaggaccttcacagacatcggcatcaagtactacagaaatgagttcaagaccaaggtgcccatcatcatggtgaacagcgtgtctgacctgcacggctacatcgacaagagccagctgacccgggagctgggcggcaccctggagtacagacatggccagtgggtgaaccacaggacagccatcgagaactttgccctgaccctgaagaccacagcccagatgctgcagaccttcggcagctgcctggccacagctgagctgcccaggtccatgctgagcacagaggacctgctgatgagccacacccggcagagggacaagctgcaggatgagctgaagctgctgggcaagcagggcaccaccctgctgagctgcatccaggagcccgccaccaagtgccccaacagcaagctgaacctgaaccagctggagaatgtgaccaccatggagcggctgctggtgcagctggatgaaacagagaaggccttcagccacttctggagcgagcaccacctgaagctgaaccagtgcctgcagctgcagcactttgaacatgacttctgcaaggccaagctggccctggacaacctgctggaggagcaggccgagttcaccggcattggagacagcgtgatgcacgtggagcagatcctgaaggagcacaagaagctggaggagaagagccaggagcccctggagaaggcccagctgctggccctggtgggggaccagctgatccagagccaccactacgccgcagatgccatccggccccgctgtgtggagctgcggcacctgtgtgatgacttcatcaatggaaacaagaagaagtgggacatcctgggcaagagcctggagttccaccggcagctggacaaggtgtcccagtggtgtgaggccggcatctacctgctggccagccaggccgtggacaagtgccagagccgggagggcgtggacatcgccctgaatgacatcgccaccttcctgggcaccgtgaaggagtaccccctgctgagccccaaggagttctacaatgaatttgagctgctgctgaccctggatgccaaggccaaggcccagaaggtgctgcagaggctggatgatgtgcaggagatcttccacaagaggcaggtgtccctgatgaagctggccgccaagcagaccaggcctgtgcagcctgtggccccccaccctgagagcagccccaagtgggtgagcagcaagaccagccagcccagcacctctgtgcccctggcccggcccctgcggaccagcgaggagccctacacagaaacagagctgaacagccggggcaaggaggatgatgagaccaagtttgaggtgaagtctgaggagatctttgagagccaccacgagcggggcaaccctgagctggagcagcaggcccggctgggggacctgagcccccggcggcgcatcatccgggacctgctggagacagaggagatctacatcaaggagatcaagagcatcattgatggctacatcacccccatggacttcatctggctgaagcacctgatcccagatgtgctgcagaacaacaaggacttcctgtttggaaacatccgggagctgtatgagttccacaacagaaccttcctgaaggagctggagaagtgtgctgaaaatcctgagctgctggcccactgcttcctgaagaggaaagaagacctgcagatctacttcaagtaccacaagaacctgccccgggcccgggccatctggcaggagtgccaggactgtgcctactttggagtgtgccagaggcagctggaccacaacctgcccctcttcaagtacctgaagggccccagccagaggctcatcaagtaccagatgctgctgaagggcctgctggactttgagagccctgaggacatggagattgaccccggggagctgggcggcagcgccaaggatggccccaagaggaccaaggacagcgccttcagcacagagctgcagcaggccctggccgtgattgaagatctcatcaagagctgtgagctggccgtggacctggccgctgtgacagagtgcccagatgacatcggcaagctgggcaagctgctgctgcacggccccttctctgtgtggaccatccacaaggaccgctacaagatgaaggacctgatccgcttcaagcccagccagaggcagatctacctgtttgagcggggcatcgtgttctgcaagatccgcatggagcccggggaccagggcctgagcccccactacagcttcaagaagaccatgaagctgatgaccctgagcatccggcagctgggccggggcagccacaggaagtttgaaattgccagcagaaatggcctggagaagtacatcctgcaggccgccagcaaggagatccgggactgctggttcagcgagatcagcaagctgctgatggagcagcagaacaacatcaaggaccagggcaacccccagtttgagatgagcaccagcaagggcagcggggccggcagcggcccctggatcaagaacatggagcgggccaccaccagcaaagaagatcctgccagcagcactggaggcatcaagggctgcagcagccgggagttcagctccatggacacctttgaggactgtgagggcgctgaggacatggagaaggagagcagcgccctgagcctggccggcctcttccagagtgatgacagccatgagacctgcagcagcaagagcgccttcctggagcggggggagagcagccagggcgagaaggaggagagagatgaggaggagacctag

SEQ ID NO: 39930 - DNA, 360 bp, Artificial Sequence
  Description of Artificial Sequence: Synthetic coding sequence
atggaggagcctgagatgcagctgaagggcaagaaggtgacagacaagttcacagagagcgtgtatgtgctggccaatgagcccagcgtggccctgtaccgcctgcaggagcacgtgcggcgcagcctgcctgagctggcccagcacaaggctgacatgcagcgctgggaggagcagagccagggcgccatctacacagtggagtatgcctgcagcgctgtgaagaacctggtggacagctctgtgtacttccgctctgtggagggcctgctgaagcaggccatcagcatccgggaccacatgaatgccagcgcccagggccacagccctgaggagcccccaccacccagcagcgcctag

SEQ ID NO: 39931 - DNA, 330 bp, Artificial Sequence
  Description of Artificial Sequence: Synthetic coding sequence
atggaggagcctgagatgcagctgaagggcaagaaggtgacagacaagttcacagagagcgtgtatgtgctggccaatgagcccagcgtggccctgtaccgcctgcaggagcacgtgcggcgcagcctgcctgagctggcccagcacaaggctgacatgcagcgctgggaggagcagagccagggcgccatctacacagtggagtatgcctgcagcgctgtgaagaacctggtggacagctctgtgtacttccgctctgtggagggcctgctgaagcaggccatcagcatccgggaccacatgaatgccagcgcccagggccacaggtag

SEQ ID NO: 39932 - DNA, 717 bp, Artificial Sequence
  Description of Artificial Sequence: Synthetic coding sequence
atgctggccctgaccctggccaaggctgacagccccaggacagccctgctgtgcagcgcctggctgctgacagccagcttcagcgcccagcagcacaagggcagcctgcaggtgcaccagaccctgtctgtggagatggaccaggtgctgaaggccctgtccttccccaagaagaaggccgccctgctgtctgctgccatcctgtgcttcctgaggacagccctgcggcagagcttcagcagcgccctggtggccctggtgcccagcggggcccagcccctgcctgccaccaaggacacagtgctggcccccctgaggatgagccaggtgcgcagcctggtgattggcctgcagaacctgctggtgcagaaggaccccctgctgagccaggcctgtgtgggctgcctggaggccctgctggactacctggatgcccggagcccagacatcgccctgcacgtggccagccagccctggaaccgcttcctgctcttcaccctgctggatgctggggagaacagcttcctgcggcctgagatcctgcggctgatgaccctgctgcagagcatgggccacctggccgaccacagcatggcccagaccctgcaggccagcctggagggcctgccccccagcaccagcagcggccagccccccctgcaggacatgctgtgcctgggcggcgtggccgtgtccctgagccacatcagaaattag

SEQ ID NO: 39933 - DNA, 1824 bp, Artificial Sequence
  Description of Artificial Sequence: Synthetic coding sequence
atgtgcctgaacctgctgagcgcccctgagaagacaggcccccccagcaaggaggagctgtctgctgtgtctgagctgctgcagcacggcctgccccagatcagcagccgcagccctgagagcctggccttcctgagtgaccggcagtacatggagggcgccgcccggcagaggcagtactgcatcctgctgctcttctacctggcctacatccatgaagatagatttgtgtctgaggccgagctgtttgaagctgtgcagagcttcctgctgagcctgcaggaccagggcgagcggccccccctggtggtgttcaaggccagcatctacctgctggccatctgccaggacaaggacaacaccctgcgggagaccatggtgtctgccatcaggaagttcctggagggcatcccagacctgcagctggtgtacacccaccaccccctgctgctgcgcttcttcctgctgtacccagagctgatgagccgctatggccaccgggtgctggagctgtggttcttctgggaggagagcagctatgaggagctggatgatgtgaccagcgctggccagcctgccctgcctgccagcctggtggtgctcttccagctgctgcggagcatccccagcatcctgctgatcctgctggacctgatctacagcagccctgtggacacagcccacaaggtgctgatcagcctgcggaccttcctgcggagaaatgaagacatccaggtgggcggcctcatccggggccacttcctgctgatcctgcagaggctgctggtggagcacggggccagccccagcggcgtgtccaagctgtgtgggaagtgcagccccacagatgtggacatcctgcagcccagcttcaacttcctgtactggagcctgcaccagaccacccccagcagccagaagagagctgctgctgtgctgctgagcagcacaggcctgatggagctgctggagaagatgctggccctgaccctggccaaggctgacagccccaggacagccctgctgtgcagcgcctggctgctgacagccagcttcagcgcccagcagcacaagggcagcctgcaggtgcaccagaccctgtctgtggagatggaccaggtgctgaaggccctgtccttccccaagaagaaggccgccctgctgtctgctgccatcctgtgcttcctgaggacagccctgcggcagagcttcagcagcgccctggtggccctggtgcccagcggggcccagcccctgcctgccaccaaggacacagtgctggcccccctgaggatgagccaggtgcgcagcctggtgattggcctgcagaacctgctggtgcagaaggaccccctgctgagccaggcctgtgtgggctgcctggaggccctgctggactacctggatgcccggagcccagacatcgccctgcacgtggccagccagccctggaaccgcttcctgctcttcaccctgctggatgctggagaaaattccttcctgcggcctgagatcctgcggctgatgaccctcttcatgagataccgcagcagctctgtgctgagccatgaggaggtgggagatgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgtccctgagccacatccggaactag

SEQ ID NO: 39934 - DNA, 3825 bp, Artificial Sequence
  Description of Artificial Sequence: Synthetic coding sequence
atggctgtgcggcaggccgccacagctggcaccccaggcccccggcgggaggaggaggccgccctgctgtttgagcgggcccactacagacatgacccccgctggctgctgcctgtgaccccccggctgtgcctggcctgtgccctggagctgctgcctgaccccggggtgtccctggtgaggaagaagcacatgctgagctgcttccaggatgccctggtgcgccacaccagcctggtgacccagctggtgtcccaggaccagagggtgtgcatccacttcatctctgtgctgtttggcctgctgtgcagcatggaggatggctctgtgacagacctgtgcatcgaggtgctgatccagatcaccacccagctgaagctggagcagaccatccgctgcctgctggatgagtgccacaaggagctgtgcaacatgcccagcatgaggggcagcctggccaccctgaccctgctgggcaagctggtggatgccatcccagccctggctgatgagctggtgatggagcacggcaacctgatggagcacctgctgcggggcctggtgtaccccagcgagggcatccaggcctctgtgtgctacctgtatggcaagctgtacagcagccctgtggccgctgagatgctgagcggccacttccgggagaagctgttccccctcttcctgagcatcctggatggagcccagaccaaggagctgcagatcaactgcctgggcctgctgcggcagctgctgaagtatgacctgtttgtgtccatgatcatgaaccaggacggcctgggggagagcgccaagaacatcgagggcagcagcggcaacaccagcctgcccctggtgctgaagaagctgctgctgagcagagatgagaccctgcaggtggccagcgcccactgcatcacagctgtgctggtgcacagccctgccaagcacgccagcgccttcatccatgctgacatccctgagttcctgtttgagcacctgagcagcagcagcgaggtgctggtgtggagcagctgcaactgcctgaccctgctggtggaggagcccctcttcttcagcaagtgccacacagtgtatggaattgaagctgtggtgcgcagcctgcagggcagcctgaagatgaacaacatcgagctgcacaagcagggcctgctgctgtttgctgagatcctgacccggcagcctgaggagatcaagctgttcaccagcagcgccatgtgcagagatgctggccgggccctgcaggaggccgtgagcagccctgtgctggaggtggccgctgaggccctgaaggccaccagcgccttcctgaggaaggaccaccagagcaccccacctgtgcagtatggagagctgcaggccctgctggaggccatgctgaacagatgtgccgagttcagccagaccctgctgagcagaagacccctgggccacgccagcagccgggacagcgagaaggccatcctgcagaggggcaagttcctgctgagcaccctggagggcttccgcagcgcctgccgcctggccatcgagttccagagcgagcccagcgcccaggagaaccccttcaccgcccccagcgccaagaaggaggacaccctggaggccttcagcgagttcctgctgagcgcctgtgacagcctgtgcatccccatggtgatgaggcacctggagcagaccacccacccagccctgatggaggtgttcctgagcatcctgcacaacctgtttgtgattgtgccccacatgaaggagaagttcagcaagaagctggccagcagcagcttcatccggctgaccctggagctgaaggcccgcttctgcagcggcctgagccacagcgccctgaaccaggtgtgcagcaacttcctgtactacatgtgcctgaacctgctgagcgcccctgagaagacaggcccccccagcaaggaggagctgtctgctgtgtctgagctgctgcagcacggcctgccccagatcagcagccgcagccctgagagcctggccttcctgagtgaccggcagtacatggagggcgccgcccggcagaggcagtactgcatcctgctgctcttctacctggcctacatccatgaagatagatttgtgtctgaggccgagctgtttgaagctgtgcagagcttcctgctgagcctgcaggaccagggcgagcggccccccctggtggtgttcaaggccagcatctacctgctggccatctgccaggacaaggacaacaccctgcgggagaccatggtgtctgccatcaggaagttcctggagggcatcccagacctgcagctggtgtacacccaccaccccctgctgctgcgcttcttcctgctgtacccagagctgatgagccgctatggccaccgggtgctggagctgtggttcttctgggaggagagcagctatgaggagctggatgatgtgaccagcgctggccagcctgccctgcctgccagcctggtggtgctcttccagctgctgcggagcatccccagcatcctgctgatcctgctggacctgatctacagcagccctgtggacacagcccacaaggtgctgatcagcctgcggaccttcctgcggagaaatgaagacatccaggtgggcggcctcatccggggccacttcctgctgatcctgcagaggctgctggtggagcacggggccagccccagcggggccagcggcaacctgcccctgctgctgagcctgctgagcctgatgcagctgagaaatgtgtctgagcaggagctggacagcgtggccatgaagctgctgcaccaggtgtccaagctgtgtgggaagtgcagccccacagatgtggacatcctgcagcccagcttcaacttcctgtactggagcctgcaccagaccacccccagcagccagaagagagctgctgctgtgctgctgagcagcacaggcctgatggagctgctggagaagatgctggccctgaccctggccaaggctgacagccccaggacagccctgctgtgcagcgcctggctgctgacagccagcttcagcgcccagcagcacaagggcagcctgcaggtgcaccagaccctgtctgtggagatggaccaggtgctgaaggccctgtccttccccaagaagaaggccgccctgctgtctgctgccatcctgtgcttcctgaggacagccctgcggcagagcttcagcagcgccctggtggccctggtgcccagcggggcccagcccctgcctgccaccaaggacacagtgctggcccccctgaggatgagccaggtgcgcagcctggtgattggcctgcagaacctgctggtgcagaaggaccccctgctgagccaggcctgtgtgggctgcctggaggccctgctggactacctggatgcccggagcccagacatcgccctgcacgtggccagccagccctggaaccgcttcctgctcttcaccctgctggatgctggggagaacagcttcctgcggcctgagatcctgcggctgatgaccctcttcatgagataccgcagcagctctgtgctgagccatgaggaggtgggagatgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgtccctgagccacatcagaaattag

SEQ ID NO: 39935 - DNA, 1155 bp, Artificial Sequence
  Description of Artificial Sequence: Synthetic coding sequence
atgggccacccccaccaggagagcagcctcttcttcaccgccagcggcaacctgcccctgctgctgagcctgctgagcctgatgcagctgagaaatgtgtctgagcaggagctggacagcgtggccatgaagctgctgcaccaggtgtccaagctgtgtgggaagtgcagccccacagatgtggacatcctgcagcccagcttcaacttcctgtactggagcctgcaccagaccacccccagcagccagaagagagctgctgctgtgctgctgagcagcacaggcctgatggagctgctggagaagatgctggccctgaccctggccaaggctgacagccccaggacagccctgctgtgcagcgcctggctgctgacagccagcttcagcgcccagcagcacaagggcagcctgcaggtgcaccagaccctgtctgtggagatggaccaggtgctgaaggccctgtccttccccaagaagaaggccgccctgctgtctgctgccatcctgtgcttcctgaggacagccctgcggcagagcttcagcagcgccctggtggccctggtgcccagcggggcccagcccctgcctgccaccaaggacacagtgctggcccccctgaggatgagccaggtgcgcagcctggtgattggcctgcagaacctgctggtgcagaaggaccccctgctgagccaggcctgtgtgggctgcctggaggccctgctggactacctggatgcccggagcccagacatcgccctgcacgtggccagccagccctggaaccgcttcctgctcttcaccctgctggatgctggggagaacagcttcctgcggcctgagatcctgcggctgatgaccctcttcatgagataccgcagcagctctgtgctgagccatgaggaggtgggagatgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgtccctgagccacatcagaaattag

SEQ ID NO: 39936 - DNA, 1521 bp, Artificial Sequence
  Description of Artificial Sequence: Synthetic coding sequence
atgaaccaggacggcctgggggagagcgccaagaacatcgagggcagcagcggcaacaccagcctgcccctggtgctgaagaagctgctgctgagcagagatgagaccctgcaggtggccagcgcccactgcatcacagctgtgctggtgcacagccctgccaagcacgccagcgccttcatccatgctgacatccctgagttcctgtttgagcacctgagcagcagcagcgaggtgctggtgtggagcagctgcaactgcctgaccctgctggtggaggagcccctcttcttcagcaagtgccacacagtgtatggaattgaagctgtggtgcgcagcctgcagggcagcctgaagatgaacaacatcgagctgcacaagcagggcctgctgctgtttgctgagatcctgacccggcagcctgaggagatcaagctgttcaccagcagcgccatgtgcagagatgctggccgggccctgcaggaggccgtgagcagccctgtgctggaggtggccgctgaggccctgaaggccaccagcgccttcctgaggaaggaccaccagagcaccccacctgtgcagtatggagagctgcaggccctgctggaggccatgctgaacagatgtgccgagttcagccagaccctgctgagcagaagacccctgggccacgccagcagccgggacagcgagaaggccatcctgcagaggggcaagttcctgctgagcaccctggagggcttccgcagcgcctgccgcctggccatcgagttccagagcgagcccagcgcccaggagaaccccttcaccgcccccagcgccaagaaggaggacaccctggaggccttcagcgagttcctgctgagcgcctgtgacagcctgtgcatccccatggtgatgaggcacctggagcagaccacccacccagccctgatggaggtgttcctgagcatcctgcacaacctgtttgtgattgtgccccacatgaaggagaagttcagcaagaagctggccagcagcagcttcatccggctgaccctggagctgaaggcccgcttctgcagcggcctgagccacagcgccctgaaccaggtgtgcagcaacttcctgtactacatgtgcctgaacctgctgagcgcccctgagaagacaggcccccccagcaaggaggagctgtctgctgtgtctgagctgctgcagcacggcctgccccagatcagcagccgcagccctgagagcctggccttcctgagtgaccggcagtacatggagggcgccgcccggcagaggcagtactgcatcctgctgctcttctacctggcctacatccatgaagatagatttgtgtctgaggccgagctgtttgaagctgtgcagagcttcctgctgagcctgcaggaccagggcgagcggccccccctggtggtgttcaaggccagcatctacctgctggccatctgccaggacaaggacaacaccctgcgggagcagctgcactgcagcctcatcagcatctcctag

SEQ ID NO: 39937 - DNA, 810 bp, Artificial Sequence
  Description of Artificial Sequence: Synthetic coding sequence
atggagggcgccgcccggcagaggcagtactgcatcctgctgctcttctacctggcctacatccatgaagatagatttgtgtctgaggccgagctgtttgaagctgtgcagagcttcctgctgagcctgcaggaccagggcgagcggccccccctggtggtgttcaaggccagcatctacctgctggccatctgccaggacaaggacaacaccctgcgggagaccatggtgtctgccatcaggaagttcctggagggcatcccagacctgcagctggtgtacacccaccaccccctgctgctgcgcttcttcctgctgtacccagagctgatgagccgctatggccaccgggtgctggagctgtggttcttctgggaggagagcagctatgaggagctggatgatgtgaccagcgctggccagcctgccctgcctgccagcctggtggtgctcttccagctgctgcggagcatccccagcatcctgctgatcctgctggacctgatctacagcagccctgtggacacagcccacaaggtgctgatcagcctgcggaccttcctgcggagaaatgaagacatccaggtgggcggcctcatccggggccacttcctgctgatcctgcagaggctgctggtggagcacggggccagccccagcggcgtgctgctggtgctgcacagcctgggggagcccaccatcgctgctgagccccccctgcctgatgctgcccaggagtgtgtgcgggccaggacaggccagaggggccacgaggcccccagcccccgctgccccggctgcctgggctag

SEQ ID NO: 39938 - DNA, 1203 bp, Artificial Sequence
  Description of Artificial Sequence: Synthetic coding sequence
atgagcaaggtgtccaccatgttttctgaagatgacttccagagcacagagcgggccccctacggcccccagctgcagtggagccaggacctgccccgggtgcaggtgttccgggagcaggccaacctggaggacaggagccccaggaggacccagaggatcactggaggagagcaggtgctgtggggccccatcacccagatcttccccaccgtgcggcctgctgacctgaccagggtcatcatgcccctggagcagaggagccagcactgcaagccagaggagggcctgcaggcccaggaggaggacctgggcctggtgggcgcccaggccctgcaggccgaggagcaggaggccgccttcttcagcagcaccctgaatgtgggcaccctggaggagctgcctgctgctgagagccccagccccccccagagcccccaggaggagagcttcagccccacagccatggatgccatcttcggcagcctgagtgatgagggcagcggcagccaggagaaggagggccccagcaccagcccagacctgattgatcctgagagcttcagccaggacatcctgcatgacaagatcatcgacctggtgcacctgctgctgaggaagtacagagtgaagggcctcatcaccaaggccgagatgctgggcagcgtcatcaagaactatgaggactacttccctgagatcttccgggaggcctctgtgtgcatgcagctgctgtttggaattgatgtgaaggaggtggaccccaccagccacagctatgtgctggtgaccagcctgaacctgtcctatgatggcatccagtgcaatgagcagagcatgcccaagagcggcctgctgatcatcgtgctgggcgtcatcttcatggagggcaactgcatccctgaggaggtgatgtgggaggtgctgagcatcatgggcgtgtatgccggccgggagcacttcctgtttggagagcccaagaggctgctgacccagaactgggtgcaggagaagtacctggtgtaccggcaggtgcccggcacagatcctgcctgctatgagttcctgtggggcccccgggcccatgctgagaccagcaagatgaaggtgctggagtacatcgccaatgccaacggccgggaccccaccagctaccccagcctgtatgaagatgccctgcgggaggagggggagggcgtgtag

SEQ ID NO: 39939 - DNA, 957 bp, Artificial Sequence
  Description of Artificial Sequence: Synthetic coding sequence
atgctgctgggccagaagagccagcgctacaaggccgaggagggcctgcaggcccagggcgaggcccctggcctgatggatgtgcagatccccacagctgaggagcagaaggccgccagcagcagcagcaccctcatcatgggcaccctggaggaggtgacagacagcggcagccccagccccccccagagccctgagggcgccagcagcagcctgactgtgacagacagcaccctgtggagccagagtgatgagggcagcagcagcaatgaggaggagggccccagcaccagcccagaccctgcccacctggagagcctcttccgggaggccctggatgagaaggtggccgagctggtgcgcttcctgctgaggaagtaccagatcaaggagcctgtgaccaaggccgagatgctggagagcgtcatcaagaactacaagaaccacttcccagacatcttcagcaaggccagcgagtgcatgcaggtgatctttggaattgatgtgaaggaggtggaccctgctggccacagctacatcctggtgacctgcctgggcctgtcctatgatggcctgctgggagatgaccagagcacccccaagacaggcctgctgatcatcgtgctgggcatgatcctgatggagggcagccgggcccctgaggaggccatctgggaggccctgtctgtgatgggcctgtatgatggccgggagcacagcgtgtactggaagctgaggaagctgctgacccaggagtgggtgcaggagaactacctggagtaccggcaggcccctggcagtgaccctgtgcgctatgagttcctgtggggcccccgggccctggccgagaccagctatgtgaaggtgctggagcacgtggtgcgggtgaatgcccgggtgcgcatctcctaccccagcctgcacgaggaggccctgggggaggagaagggcgtgtag

SEQ ID NO: 39940 - DNA, 957 bp, Artificial Sequence; identical to SEQ ID NO: 39939
  Description of Artificial Sequence: Synthetic coding sequence

SEQ ID NO: 39941 - DNA, 957 bp, Artificial Sequence; identical to SEQ ID NO: 39939
  Description of Artificial Sequence: Synthetic coding sequence

SEQ ID NO: 39942 - DNA, 945 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaaccaggaggaggagggccccaggatgtttcctgacctggagagcgagttccaggccgccatcagcaggaagatggtggagctggtgcacttcctgctgctgaagtaccgggcccgggagcctgtgaccaaggccgagatgctggagagcgtgctgaggaactgccaggacttcttccctgtgatcttcagcaaggccagcgagtacctgcagctggtgtttggcatcgaggtggtggaggtggtgcccatcagccacctgtacatcctggtgacctgcctgggcctgtcctatgatggcctgctgggggacaaccaggtgatgcccaagacaggcctgctgatcatcgtgctggccatcatcgccattgaaggagactgtgcccctgaggagaagatctgggaggagctgtccatgctggaggtgtttgagggcagagaagattctgtgtttgcccaccccaggaagctgctgatgcaggacctggtgcaggagaactacctggagtaccggcaggtgcccggcagtgaccctgcctgctatgagttcctgtggggcccccgggccctgattgagaccagctatgtgaaggtgctgcaccacaccctgaagattggaggagagccccacatctcctacccacccctgcacgagcgggccctgcgggagggggaggagtag

SEQ ID NO: 39943 - DNA, 945 bp, Artificial Sequence; identical to SEQ ID NO: 39942
  Description of Artificial Sequence: Synthetic coding sequence

SEQ ID NO: 39944 - DNA, 102 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacctag

SEQ ID NO: 39945 - DNA, 363 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaaccaggaggaggagggccccaggatgtttcctgacctggagagcgagttccaggccgccatcagcaggaagatggtggagctggtgcacttcctgtag

SEQ ID NO: 39946 - DNA, 459 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaaccaggaggaggagggccccaggatgtttcctgacctggagagcgagttccaggccgccatcagcaggaagatggtggagctggtgcacttcctgctgctgaagtaccgggcccgggagcctgtgaccaaggccgagatgctggagagcgtgctgaggaactgccaggacttcttccctgtgatcttctcctag

SEQ ID NO: 39947 - DNA, 270 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaactag

SEQ ID NO: 39948 - DNA, 447 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaaccaggaggaggagggccccaggatgtttcctgacctggagagcgagttccaggccgccatcagcaggaagatggtggagctggtgcacttcctgctgctgaagtaccgggcccgggagcctgtgaccaaggccgagatgctggagagcgtgctgaggaactgccaggacttcttcccctag

SEQ ID NO: 39949 - DNA, 114 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagtag

SEQ ID NO: 39950 - DNA, 1032 bp, Artificial Sequence
  Description of Artificial Sequence: Synthetic coding sequence
atgccccggggccagaagagcaagctgcgggcccgggagaagaggcaccaggcccgctgtgagaaccaggacctgggcgccacccaggccaccgtggccgagggggagagccccagccctgcctacctgctgtttggagaccggccccagaacctgcctgctgctgagacccccagcatccctgaggccctgcagggcgcccccagcaccaccaatgccatcgcccctgtgtcctgcagcagcaatgaaggagccagcagccaggatgagaagagcctgggcagcagccgggaggccgagggctggaaggaggaccccctgaacaagaaggtggtgtccctggtgcacttcctgctgcagaagtatgagaccaaggagcccatcaccaagggggacatgatcaagtttgtgatcaggaaggacaagtgccacttcaatgagatcctgaagagggccagcgagcacatggagctggccctgggcgtggacctgaaggaggtggaccccatccgccactactatgccttcttcagcaagctggacctgacctatgatgagaccaccagtgatgaggagaagatccccaagacaggcctgctgatgattgccctgggcgtcatcttcctgaatggaaacagagcccctgaggaggccgtgtgggagatcatgaacatgatgggcgtgtatgctgacaggaagcacttcctgtatggagaccccaggaaggtgatgaccaaggacctggtgcagctgaagtacctggagtaccagcaggtgcccaacagcgacccccccaggtatgagttcctgtggggcccccgggcccatgctgagaccagcaagatgaaggtgctggagtttgtggccaagatccatgacacagtgcccagcgccttccccagctgctatgaggaggccctgagagatgaggagcagaggacccaggcccgggctgctgcccgggcccacacagctgccatggccaatgcccggagcaggaccaccagcagcagcttcagccacgccaagtag

SEQ ID NO: 39951 - DNA, 2337 bp, Artificial Sequence
  Description of Artificial Sequence: Synthetic coding sequence
atggcccagaagatggactgtggggccggcctgctgggcttccaggccgaggcctctgtggaggacagcgccctgctgatgcagaccctgatggaggccatccagatcagcgaggccccacccaccaaccaggccacagctgctgccagcccccagagcagccagcccccaacagccaatgagatggctgacatccaggtgtctgctgctgctgcccggcccaagagcgccttcaaggtgcagaatgccaccaccaagggccccaatggagtgtatgacttcagccaggcccacaatgccaaggatgtgcccaacacccagcccaaggccgccttcaagagccagaatgccacccccaagggccccaatgctgcctatgacttcagccaggccgccaccaccggggagctggccgccaacaagtctgagatggccttcaaggcccagaatgccaccaccaaggtgggccccaatgccacctacaacttcagccagagcctgaatgccaatgacctggccaacagccggcccaagacccccttcaaggcctggaatgacaccaccaaggcccccacagctgacacccagacccagaatgtgaaccaggccaagatggccaccagccaggccgacatcgagacagaccccggcatcagcgagccagatggagccacagcccagaccagcgcagatggcagccaggcccagaacctggagagcaggaccatcatccggggcaagaggaccaggaagatcaacaacctgaatgtggaggagaacagcagcggggaccagaggcgggcccccctggccgccggcacctggaggtctgcccctgtgcctgtgaccacccagaaccccccaggggcccccccaaatgtgctgtggcagacccccctggcctggcagaaccccagcggctggcagaaccagacagcccggcagaccccaccagcccggcagagccccccagcccggcagaccccaccagcctggcagaaccctgtggcctggcagaaccctgtgatctggcccaaccctgtgatctggcagaaccctgtgatctggcccaaccccatcgtgtggccaggccctgtggtgtggcccaaccccctggcctggcagaaccccccaggctggcagaccccacctggctggcagaccccacctggctggcagggccccccagactggcagggccccccagactggcccctgcccccagactggcccctgcccccagactggcccctgcccacagactggcccctgcccccagactggatcccagctgactggcccatccccccagactggcagaacctgcggcccagccccaacctgcggcccagccccaacagccgggccagccagaaccctggggccgcccagcccagagatgtggccctgctgcaggagcgggccaacaagctggtgaagtacctgatgctgaaggactacaccaaggtgcccatcaagaggtctgagatgctgcgggacatcatccgggagtacacagatgtgtacccagagatcatcgagcgggcctgctttgtgctggagaagaagtttggcatccagctgaaggagattgacaaggaggagcacctgtacatcctgatcagcaccccagagagcctggccggcatcctgggcaccaccaaggacacccccaagctgggcctgctgctggtgatcctgggcgtcatcttcatgaatggaaacagagccagcgaggccgtgctgtgggaggccctgaggaagatgggcctgcggcctggggtgcgccaccccctgctgggggacctgaggaagctgctgacctatgaatttgtgaagcagaagtacctggactaccgccgggtgcccaacagcaaccccccagaatatgagttcctgtggggcctgcggagctaccacgagaccagcaagatgaaggtgctgcgcttcatcgccgaggtgcagaagagggacccccgggactggacagcccagttcatggaggccgcagatgaggccctggatgccctggatgctgctgctgctgaggccgaggcccgggcagaggcccggaccaggatgggcattggagatgaggccgtgtctggcccctggagctgggatgacatcgagtttgagctgctgacctgggatgaggagggggactttggagacccctggagccgcatccccttcaccttctgggcccgctaccaccagaatgcccggagccgcttcccccagacctttgctggccccatcatcggccctgggggcacagccagcgccaactttgctgccaactttggagccatcggcttcttctgggtggagtag

SEQ ID NO: 39952 - DNA, 2337 bp, Artificial Sequence; identical to SEQ ID NO: 39951
  Description of Artificial Sequence: Synthetic coding sequence

SEQ ID NO: 39953 - DNA, 2220 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagtag

SEQ ID NO: 39954 - DNA, 2274 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagaaccctgagctgcgggaggagacccccctgtccatggcccccagctggtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagcacaggtag

SEQ ID NO: 39955 - DNA, 2091 bp, Artificial Sequence
  Description of Artificial Sequence: Synthetic coding sequence
atggagagtgaatatgtgctgtgcaactggaaggaccagctgtggccagccaaggtgctgagccgctctgagaccagcagcaacagcaagaggaagaaggccttcagcctggaggtgcagatcctgagcctggatgagaagatcaagctggacagcacagagaccaagatcctgaacaagagccagatcgaggccatcgccgccagcctgggcctgcagagtgaagattctgccccacccacagaggagacagcctacggccgcagcctgaaggtggccctgggcatcctgaatgaaagaaccaacctgagccaggccagcaccagtgatgaggaggagatcaccatgctgagccagaatgtgccccagaagcagagcgacagccccccccacaagaagtacaggaaggatgaaggagacctgcccggctgcctggaggagagagaaaattctgcctgcctgctggccagcagcgagagtgatgacagcctgtatgatgacaagagccaggcccccaccatggtggacaccatccccagcgaggtggagaccaagagcctgcagaacagctcctggtgtgagaccttccccagcctgtctgaagataatgatgagaaggagaacaagaacaagattgacatctctgctgtgatgtctgtgcacagcgctgtgaaggaggagagcgcctgtgtgaaggatgagaagtttgccccacccctgagccccctgagcagtgacatgctgatcatgcccaaggccctgaaggaggagagcgaggacacctgcctggagaccctggccgtgcccagtgaatgttctgccttctctgaaaatattgaggaccccggggagggccccagcaacccctgcctggacaccagccagaaccagcccagcatggagagcgagatgggcgctgctgcctgccccggcagctgcagccgggagtgtgaggtgtccttcagcgccagcaaccctgtgtgggactacagccacctgatgagcagcgagaggaacttccagaggctggactttgaggagctggaggaggagggccaggccagtgacaagagcctgctgcccagccgcatcaacctgagcctgctggatgatgatgaggaggatgaggagctgccccgcttcatcctgcactatgagacccacccctttgagaccggcatgattgtgtggttcaagtaccagaagtaccccttctggccagctgtgatcaagagcatccggaggaaggagaggaaggcctctgtgctgtttgtggaggccaacatgaacagcgagaagaagggcatccgggtgaacttccggcggctgaagaagtttgactgcaaggagaagcagatgctggtggacaaggcccgggaggactacagcgagagcattgactggtgcatcagcctcatctgtgactacagagtgcgcatcggctgcggcagcttcaccggcagcctgctggagtactatgctgctgacatctcctaccctgtgaggaaggagaccaagcaggacaccttcaggaacaagttccccaagctgcacaatgaagatgcccgggagcccatggctgtgaccagccagaccaagaagatgtccttccagaagatcctgcctgacaggatgaaggccgcccgggaccgggccaacaagaacctggtggacttcatcgtgaatgccaagggcacagagaaccacctgctggccatcgtgaatggcaccaagggcagccgctggctgaagagcttcctgaatgccaaccgcttcaccccctgcatcgagacctactttgaagatgaggaccagctggatgaggtggtgaagtacctgcaggaggtgtgcaaccagattgaccagatcatgcccacctggatcaaggatgacaagatcaagttcatcctggaggtgctgctgcctgaggccatcatctgcagcatctctgctgtggatggcctggactatgaagctgctgaggccaagtacctgaagggcccctgcctgggctaccgggagcgggagctgtttgatgccaagatcatctatgagaagaggaggaaggcccccaccaatgaggcccactag

SEQ ID NO: 39956 - DNA, 2091 bp, Artificial Sequence; identical to SEQ ID NO: 39955
  Description of Artificial Sequence: Synthetic coding sequence

SEQ ID NO: 39957 - DNA, 2091 bp, Artificial Sequence; identical to SEQ ID NO: 39955
  Description of Artificial Sequence: Synthetic coding sequence

SEQ ID NO: 39958 - DNA, 396 bp, Artificial Sequence
  Description of Artificial Sequence: Synthetic coding sequence
atggcccggagcctggtgtgcctgggcgtcatcatcctgctgagcgccttcagcggccctggggtgcggggcggccccatgcccaagctggccgacaggaagctgtgtgccgaccaggagtgcagccaccccatctccatggctgtggccctgcaggactacatggccccagactgccgcttcctgaccatccaccggggccaggtggtgtatgtgttcagcaagctgaagggccggggccgcctcttctggggcggctctgtgcagggcgactactatggagacctggccgcccggctgggctacttccccagcagcatcgtgcgggaggaccagaccctgaagccaggcaaggtggatgtgaagacagacaagtgggacttctactgccagtag

SEQ ID NO: 39959 - DNA, 2226 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagcacaggtag

SEQ ID NO: 39960 - DNA, 4446 bp, Artificial Sequence
  Description of Artificial Sequence: Synthetic coding sequence
atgagcaagaccctgaagaagaagaagcactggctgagcaaggtgcaggagtgtgctgtgtcctgggccggccccccaggggactttggagctgagatccggggcggcgctgagcggggggagttcccctacctgggccgcctgcgggaggagcccggcggcggcacctgctgcgtggtgtctgggaaggcccccagccctggagatgtgctgctggaggtgaatggcacccctgtgtctggcctgaccaacagagacaccctggccgtcatccgccacttccgggagcccatccggctgaagacagtgaagccaggcaaggtgatcaacaaggacctgcggcactacctgagcctgcagttccagaagggcagcattgaccacaagctgcagcaggtgatccgggacaacctgtacctgcggaccatcccctgcaccacccgggcccccagagatggagaggtgcctggggtggactacaacttcatctctgtggagcagttcaaggccctggaggagagcggggccctgctggagagcggcacctatgatggcaacttctacggcacccccaagcccccagctgagcccagccccttccagcctgaccctgtggaccaggtgctgtttgacaatgaatttgatgctgagagccagaggaagaggaccacctctgtgtccaagatggagaggatggacagcagcctgcctgaggaggaggaggatgaggacaaggaggccatcaatggaagtggaaatgcagaaaatcgggagcggcacagcgagagcagtgactggatgaagacagtgcccagctacaaccagaccaacagctccatggacttcaggaactacatgatgagagatgagaccctggagcccctgcccaagaactgggagatggcctacacagacaccggcatgatctacttcatcgaccacaacaccaagaccaccacctggctggacccccggctgtgcaagaaggccaaggcccctgaggactgtgaagatggagagctgccctacggctgggagaagattgaggacccccagtatggcacctactacgtggaccacctgaaccagaagacccagtttgagaaccctgtggaggaggccaagaggaagaagcagctgggccaggtggagatcggcagcagcaagccagacatggagaagagccacttcacccgggaccccagccagctgaagggcgtgctggtgcgggccagcctgaagaagagcaccatgggcttcggcttcaccatcattggaggagacagaccagatgagttcctgcaggtgaagaatgtgctgaaggatggccctgctgcccaggacggcaagatcgcccctggagatgtgattgtggacatcaatggaaactgtgtgctgggccacacccatgctgatgtggtgcagatgttccagctggtgcctgtgaaccagtatgtgaacctgaccctgtgccggggctaccccctgcctgatgacagtgaagatcctgtggtggacatcgtggccgccacccctgtgatcaatggccagagcctgaccaagggggagacctgcatgaacccccaggacttcaagccaggggccatggtgctggagcagaatggcaagagcggccacaccctgactggagatggcctgaatggccccagtgatgccagcgagcagagggtgtccatggccagcagcggcagcagccagcctgagctggtgaccatccccctcatcaagggccccaagggcttcggctttgccatcgctgacagccccaccggccagaaggtgaagatgatcctggacagccagtggtgccagggcctgcagaagggggacatcatcaaggagatctaccaccagaatgtgcagaacctgacccacctgcaggtggtggaggtgctgaagcagtttcctgtgggcgcagatgtgcccctgctgatcctgcggggcggcccccccagccccaccaagacagccaagatgaagacagacaagaaggaaaatgccggcagcctggaggccatcaatgagcccatcccccagcccatgcccttccccccatccatcatccgcagcggcagccccaagctggaccccagcgaggtgtacctgaagagcaagaccctgtatgaggacaagccacccaacaccaaggacctggatgtgttcctgaggaagcaggagagcggcttcggcttccgggtgctgggcggagatggccctgaccagagcatctacatcggggccatcatccccctgggcgctgctgagaaggatggccgcctgcgggcagcagatgagctgatgtgcattgatggcatccctgtgaagggcaagagccacaagcaggtgctggacctgatgaccacagctgccagaaatggacatgtgctgctgactgtgcggaggaagatcttctacggggagaagcagccagaagatgacagcagccaggccttcatcagcacccagaatggcagcccccggctgaacagagctgaggtgcctgcccggcctgccccccaggagccctatgatgtggtgctgcagaggaaagaaaatgaaggcttcggcttcgtcatcctgaccagcaagaacaagcccccacctggggtcatcccccacaagattggccgggtcatcgagggcagccctgctgacagatgtgggaagctgaaggtgggggaccacatctctgctgtgaatggccagagcatcgtggagctgagccatgacaacatcgtgcagctgatcaaggatgctggggtgacagtgaccctgactgtgattgctgaggaggagcaccacggccccccatctggcaccaacagcgcccggcagagccctgccctgcagcaccggcccatgggccagagccaggccaaccacatccctggggacagaagtgccctggagggggagatcggcaaggatgtgtccaccagctaccgccacagctggagcgaccacaagcacctggcccagcctgacacagctgtgatctctgtggtgggcagccgccacaaccagaacctgggctgctaccctgtggagctggagcggggcccccggggcttcggcttcagcctgcggggcggcaaggagtacaacatgggcctcttcatcctgcggctggccgaggatggccctgccatcaaggatggccgcatccacgtgggggaccagatcgtggagatcaacggggagcccacccagggcatcacccacacccgggccatcgagctgatccaggccggcggcaacaaggtgctgctgctgctgcggcccggcaccggcctcatcccagaccatggagactgggacatcaacaaccccagcagcagcaatgtcatctatgatgagcagagccccctgccccccagcagccactttgccagcatctttgaggagagccacgtgcctgtgattgaggagagcctgcgggtgcagatctgtgagaaggccgaggagctgaaggacatcgtgcctgagaagaagagcaccctgaatgaaaaccagcctgagatcaagcaccagagcctgctgcagaagaatgtgtccaagagggacccccccagcagccacggccacagcaacaagaagaacctgctgaaggtggagaatggagtgacccggcggggccgctctgtgagccccaagaagccagccagccagcacagcgaggagcacctggacaagatccccagccccctgaagaacaaccccaagagaagaccccgggaccagagcctgagccccagcaagggggagaacaagagctgccaggtgtccacccgggccggcagcggccaggaccagtgcaggaagagccggggccgcagcgccagccccaagaagcagcagaagattgagggcagcaaggcccccagcaatgctgaggccaagctgctggagggcaagagcagaagaattgctggctacacaggcagcaatgctgagcagatcccagatggcaaggagaagagtgatgtgatcaggaaggatgccaagcagaaccagctggagaagagcaggaccaggagccctgagaagaagatcaagaggatggtggagaagagcctgcccagcaagatgaccaacaagaccaccagcaaggaggtgtctgaaaatgagaagggcaagaaggtgaccaccggggagaccagcagcagcaatgacaagatcggggagaatgtgcagctgtctgagaagaggctgaagcaggagcctgaggagaaggtggtgagcaacaagacagaggaccacaagggcaaggagctggaggccgctgacaagaacaaggagaccggccgcttcaagccagagagcagcagccctgtgaagaagaccctcatcaccccaggcccctggaaggtgcccagcggcaacaaggtgacaggcaccatcggcatggccgagaagaggcagtag

SEQ ID NO: 39961 - DNA, 3378 bp, Artificial Sequence
  Description of Artificial Sequence: Synthetic coding sequence
atgagcaagaccctgaagaagaagaagcactggctgagcaaggtgcaggagtgtgctgtgtcctgggccggccccccaggggactttggagctgagatccggggcggcgctgagcggggggagttcccctacctgggccgcctgcgggaggagcccggcggcggcacctgctgcgtggtgtctgggaaggcccccagccctggagatgtgctgctggaggtgaatggcacccctgtgtctggcctgaccaacagagacaccctggccgtcatccgccacttccgggagcccatccggctgaagacagtgaagccaggcaaggtgatcaacaaggacctgcggcactacctgagcctgcagttccagaagggcagcattgaccacaagctgcagcaggtgatccgggacaacctgtacctgcggaccatcccctgcaccacccgggcccccagagatggagaggtgcctggggtggactacaacttcatctctgtggagcagttcaaggccctggaggagagcggggccctgctggagagcggcacctatgatggcaacttctacggcacccccaagcccccagctgagcccagccccttccagcctgaccctgtggaccaggtgctgtttgacaatgaatttgatgctgagagccagaggaagaggaccacctctgtgtccaagatggagaggatggacagcagcctgcctgaggaggaggaggatgaggacaaggaggccatcaatggaagtggaaatgcagaaaatcgggagcggcacagcgagagcagtgactggatgaagacagtgcccagctacaaccagaccaacagctccatggacttcaggaactacatgatgagagatgagaccctggagcccctgcccaagaactgggagatggcctacacagacaccggcatgatctacttcatcgaccacaacaccaagaccaccacctggctggacccccggctgtgcaagaaggccaaggcccctgaggactgtgaagatggagagctgccctacggctgggagaagattgaggacccccagtatggcacctactacgtggaccacctgaaccagaagacccagtttgagaaccctgtggaggaggccaagaggaagaagcagctgggccaggtggagatcggcagcagcaagccagacatggagaagagccacttcacccgggaccccagccagctgaagggcgtgctggtgcgggccagcctgaagaagagcaccatgggcttcggcttcaccatcattggaggagacagaccagatgagttcctgcaggtgaagaatgtgctgaaggatggccctgctgcccaggacggcaagatcgcccctggagatgtgattgtggacatcaatggaaactgtgtgctgggccacacccatgctgatgtggtgcagatgttccagctggtgcctgtgaaccagtatgtgaacctgaccctgtgccggggctaccccctgcctgatgacagtgaagatcctgtggtggacatcgtggccgccacccctgtgatcaatggccagagcctgaccaagggggagacctgcatgaacccccaggacttcaagccaggggccatggtgctggagcagaatggcaagagcggccacaccctgactggagatggcctgaatggccccagtgatgccagcgagcagagggtgtccatggccagcagcggcagcagccagcctgagctggtgaccatccccctcatcaagggccccaagggcttcggctttgccatcgctgacagccccaccggccagaaggtgaagatgatcctggacagccagtggtgccagggcctgcagaagggggacatcatcaaggagatctaccaccagaatgtgcagaacctgacccacctgcaggtggtggaggtgctgaagcagtttcctgtgggcgcagatgtgcccctgctgatcctgcggggcggcccccccagccccaccaagacagccaagatgaagacagacaagaaggaaaatgccggcagcctggaggccatcaatgagcccatcccccagcccatgcccttccccccatccatcatccgcagcggcagccccaagctggaccccagcgaggtgtacctgaagagcaagaccctgtatgaggacaagccacccaacaccaaggacctggatgtgttcctgaggaagcaggagagcggcttcggcttccgggtgctgggcggagatggccctgaccagagcatctacatcggggccatcatccccctgggcgctgctgagaaggatggccgcctgcgggcagcagatgagctgatgtgcattgatggcatccctgtgaagggcaagagccacaagcaggtgctggacctgatgaccacagctgccagaaatggacatgtgctgctgactgtgcggaggaagatcttctacggggagaagcagccagaagatgacagcagccaggccttcatcagcacccagaatggcagcccccggctgaacagagctgaggtgcctgcccggcctgccccccaggagccctatgatgtggtgctgcagaggaaagaaaatgaaggcttcggcttcgtcatcctgaccagcaagaacaagcccccacctggggtcatcccccacaagattggccgggtcatcgagggcagccctgctgacagatgtgggaagctgaaggtgggggaccacatctctgctgtgaatggccagagcatcgtggagctgagccatgacaacatcgtgcagctgatcaaggatgctggggtgacagtgaccctgactgtgattgctgaggaggagcaccacggccccccatctggcaccaacagcgcccggcagagccctgccctgcagcaccggcccatgggccagagccaggccaaccacatccctggggacagaagtgccctggagggggagatcggcaaggatgtgtccaccagctaccgccacagctggagcgaccacaagcacctggcccagcctgacacagctgtgatctctgtggtgggcagccgccacaaccagaacctgggctgctaccctgtggagctggagcggggcccccggggcttcggcttcagcctgcggggcggcaaggagtacaacatgggcctcttcatcctgcggctggccgaggatggccctgccatcaaggatggccgcatccacgtgggggaccagatcgtggagatcaacggggagcccacccagggcatcacccacacccgggccatcgagctgatccaggccggcggcaacaaggtgctgctgctgctgcggcccggcaccggcctcatcccagaccacggcctggcccccagcggcctgtgcagctatgtgaagccagagcagcactag

SEQ ID NO: 39962 - DNA, 3378 bp, Artificial Sequence; identical to SEQ ID NO: 39961
  Description of Artificial Sequence: Synthetic coding sequence

SEQ ID NO: 39963 - DNA, 1230 bp, Artificial Sequence
  Description of Artificial Sequence: Synthetic coding sequence
atgggccagagccaggccaaccacatccctggggacagaagtgccctggagggggagatcggcaaggatgtgtccaccagctaccgccacagctggagcgaccacaagcacctggcccagcctgacacagctgtgatctctgtggtgggcagccgccacaaccagaacctgggctgctaccctgtggagctggagcggggcccccggggcttcggcttcagcctgcggggcggcaaggagtacaacatgggcctcttcatcctgcggctggccgaggatggccctgccatcaaggatggccgcatccacgtgggggaccagatcgtggagatcaacggggagcccacccagggcatcacccacacccgggccatcgagctgatccaggccggcggcaacaaggtgctgctgctgctgcggcccggcaccggcctcatcccagaccatggagactgggacatcaacaaccccagcagcagcaatgtcatctatgatgagcagagccccctgccccccagcagccactttgccagcatctttgaggagagccacgtgcctgtgattgaggagagcctgcgggtgcagatctgtgagaaggccgaggagctgaaggacatcgtgcctgagaagaagagcaccctgaatgaaaaccagcctgagatcaagcaccagagcctgctgcagaagaatgtgtccaagagggacccccccagcagccacggccacagcaacaagaagaacctgctgaaggtggagaatggagtgacccggcggggccgctctgtgagccccaagaagccagccagccagcacagcgaggagcacctggacaagatccccagccccctgaagaacaaccccaagagaagaccccgggaccagagcctgagccccagcaagggggagaacaagagctgccaggtgtccacccgggccggcagcggccaggaccagtgcaggaagagccggggccgcagcgccagccccaagaagcagcagaagattgagggcagcaaggcccccagcaatgctgaggccaagctgctggagggcaagagcagaagaattgctggctacacaggcagcaatgctgagcagatcccagatggcaaggagaagagtgatgtgatcaggaaggatgccaagcagaaccagctggagaaggccgagcagggcctgcagaggaagaagagcaaggagtggctgaggaacctcttccaccccaagtag

SEQ ID NO: 39964 - DNA, 1200 bp, Artificial Sequence
  Description of Artificial Sequence: Synthetic coding sequence
atgggcagcagccgctgtggccctggggcccaccctgtgcacctgtggccaccccactttgccttcagcggccaccacccccgggacctgggcccccacagcggccctgccctgctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctaccgcacctacctggactggctggagcagcccttccctggagctgtgcccagcctgcggcccctgctgcggcgggcctggccagcccccctgtttggcctgctcttcctgctgagcagccacctgttccccctggaggccgtgcgggaggatgccttctacgcccggcccctgcctgcccggctcttctacatgatccctgtgttctttgccttcaggatgaggttctacgtggcctggattgctgctgaatgtggctgcatcgccgccggctttggagcctaccctgtggccgccaaggcccgggccggcggcggccccaccctgcagtgccccccacccagcagccctgagaaggccgccagcctggagtatgactatgagaccatcagaaatattgactgctacagcacagacttctgtgtgcgggtgagagatggcatgagatactggaacatgacagtgcagtggtggctggcccagtacatctacaagagcgccccagcccggagctatgtgctgcggagcgcctggaccatgctgctgagcgcctactggcacggcctgcaccctggctactacctgtccttcctgaccatccccctgtgcctggccgctgagggccgcctggagagcgccctgcggggccgcctgagccctgggggccagaaggcctgggactgggtgcactggttcctgaagatgagggcctatgactacatgtgcatgggctttgtgctgctgagcctggccgacaccctgcgctactgggccagcatctacttctgcatccacttcctggccctggccgccctgggcctgggcctggccctgggcggcggcagccccagcaggaggaaggccgccagccagcccaccagcctggcccctgagaagctgcgggaggagtag

SEQ ID NO: 39965 - DNA, 1200 bp, Artificial Sequence; identical to SEQ ID NO: 39964
  Description of Artificial Sequence: Synthetic coding sequence

SEQ ID NO: 39966 - DNA, 1200 bp, Artificial Sequence; identical to SEQ ID NO: 39964
  Description of Artificial Sequence: Synthetic coding sequence

SEQ ID NO: 39967 - DNA, 1200 bp, Artificial Sequence; identical to SEQ ID NO: 39964
  Description of Artificial Sequence: Synthetic coding sequence

SEQ ID NO: 39968 - DNA, 1200 bp, Artificial Sequence; identical to SEQ ID NO: 39964
  Description of Artificial Sequence: Synthetic coding sequence

SEQ ID NO: 39969 - DNA, 1200 bp, Artificial Sequence; identical to SEQ ID NO: 39964
  Description of Artificial Sequence: Synthetic coding sequence

SEQ ID NO: 39970 - DNA, 1200 bp, Artificial Sequence; identical to SEQ ID NO: 39964
  Description of Artificial Sequence: Synthetic coding sequence

SEQ ID NO: 39971 - DNA, 1200 bp, Artificial Sequence; identical to SEQ ID NO: 39964
  Description of Artificial Sequence: Synthetic coding sequence

SEQ ID NO: 39972 - DNA, 1200 bp, Artificial Sequence; identical to SEQ ID NO: 39964
  Description of Artificial Sequence: Synthetic coding sequence

SEQ ID NO: 39973 - DNA, 1200 bp, Artificial Sequence; identical to SEQ ID NO: 39964
  Description of Artificial Sequence: Synthetic coding sequence

SEQ ID NO: 39974 - DNA, 1200 bp, Artificial Sequence; identical to SEQ ID NO: 39964
  Description of Artificial Sequence: Synthetic coding sequence

SEQ ID NO: 39975 - DNA, 1200 bp, Artificial Sequence; identical to SEQ ID NO: 39964
  Description of Artificial Sequence: Synthetic coding sequence

SEQ ID NO: 39976 - DNA, 876 bp, Artificial Sequence
  Description of Artificial Sequence: Synthetic coding sequence
atgtccatgcccctgcaccagatcagcgccatccccagccaggatgccatcagcgcccgggtgtaccgcagcaagaccaaggagaaggagcgggaggagcagaatgagaagaccctgggccacttcatgagccacagcagcaacatcagcaaggccggcagccccccatctgccagcgccccagcccctgtgagcagcttcagcaggaccagcatcacccccagcagccaggacatctgccgcatctgccactgtgaaggagatgatgagagccccctcatcaccccctgccactgcaccggcagcctgcactttgtgcaccaggcctgcctgcagcagtggatcaagagcagtgacacccgctgctgtgagctgtgcaagtatgagttcatcatggagaccaagctgaagcccctgaggaagtgggagaagctgcagatgaccagcagcgagaggaggaagatcatgtgcagcgtgaccttccacgtgattgccatcacctgtgtggtgtggagcctgtatgtgctgattgacagaacagctgaggagatcaagcagggccaggccaccggcatcctggagtggcccttctggaccaagctggtggtggtggccatcggcttcaccggcggcctgctcttcatgtatgtgcagtgcaaggtgtatgtgcagctgtggaagaggctgaaggcctacaacagagtcatctacgtgcagaactgcccagagaccagcaagaagaacatctttgagaagagccccctgacagagcccaactttgagaacaagcacggctacggcatctgccacagcgacaccaacagcagctgctgcacagagcctgaggacaccggggctgagatcatccacgtgtag

SEQ ID NO: 39977 - DNA, 1089 bp, Artificial Sequence
  Description of Artificial Sequence: Synthetic coding sequence
atggccagcggcagcgctgggaagcccaccggggaggccgccagccctgccccagccagcgccatcggcggggccagcagccagcccaggaagaggctggtgtctgtgtgtgaccactgcaagggcaagatgcagctggtggccgacctgctgctgctgagcagcgaggcccggcctgtgctgtttgagggccctgccagcagcggggccggggctgagagctttgagcagtgccgggacaccatcatcgcccggaccaagggcctgagcatcctgacccatgatgtgcagagccagctgaacatgggccgctttggagaggccggggacagcctggtggagctgggggacctggtggtgtccctgacagagtgcagcgcccatgctgcctacctggccgctgtggccacccctggggcccagcctgcccagcccggcctggtggaccgctacagagtgacccgctgcagacatgaggtggagcagggctgtgctgtgctgcgggccacccccctggccgacatgaccccccagctgctgctggaggtgtcccagggcctgagcaggaacctgaagttcctgacagatgcctgtgccctggccagtgacaagagccgggaccgcttcagccgggagcagttcaagctgggcgtgaagtgcatgagcaccagcgccagcgccctgctggcctgtgtgcgggaggtgaaggtggcccccagcgagctggcccggagccgctgtgccctcttcagcggccccctggtgcaggccgtgtctgccctggtgggctttgccacagagccccagttcctgggccgggctgctgctgtgtctgctgagggcaaggctgtgcagacagccatcctgggcggggccatgtctgtggtgtctgcctgtgtgctgctgacccagtgcctgcgggacctggcccagcacccagatggaggagccaagatgtctgaccaccgggagcggctgagaaattctgcctgtgctgtgtctgagggctgcaccctgctgagccaggccctgcgggagaggagcagccccaggaccctgccccctgtgaacagcaacagcgtgaactag

SEQ ID NO: 39978 - DNA, 879 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggaggagtgctgagccccatcctgacccggctgatgaacttctttgtgttcagccggggcctgctgcagtacatcaaccagaggaagaagttcagaagacgctgggtgggcgccctggcctctgtgaccatccccatccacttcatctacggccccctggaccctgtgaacccctacccagagttcctggagctgtacaggaagaccctgcccaggagcacagtgtccatcctggatgaccacatcagccactacccccagctggaggaccccatgggcttcctgaatgcctacatgggcttcatcaacagcttctag

SEQ ID NO: 39979 - DNA, 981 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggaggagtgctgagccccatcctgacccggctgatgaacttctttgtgttcagccggggcctgacccctgtgtttggcccctacacccggcccagcgagagcgagctgtgggacatgtgggccggcatcagaaataatgatggcaacctggtgattgacagcctgctgcagtacatcaaccagaggaagaagttcagaagacgctgggtgggcgccctggcctctgtgaccatccccatccacttcatctacggccccctggaccctgtgaacccctacccagagttcctggagctgtacaggaagaccctgcccaggagcacagtgtccatcctggatgaccacatcagccactacccccagctggaggaccccatgggcttcctgaatgcctacatgggcttcatcaacagcttctag

SEQ ID NO: 39980 - DNA, 879 bp, Artificial Sequence; identical to SEQ ID NO: 39978
  Description of Artificial Sequence: Synthetic coding sequence

SEQ ID NO: 39981 - DNA, 981 bp, Artificial Sequence; identical to SEQ ID NO: 39979
  Description of Artificial Sequence: Synthetic coding sequence

SEQ ID NO: 39982 - DNA, 801 bp, Artificial Sequence
  Description of Artificial Sequence: Synthetic coding sequence
atgaggacagagcccctgtgtggggccagccccctgctggtgcctggggacccctacagcgtggtggtgctgctgcagggctatgcagagcctgagggcgtgggagatgctgtgcgggcagatggctctgtgaccctggtgctgccccagacccggggccctgccagcagccaccgggagagcccccggggcagcggcggcgctgaggccgccctggaggaggccgcccggggccccatcctggtggacaccggcggcccctgggcccgggaggccctgctgggcgccctggccggccagggcgtggcccctggagatgtgaccctggtggtgggcacccacggccacagcgaccacatcggcaacctgggcctcttccctggagctgccctgctggtgtcccatgacttctgcctgcccggcggccgctacctgccccacggcctgggggagggccagcccctgcggctgggccctggcctggaggtgtgggccaccccaggccatggaggccagagagatgtgtctgtggtggtggccggcacagccctgggcaccgtggtggtggccggagatgtgtttgaaagagatggagatgaggacagctggcaggccctgtctgaggaccctgctgcccaggagaggagcaggaagagggtgctggtggtggctgatgtggtggtgcccggccacggcccccccttccgggtgctgcgggaggccagccagcctgagacagagggcggcggcaacagccagcaggagcctgtggtgggagatgaggagcccgccctgcactag

SEQ ID NO: 39983 - DNA, 342 bp, Artificial Sequence
  Description of Artificial Sequence: Synthetic coding sequence
atgaggacagagcccctgtgtggggccagccccctgctggtgcctggggacccctacagcgtggtggtgctgctgcagggctatgcagagcctgagggcgtgggagatgctgtgcgggcagatggctctgtgaccctggtgctgccccagacccggggccctgccagcagccaccgggagagcccccggggcagcggcggcgctgaggccgccctggaggaggccgcccggggccccatcctggtggacaccggcggcccctgggcccgggaggccctgctgggcgccctggccggccagggcgtggcccctggagatgtgaccctggtggtgggcacctag

SEQ ID NO: 39984 - DNA, 840 bp, Artificial Sequence
  Description of Artificial Sequence: Synthetic coding sequence
atgtctgccctggagtggtacgcccacaagagcctgggagatggcatcttctggatccaggagcgcttctatgagagcggcaacagagccaacatctggctggtgcggggcagcgagcaggatgtggtgattgacaccggcctgggcctgcggagcctgcctgagtacctgtacagcagcggcctgctgcaggaccgggaggccaaggaggatgctgcccggcggcccctgctggccgtggccacccacgtgcactttgaccacagcggcggcctgtaccagtttgacagagtggccgtgcaccacgccgaggccgaggccctggcccggggggacaactttgagaccgtgacctggctgagtgacagcgaggtggtgaggacccccagccctggctggagggcccggcagttccgggtgcaggccgtgcagcccaccctcatcctgcaggatggagatgtgatcaacctgggggaccggcagctgactgtgatgcacatgcctggccacagccggggcagcatctgcctgcatgacaaggacaggaagatcctcttctctggagatgtggtgtatgatggcagcctgattgactggctgccctacagccgcatcagtgactatgtgggcacctgtgagcggctcatcgagctggtggaccggggcctggtggagaaggtgctgcccggccacttcaacacctttggagctgagcggctcttccggctggccagcaactacatcagcaaggccggcatctgccacaaggtgtccacctttgccatgaggagcctggccagcctggccctgcgggtgaccaacagcaggaccagcccctag

SEQ ID NO: 39985 - DNA, 600 bp, Artificial Sequence
  Description of Artificial Sequence: Synthetic coding sequence
atgtctgccctggagtggtacgcccacaagagcctgggagatggcatcttctggatccaggagcgcttctatgagagcggcaacagagccaacatctggctggtgcggggcagcgagcaggatgtggtgattgacaccggcctgggcctgcggagcctgcctgagtacctgtacagcagcggcctgctgcaggaccgggaggccaaggaggatgctgcccggcggcccctgctggccgtggccacccacgtgcactttgaccacagcggcggcctgtaccagtttgacagagtggccgtgcaccacgccgaggccgaggccctggcccggggggacaactttgagaccgtgacctggctgagtgacagcgaggtggtgaggacccccagccctggctggagggcccggcagttccgggtgcaggccgtgcagcccaccctcatcctgcaggatggaaatggaccaccccgggcccgggccctggtgaagggcggctactgggaggagaccgtgcgggtgccccacgtggccgacctgcggggccacaagggggactacttcggcaccagccagagccacttctgcttcaccctgccctag

SEQ ID NO: 39986 - DNA, 630 bp, Artificial Sequence
  Description of Artificial Sequence: Synthetic coding sequence
atggccgcccggcggcccctgctggccgtggccacccacgtgcactttgaccacagcggcggcctgtaccagtttgacagagtggccgtgcaccacgccgaggccgaggccctggcccggggggacaactttgagaccgtgacctggctgagtgacagcgaggtggtgaggacccccagccctggctggagggcccggcagttccgggtgcaggccgtgcagcccaccctcatcctgcaggatggagatgtgatcaacctgggggaccggcagctgactgtgatgcacatgcctggccacagccggggcagcatctgcctgcatgacaaggacaggaagatcctcttctctggagatgtggtgtatgatggcagcctgattgactggctgccctacagccgcatcagtgactatgtgggcacctgtgagcggctcatcgagctggtggaccggggcctggtggagaaggtgctgcccggccacttcaacacctttggagctgagcggctcttccggctggccagcaactacatcagcaaggccggcatctgccacaaggtgtccacctttgccatgaggagcctggccagcctggccctgcgggtgaccaacagcaggaccagcccctag

SEQ ID NO: 39987 - DNA, 840 bp, Artificial Sequence; identical to SEQ ID NO: 39984
  Description of Artificial Sequence: Synthetic coding sequence

SEQ ID NO: 39988 - DNA, 153 bp, Artificial Sequence
  Description of Artificial Sequence: Synthetic coding sequence
agctgcacctacgccagcttctgcaagtgcaaggagtacaagtgcaccagctgcaagaagaactgctgcagctgctaccctgtgggctgtgccaagtgtgcccagggctgcatctgcaagggggccagtgacaagtgcagctgctgtgcctag

SEQ ID NO: 39989 - DNA, 123 bp, Artificial Sequence
  Description of Artificial Sequence: Synthetic coding sequence
atggaccccaactacagctgcaccactggaggcagctgcacctgtgccggcagctgcaagtgcaaggagtgcaagtgcaccagctgcaagaagagctgctgcttctgctgccccatgggctag

SEQ ID NO: 39990 - DNA, 186 bp, Artificial Sequence
  Description of Artificial Sequence: Synthetic coding sequence
atggaccccaactgcagctgcaccactggagtgtcctgtgcctgcaccggcagctgcacctgcaaggagtgcaagtgcaccagctgcaagaagagctgctgcagctgctgccctgtgggctgtgccaagtgtgcccacggctgtgtgtgcaagggcaccctggagaactgcagctgctgtgcctag

SEQ ID NO: 39991 - DNA, 879 bp, Artificial Sequence
  Description of Artificial Sequence: Synthetic coding sequence
atggagacagctgagaaggaatgtggggccctgggcggcctcttccaggccatcgtgaatgacatgaagagcagctaccccatctgggaggacttcaacagcaaggccaccaagctgcacagccagctgcggaccaccgtgctggccgctgtggccttcctggatgccttccagaaggtggccgacatggccaccaacaccaggggggccacccgggacatcggcagcgccctgaccaggatgtgcatgaggcacaggagcattgagaccaagctgcggcagttcaccaatgccctgctggagagcctcatcaaccccctgcaggagagaattgaggactggaagaaggccgccaaccagctggacaaggaccacgccaaggagtacaagagggcccggcatgagatcaagaagaagagcagtgacaccctgaagctgcagaagaaggccaggaagggcaagggggacctgcagccccagctggacagcgccctgcaggatgtgaatgacatgtacctgctgctggaggagacagagaagcaggccgtgcggcgggccctgattgaggagcggggccgcttctgcaccttcatcaccttcctgcagcctgtggtgaatggagagctgaccatgctgggggagatcacccacctgcagggcatcattgatgacctggtggtgctgacagctgagccccacaagctgcccccagccagcgagcaggtgatcaaggacctgaagggcagtgactacagctggagctaccagaccccacctccttctgtgcccagcgagccctttgtgtccttcctgtctgtgcgcttctggaagaacagccccctgctgcctgcccccagcacccccagcagccccatctag

SEQ ID NO: 39992 - DNA, 2244 bp, Artificial Sequence
  Description of Artificial Sequence: Synthetic coding sequence
atggagacagctgagaaggaatgtggggccctgggcggcctcttccaggccatcgtgaatgacatgaagagcagctaccccatctgggaggacttcaacagcaaggccaccaagctgcacagccagctgcggaccaccgtgctggccgctgtggccttcctggatgccttccagaaggtggccgacatggccaccaacaccaggggggccacccgggacatcggcagcgccctgaccaggatgtgcatgaggcacaggagcattgagaccaagctgcggcagttcaccaatgccctgctggagagcctcatcaaccccctgcaggagagaattgaggactggaagaaggccgccaaccagctggacaaggaccacgccaaggagtacaagagggcccggcatgagatcaagaagaagagcagtgacaccctgaagctgcagaagaaggccaggaaggagctgctgggcaaaggagacctgcagccccagctggacagcgccctgcaggatgtgaatgacatgtacctgctgctggaggagacagagaagcaggccgtgagaagagccctgattgaggagcggggccgcttctgcaccttcatcaccttcctgcagcctgtggtgaatggagagctgaccatgctgggggagatcacccacctgcagggcatcattgatgacctggtggtgctgacagctgagccccacaagctgcccccagccagcgagcaggtgatcaaggacctgaagggcagtgactacagctggagctaccagaccccacccagcagccccagcagcagcagcagcaggaagagctccatgtgcagcgcccccagcagcagcagcagcgccaagggcggcggggccccctggccaggaggagcccagacctacagccccagcagcacctgccgctaccgcagcctggcccagcctgccaccaccacagcccggctgagctctgtgagcagccatgacagcggctttgtgtcccaggatgccacctacagcaagccacccagccccatgcccagcgacatcaccagccagaagagcagcagcagcgccagcagcgaggccagcgagacctgccagagcgtgtctgagtgcagcagccccaccagtgactggagcaaggtgggcagccatgagcagcccagcggggccaccctgcagaggaggaaggacagagtggagctgctgcgggacacagagcccggccctgccagcggcggcaccctgggccccagcggggaggaggccccccggcccaggatgagccctgccaccatcgccgccaagcacggggaggaggtgtccccagctgccagtgacctggccatggtgctgacccggggcctgagcctggagcaccagaagagcagccgggacagcctgcagtacagcagcggctacagcacccagaccaccacccccagctgcagcgaggacaccatccccagccagggcagtgactatgactgctacagcgtgaatggagatgctgacagcgagggccccccagagtttgacaagagcagcaccatccccaggaacagcaacatcgcccagaactaccgccgcctcatccagaccaagaggcctgccagcacagctggcctgcccacagctggcctgcccacagccaccggcctgcccagcggggcccctcctggggtggccaccatccggaggacccccagcaccaagcccaccgtgagaagagccctgagcagcgctggccccatccccatccggccccccatcgtgcctgtgaagacccccaccgtgcctgacagccctggctacatgggccccacccgggccggcagcgaggagtgtgtgttctacacagatgaaacagccagccccctggccccagacctggccaaggccagccccaagaggctgagcctgcccaacacagcctggggcagccccagccctgaggccgccggctacccaggggccggggctgaagatgagcagcagcagctggccgccaacagacacagcctggtggagaagctgggggagctggtggccggggcccacgccctgggggagggccagttccccttccccacagccctgagcgccacccccacagaggagacccccaccccacctcctgctgccaccagtgaccccccagctgaggacatgctggtggccatccggcggggcgtgcggctgcggaggacagtgaccaatgacagaagtgccccccgcatcctgtag

SEQ ID NO: 39993 - DNA, 1149 bp, Artificial Sequence
  Description of Artificial Sequence: Synthetic coding sequence
atggagcccagggctggggtgtccaagcaggacatccgggagcagatctggggctacatggagagccagaacctggccgacttccccaggcctgtgcaccaccgcatccccaacttcaagggcagctacctggcctgccagaacatcaaggacctggatgtgtttgcccggacccaggaggtgaaggtggaccctgacaagcccctggagggcgtgcggctgctggtgctgcagagcaagaagaccctgctggtgcccaccccccggctgaggacaggcctcttcaacaagatcaccccacctcctggggccaccaaggacatcctgaggaaatgtgccaccagccagggcgtgaggaactacagcgtgcccatcggcctggacagccgggtgctggtggacctggtggtggtgggctctgtggccgtgtctgagaagggctggagaattggcaagggggagggctatgctgacctggagtatgccatgatggtgtccatgggcgctgtgtccaaggagacccctgtggtgaccatcgtgcatgactgccaggtggtggacatccctgaggagctggtggaggagcatgacatcaccgtggactacatcctgacccccaccagggtcatcgccaccggctgcaagaggcccaagcccatgggcatcacctggttcaagatcagcctggagatgatggagaagatccccatcctgcggagcctgcgggcccgggagcagcaggccggcaaggatgtgaccctgcagggcgagcaccagcacctgcctgagcccggctgccagcagacagtgcccctgtctgtgggccggcggcccccagacaccccaggccctgagaccaacagcatggaggccgcccctggcagccccccaggagagggcgcccccctggccgcagatgtgtatgtgggcaacctgcctggagatgcccgggtgtctgacctgaagagggccctgcgggagctgggctctgtgcccctgcggctgacctggcagggcccccggcggcgggccttcctgcactacccagattctgctgctgcccagcaggccgtgtcctgcctgcagggcctgcggctgggcacagacaccctgcgggtggccctggcccggcagcagagggacaagtag

SEQ ID NO: 39994 - DNA, 1152 bp, Artificial Sequence
  Description of Artificial Sequence: Synthetic coding sequence
atggagcccagggctgtgggcgtgtccaagcaggacatccgggagcagatctggggctacatggagagccagaacctggccgacttccccaggcctgtgcaccaccgcatccccaacttcaagggcagctacctggcctgccagaacatcaaggacctggatgtgtttgcccggacccaggaggtgaaggtggaccctgacaagcccctggagggcgtgcggctgctggtgctgcagagcaagaagaccctgctggtgcccaccccccggctgaggacaggcctcttcaacaagatcaccccacctcctggggccaccaaggacatcctgaggaaatgtgccaccagccagggcgtgaggaactacagcgtgcccatcggcctggacagccgggtgctggtggacctggtggtggtgggctctgtggccgtgtctgagaagggctggagaattggaaaaggagagggctacgccgacctggagtatgccatgatggtgtccatgggcgctgtgtccaaggagacccctgtggtgaccatcgtgcatgactgccaggtggtggacatccctgaggagctggtggaggagcatgacatcaccgtggactacatcctgacccccaccagggtgattgccaccggctgcaagaggcccaagcccatgggcatcacctggttcaagatcagcctggagatgatggagaagatccccatcctgcggagcctgcgggcccgggagcagcaggccggcaaggatgtgaccctgcagggcgagcaccagcacctgcctgagcccggctgccagcagacagtgcccctgtctgtgggcagaagacctccagacaccccaggccctgagaccaacagcatggaggccgcccctggcagccccccaggagagggcgcccccctggccgcagatgtgtatgtgggcaacctgcctggagatgcccgggtgtctgacctgaagagggccctgcgggagctgggctctgtgcccctgcggctgacctggcagggccccaggagaagagccttcctgcactacccagacagcgctgctgcccagcaggccgtgtcctgcctgcagggcctgcggctgggcacagacaccctgcgggtggccctggcccggcagcagagggacaagtag

SEQ ID NO: 39995 - DNA, 1152 bp, Artificial Sequence
  Description of Artificial Sequence: Synthetic coding sequence
atggagcccagggctgtgggcgtgtccaagcaggacatccgggagcagatctggggctacatggagagccagaacctggccgacttccccaggcctgtgcaccaccgcatccccaacttcaagggggccagccacgccgctgagcagctgccccggctgcaggccttcaagacagcccggaccatcaaggtgaacccagatgccccccagaagagcgcccgcttctttgtgctggagagcaagaagaccctgctggtgcccaccccccggctgaggacaggcctcttcaacaagatcaccccacctcctggggccaccaaggacatcctgaggaaatgtgccaccagccagggcgtgaggaactacagcgtgcccatcggcctggacagccgggtgctggtggacctggtggtggtgggctctgtggccgtgtctgagaagggctggagaattggaaaaggagagggctacgccgacctggagtatgccatgatggtgtccatgggcgctgtgtccaaggagacccctgtggtgaccatcgtgcatgactgccaggtggtggacatccctgaggagctggtggaggagcatgacatcaccgtggactacatcctgacccccaccagggtgattgccaccggctgcaagaggcccaagcccatgggcatcacctggttcaagatcagcctggagatgatggagaagatccccatcctgcggagcctgcgggcccgggagcagcaggccggcaaggatgtgaccctgcagggcgagcaccagcacctgcctgagcccggctgccagcagacagtgcccctgtctgtgggcagaagacctccagacaccccaggccctgagaccaacagcatggaggccgcccctggcagccccccaggagagggcgcccccctggccgcagatgtgtatgtgggcaacctgcctggagatgcccgggtgtctgacctgaagagggccctgcgggagctgggctctgtgcccctgcggctgacctggcagggccccaggagaagagccttcctgcactacccagacagcgctgctgcccagcaggccgtgtcctgcctgcagggcctgcggctgggcacagacaccctgcgggtggccctggcccggcagcagagggacaagtag

SEQ ID NO: 39996 - DNA, 1146 bp, Artificial Sequence
  Description of Artificial Sequence: Synthetic coding sequence
ggcccccggctgggcgtgtccaagcaggacatccgggagcagatctggggctacatggagagccagaacctggccgacttccccaggcctgtgcaccaccgcatccccaacttcaagggcagctacctggcctgccagaacatcaaggacctggatgtgtttgcccggacccaggaggtgaaggtggaccctgacaagcccctggagggcgtgcggctgctggtgctgcagagcaagaagaccctgctggtgcccaccccccggctgaggacaggcctcttcaacaagatcaccccacctcctggggccaccaaggacatcctgaggaaatgtgccaccagccagggcgtgaggaactacagcgtgcccatcggcctggacagccgggtgctggtggacctggtggtggtgggctctgtggccgtgtctgagaagggctggagaattggaaaaggagagggctacgccgacctggagtatgccatgatggtgtccatgggcgctgtgtccaaggagacccctgtggtgaccatcgtgcatgactgccaggtggtggacatccctgaggagctggtggaggagcatgacatcaccgtggactacatcctgacccccaccagggtgattgccaccggctgcaagaggcccaagcccatgggcatcacctggttcaagatcagcctggagatgatggagaagatccccatcctgcggagcctgcgggcccgggagcagcaggccggcaaggatgtgaccctgcagggcgagcaccagcacctgcctgagcccggctgccagcagacagtgcccctgtctgtgggcagaagacctccagacaccccaggccctgagaccaacagcatggaggccgcccctggcagccccccaggagagggcgcccccctggccgcagatgtgtatgtgggcaacctgcctggagatgcccgggtgtctgacctgaagagggccctgcgggagctgggctctgtgcccctgcggctgacctggcagggccccaggagaagagccttcctgcactacccagacagcgctgctgcccagcaggccgtgtcctgcctgcagggcctgcggctgggcacagacaccctgcgggtggccctggcccggcagcagagggacaagtag

SEQ ID NO: 39997 - DNA, 663 bp, Artificial Sequence
  Description of Artificial Sequence: Synthetic coding sequence
atgatggtgtccatgggcgctgtgtccaaggagacccctgtggtgaccatcgtgcatgactgccaggtggtggacatccctgaggagctggtggaggagcatgacatcaccgtggactacatcctgacccccaccagggtcatcgccaccggctgcaagaggcccaagcccatgggcatcacctggttcaagatcagcctggagatgatggagaagatccccatcctgcggagcctgcgggcccgggagcagcaggccggcaaggatgtgaccctgcagggcgagcaccagcacctgcctgagcccggctgccagcagacagtgcccctgtctgtgggccggcggcccccagacaccccaggccctgagaccaacagcatggaggccgcccctggcagccccccaggagagggcgcccccctggccgcagatgtgtatgtgggcaacctgcctggagatgcccgggtgtctgacctgaagagggccctgcgggagctgggctctgtgcccctgcggctgacctggcagggcccccggcggcgggccttcctgcactacccagattctgctgctgcccagcaggccgtgtcctgcctgcagggcctgcggctgggcacagacaccctgcgggtggccctggcccggcagcagagggacaagtag

SEQ ID NO: 39998 - DNA, 579 bp, Artificial Sequence
  Description of Artificial Sequence: Synthetic coding sequence
atgtgcagcgagcccaagcaccacgtgaatggaaacagaacagtggagcccttccctgagggcacccagatggctgtgtttggcatgggctgcttctggggcgctgagaggaagttctgggtgctgaagggcgtgtacagcacccaggtgggctttgctgggggctacaccagcaaccccacctacaaggaggtgtgcagcgagaagacaggccatgctgaggtggtgcgggtggtgtaccagcctgagcacatgagctttgaggagctgctgaaggtgttctgggagaaccacgaccccacccagggcatgaggcagggcaatgaccacggcacccagtaccgcagcgccatctaccccaccagcgccaagcagatggaggccgccctgagcagcaaggagaactaccagaaggtgctgtctgaacatggcttcggccccatcaccacagacatccgggagggccagaccttctactatgcagaggactaccaccagcagtacctgagcaagaaccccaacggctactgcggcctgggcggcaccggggtgtcctgccctgtgggcatcaagaagtag

SEQ ID NO: 39999 - DNA, 588 bp, Artificial Sequence
  Description of Artificial Sequence: Synthetic coding sequence
atgctgagcgccacccggcgggcctgccagctgctgctgctgcacagcctcttccctgtgcccaggatgggcaacagcgccagcaacatcgtgagcccccaggaggccctgcccggcaggaaggagcagacccctgtggccgccaagcaccacgtgaatggaaacagaacagtggagcccttccctgagggcacccagatggctgtgtttgagaagacaggccacgccgaggtggtgcgggtggtgtaccagcctgagcacatgagctttgaggagctgctgaaggtgttctgggagaaccacgaccccacccagggcatgaggcagggcaatgaccacggcacccagtacagaagtgccatctaccccaccagcgccaagcagatggaggccgccctgagcagcaaagaaaactaccagaaggtgctgtctgagcacggcttcggccccatcaccacagacatccgggagggccagaccttctactatgcagaggactaccaccagcagtacctgagcaagaaccccaacggctactgcggcctgggcggcactggagtgtcctgccctgtgggcatcaagaagtag

SEQ ID NO: 40000 - DNA, 510 bp, Artificial Sequence
  Description of Artificial Sequence: Synthetic coding sequence
atggctgtgtttggcatgggctgcttctggggcgctgagaggaagttctgggtgctgaagggcgtgtacagcacccaggtgggctttgctgggggctacaccagcaaccccacctacaaggaggtgtgcagcgagaagacaggccacgccgaggtggtgcgggtggtgtaccagcctgagcacatgagctttgaggagctgctgaaggtgttctgggagaaccacgaccccacccagggcatgaggcagggcaatgaccacggcacccagtacagaagtgccatctaccccaccagcgccaagcagatggaggccgccctgagcagcaaagaaaactaccagaaggtgctgtctgagcacggcttcggccccatcaccacagacatccgggagggccagaccttctactatgcagaggactaccaccagcagtacctgagcaagaaccccaacggctactgcggcctgggcggcactggagtgtcctgccctgtgggcatcaagaagtag

SEQ ID NO: 40001 - DNA, 627 bp, Artificial Sequence
  Description of Artificial Sequence: Synthetic coding sequence
atgggagagcccgccttcaccagcttccccagcctgcctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcagccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcgggcagagatgctgaccggcggctag

SEQ ID NO: 40002 - DNA, 627 bp, Artificial Sequence
  Description of Artificial Sequence: Synthetic coding sequence
atgggagagcccgccttcaccagcttccccagcctgcctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcagccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcgggcagagatgctgactgtgaggtag

SEQ ID NO: 40003 - DNA, 627 bp, Artificial Sequence
  Description of Artificial Sequence: Synthetic coding sequence
atgggagagcccgccttcaccagcttccccagcccccctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcagccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcaggccgagatgctgacctgcaggtag

SEQ ID NO: 40004 - DNA, 627 bp, Artificial Sequence
  Description of Artificial Sequence: Synthetic coding sequence
atgggagagcccgccttcaccagcttccccagcccccctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcatccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcaggccgagatgctgacctgcaggtag

SEQ ID NO: 40005 - DNA, 627 bp, Artificial Sequence
  Description of Artificial Sequence: Synthetic coding sequence
atgggagagcccgccttcaccagcttccccagcccccctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcatccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcaggccgagatgctgaccggcggctag

SEQ ID NO: 40006 - DNA, 627 bp, Artificial Sequence
  Description of Artificial Sequence: Synthetic coding sequence
atgggagagcccgccttcaccagcttccccagcccccctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcatccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcaggccgagatgctgactgtgaggtag

SEQ ID NO: 40007 - DNA, 615 bp, Artificial Sequence
  Description of Artificial Sequence: Synthetic coding sequence
atgggagagcccgccttcaccagcttccccagcctgcctgtgctgggcaagctgaagaggaacatgatgccctgggccctgcagaagaagcgggagatccacatggccaaggcccacagaagaagagctgcccggagcgccctgcccatgaggctgaccagctgcatcttccggcggcctgtgacccgcatccgcagccacccagacaaccaggtgagaagaagaaaaggagatgagcacctggagaagccccagcagctgtgtgcctacagaaggctgcaggccctgcagccctgcagcagccagggcgagggcagcagccccctgcacctggagagcgtgctgagcatcctggcccctggaacagctggggagagcctggaccgggccggggctgagcgggtgcgcagccccctggagcccaccccaggccgcttccctgctgtggccggcggccccaccccaggcatgggctgccagctgcccccacccctgagcggccagctggtgaccccagctgacatccggcggcaggcccggcgggtgaagaaggcccgggagcggctggccaaggccctgcaggccgaccggctggcccggcgggcagagatgtag

SEQ ID NO: 40008 - DNA, 759 bp, Artificial Sequence
  Description of Artificial Sequence: Synthetic coding sequence
atgagcagcgaggtgtctgccaggagagatgccaagaagctggtgcgcagccccagcggcctgaggatggtgcctgagcaccgggccttcggcagccccttcggcctggaggagccccagtgggtgcctgacaaggagtgccgccgctgcatgcagtgtgatgccaagtttgacttcctgaccaggaagcaccactgcagaagatgtgggaagtgcttctgtgaccgctgctgcagccagaaggtgcccctgcggaggatgtgctttgtggaccctgtgcggcagtgtgccgagtgtgccctggtgtccctgaaggaggccgagttctatgacaagcagctgaaggtgctgctgagcggggccaccttcctggtgacctttggaaacagcgagaagccagagaccatgacctgccgcctgagcaacaaccagcgctacctgttcctggatggagacagccactatgaaattgaaattgtgcacatcagcacagtgcagatcctgacagagggcttccccccaggagagaaggacatccacgcctacaccagcctgcggggcagccagcctgccagcgagggcggcaatgcccgggccaccggcatgttcctgcagtacacagtgcctggaacagaaggagtgacccagctgaagctgactgtggtggaggatgtgacagtgggccggcggcaggccgtggcctggctggtggccatgcacaaggccgccaagctgctgtatgagagccgggaccagtag

SEQ ID NO: 40009 - DNA, 2808 bp, Artificial Sequence
  Description of Artificial Sequence: Synthetic coding sequence
atggccccagctgagatcctgaatggcaaggagatcagcgcccagatccgggcccggctgaagaaccaggtgacccagctgaaggagcaggtgcccggcttcaccccccggctggccatcctgcaggtgggcaacagagatgacagcaacctgtacatcaacgtgaagctgaaggctgctgaggagatcggcatcaaggccacccacatcaagctgcccaggaccaccacagaaagtgaggtgatgaagtacatcaccagcctgaatgaagacagcacagtgcacggcttcctggtgcagctgcccctggacagcgagaacagcatcaacacagaggaggtgatcaatgccatcgcccctgagaaggatgtggatggcctgaccagcatcaatgctgggaagctggcccggggggacctgaatgactgcttcatcccctgcacccccaagggctgcctggagctgatcaaggagactggagtgcccatcgccggcagacatgctgtggtggtgggccgcagcaagatcgtgggcgcccccatgcatgacctgctgctgtggaacaatgccaccgtgaccacctgccacagcaagacagcccacctggatgaggaggtgaacaagggggacatcctggtggtggccaccggccagcctgagatggtgaagggggagtggatcaagccaggggccatcgtcatcgactgtggcatcaactacgtgcctgatgacaagaagcccaacggcaggaaggtggtgggagatgtggcctatgatgaggccaaggagcgggccagcttcatcacccctgtgcctgggggcgtgggccccatgacagtggccatgctgatgcagagcacagtggagagcgccaagcgcttcctggagaagttcaagccaggcaagtggatgatccagtacaacaacctgaacctgaagacccctgtgcccagcgacatcgacatcagccgcagctgcaagcccaagcccatcggcaagctggcccgggagatcggcctgctgtctgaggaggtggagctgtatggagagaccaaggccaaggtgctgctgagcgccctggagcggctgaagcacaggccagatggcaagtatgtggtggtgacaggcatcacccccacccccctgggggagggcaagagcaccaccaccatcggcctggtgcaggccctgggcgcccacctgtaccagaatgtgtttgcctgtgtgcggcagcccagccagggccccaccttcggcatcaagggcggcgctgctgggggcggctacagccaggtgatccccatggaggagttcaacctgcacctgactggagacatccacgccatcacagctgccaacaacctggtggccgccgccattgatgcccgcatcttccacgagctgacccagacagacaaggccctcttcaaccggctggtgcccagcgtgaatggagtgcggcgcttcagtgacatccagatccggcggctgaagaggctgggcatcgagaagacagaccccaccaccctgacagatgaggagatcaacagatttgcccggctggacattgatcctgagaccatcacctggcagagggtgctggacaccaatgaccgcttcctgaggaagatcaccatcggccaggcccccacagagaagggccacaccaggacagcccagtttgacatctctgtggccagcgagatcatggctgtgctggccctgaccaccagcctggaggacatgagggagcggctgggcaagatggtggtggccagcagcaagaagggggagcctgtgtctgctgaggacctgggcgtgtctggggccctgactgtgctgatgaaggatgccatcaagcccaacctgatgcagaccctggagggcacccctgtgtttgtgcacgccggcccctttgccaacatcgcccacggcaacagcagcatcatcgctgaccgcatcgccctgaagctggtgggccctgagggctttgtggtgacagaagctggctttggagctgacatcggcatggagaagttcttcaacatcaagtgccgctacagcggcctgtgcccccacgtggtggtgctggtggccaccgtgcgggccctgaagatgcatggaggcggccccaccgtgacagctggcctgcccctgcccaaggcctacatccaggagaacctggagctggtggagaagggcttcagcaacctgaagaagcagattgaaaatgccaggatgtttggcatccctgtggtggtggccgtgaatgccttcaagacagacacagaaagtgagctggacctgatcagccggctgagccgggagcacggggcctttgatgctgtgaagtgcacccactgggccgagggcggcaaaggagccctggccctggcccaggccgtgcagagagctgcccaggcccccagcagcttccagctgctgtatgacctgaagctgcctgtggaggacaagatccgcatcatcgcccagaagatctacggggctgatgacatcgagctgctgcctgaggcccagcacaaggccgaggtgtacaccaagcagggctttggaaacctgcccatctgcatggccaagacccacctgagcctgagccacaaccctgagcagaagggcgtgcccaccggcttcatcctgcccatccgggacatccgggcctctgtgggcgccggcttcctgtaccccctggtgggcaccatgagcaccatgcctggcctgcccacccggccctgcttctatgacatcgacctggaccctgagacagagcaggtgaatggcctcttctag

SEQ ID NO: 40010 - DNA, 852 bp, Artificial Sequence
  Description of Artificial Sequence: Synthetic coding sequence
atggcccacagaggagcccactttgccttccgcagccgctggcagaagacagatgatgagctgtgccgccacagcatgtccttcatcctgcacaaggccatcagaaatgacttcttccagagctacctgtacctgctggagaagatccccctggtgaagctgtatgccctgaccagccaggtgatcaatggagagatgcagttctacgcccgggccaagctgttctaccaggaggtgcctgccacagaggagggcatgatgggcaacttcatcgagctgagcagcccagacatccaggccagccagaagttcctgaggaagtttgtgggcggccctggccgggccggcacagactgtgccctggactgtggcagcggcatcggccgggtgtccaagcacgtgctgctgcctgtgttcaacagcgtggagctggtggacatgatggagagcttcctgctggaggcccagaactacctgcaggtgaagggggacaaggtggagagctaccactgctacagcctgcaggagttcaccccacccttccgccgctatgatgtgatctggatccagtgggtgtctggccacctgacagacaaggacctgctggccttcctgagccgctgcagagatggcctgaaggaaaatggcatcatcatcctgaaggacaacgtggcccgggagggctgcatcctggacctgagtgacagctctgtgacccgggacatggacatcctgcggagcctcatcaggaagagcggcctggtggtgctgggccaggagaagcaggacggcttccctgagcagtgcatccctgtgtggatgtttgccctgcacagcgacagacacagctag

SEQ ID NO: 40011 - DNA, 1191 bp, Artificial Sequence
  Description of Artificial Sequence: Synthetic coding sequence
atgaaggaatgtaatgccacccggcggccccagatgtccttcctgaagatggacatgacccagatggagttcccagatgccagcttccaggtggtgctggacaagggcaccctggatgctgtgctgacagatgaggaggagaagaccctgcagcaggtggacaggatgctggccgaggtgggccgggtgctgcaggtgggcggccgctacctgtgcatcagcctggcccaggcccacatcctgaagaaggctgtgggccacttcagccgggagggctggatggtgcgggtgcaccaggtggccaacagccaggaccaggtgctggaggccgagccccagttcagcctgcctgtgtttgccttcatcatgaccaagttccggcctgtgcccggcagcgccctgcagatctttgagctgtgtgcccaggagcagaggaagcctgtgcggctggagagcgctgagcggctggccgaggccgtgcaggagcggcagcagtatgcctggctgtgcagccagctgcggaggaaggcccggctgggctctgtgtccctggacctgtgtgatggagacacaggagagccccgctacaccctgcacgtggtggacagcctgcccctgtttgtgcatgaccacttccccaagagctgcattgatgctgtggagattgaccccagcatgctggaggtggccacccagtggtttggcttcagccagagcgacaggatgaaggtgcacatcgcagatggcctggactacatcgccagcctggccggcggcggggaggcccggccctgctatgatgtgatcatgtttgatgtggacagcaaggaccccaccctgggcatgagctgccccccaccagcctttgtggagcagagcttcctgcagaaggtgaagagcatcctgaccccagagggcgtcttcatcctgaacctggtgtgccgggacctgggcctgaaggacagcgtgctggccggcctgaaggctgtgttccccctgctgtatgtgagaagaattgaaggagaggtgaatgagatcctcttctgccagctgcaccctgagcagaagctggccaccccagagctgctggagacagcccaggccctggagaggaccctgaggaagccaggccggggctgggatgacacctacgtgctgagtgacatgctgaagacagtgaagatcgtgtag

SEQ ID NO: 40012 - DNA, 2100 bp, Artificial Sequence
  Description of Artificial Sequence: Synthetic coding sequence
atgaacctgctgcccaagagcagccgggagtttggatctgtggactactgggagaagttcttccagcagaggggcaagaaggcctttgagtggtacggcacctacctggagctgtgtggggtgctgcacaagtacatcaagccccgggagaaggtgctggtgattggctgcggcaacagcgagctgtctgagcagctgtatgatgtgggctacagagacatcgtgaacatcgacatcagcgaggtggtgatcaagcagatgaaggaatgtaatgccacccggcggccccagatgtccttcctgaagatggacatgacccagatggagttcccagatgccagcttccaggtggtgctggacaagggcaccctggatgctgtgctgacagatgaggaggagaagaccctgcagcaggtggacaggatgctggccgaggtgggccgggtgctgcaggtgggcggccgctacctgtgcatcagcctggcccaggcccacatcctgaagaaggctgtgggccacttcagccgggagggctggatggtgcgggtgcaccaggtggccaacagccaggaccaggtgctggaggccgagccccagttcagcctgcctgtgtttgccttcatcatgaccaagttccggcctgtgcccggcagcgccctgcagatctttgagctgtgtgcccaggagcagaggaagcctgtgcggctggagagcgctgagcggctggccgaggccgtgcaggagcggcagcagtatgcctggctgtgcagccagctgcggaggaaggcccggctgggctctgtgtccctggacctgtgtgatggagacacaggagagccccgctacaccctgcacgtggtggacagccccaccgtgaagcccagccgggacaaccactttgccatcttcatcatcccccagggccgggagacagagtggctgtttggcatggatgagggcaggaagcagctggccgccagcgctggcttcagaagactcatcaccgtggccctgcaccggggccagcagtatgagagcatggaccacatccaggccgagctgagcgcccgggtgatggagctggccccagctggcatgcccacccagcagcaggtgcccttcctgtctgtgggcggggacattggagtgaggacagtgcagcaccaggactgcagccccctgagcggggactatgtgattgaagatgtgcagggagatgacaagcgctacttccggcggctcatcttcctgagcaacagaaatgtggtgcagagcgaggcccggctgctgaaggatgtgagccacaaggcccagaagaagaggaagaaggacaggaagaagcagaggcctgcagatgctgaggacctgcctgctgcccctggccagagcattgacaagagctacctgtgctgtgagcaccacaaggccatgattgctggcctggccctgctgagaaatcctgagctgctgctggagatccccctggccctgctggtggtgggcctgggcggcggcagcctgcccctgtttgtgcatgaccacttccccaagagctgcattgatgctgtggagattgaccccagcatgctggaggtggccacccagtggtttggcttcagccagagcgacaggatgaaggtgcacatcgcagatggcctggactacatcgccagcctggccggcggcggggaggcccggccctgctatgatgtgatcatgtttgatgtggacagcaaggaccccaccctgggcatgagctgccccccaccagcctttgtggagcagagcttcctgcagaaggtgaagagcatcctgaccccagagggcgtcttcatcctgaacctggtgtgccgggacctgggcctgaaggacagcgtgctggccggcctgaaggctgtgttccccctgctgtatgtgcggcgcatcgagggggaggtgaatgagatcctcttctgccagctgcaccctgagcagaagctggccaccccagagctgctggagacagcccaggccctggagaggaccctgaggaagccaggccggggctgggatgacacctacgtgctgagtgacatgctgaagacagtgaagatcgtgtag

SEQ ID NO: 40013 - DNA, 1842 bp, Artificial Sequence
  Description of Artificial Sequence: Synthetic coding sequence
atgaaggaatgtaatgccacccggcggccccagatgtccttcctgaagatggacatgacccagatggagttcccagatgccagcttccaggtggtgctggacaagggcaccctggatgctgtgctgacagatgaggaggagaagaccctgcagcaggtggacaggatgctggccgaggtgggccgggtgctgcaggtgggcggccgctacctgtgcatcagcctggcccaggcccacatcctgaagaaggctgtgggccacttcagccgggagggctggatggtgcgggtgcaccaggtggccaacagccaggaccaggtgctggaggccgagccccagttcagcctgcctgtgtttgccttcatcatgaccaagttccggcctgtgcccggcagcgccctgcagatctttgagctgtgtgcccaggagcagaggaagcctgtgcggctggagagcgctgagcggctggccgaggccgtgcaggagcggcagcagtatgcctggctgtgcagccagctgcggaggaaggcccggctgggctctgtgtccctggacctgtgtgatggagacacaggagagccccgctacaccctgcacgtggtggacagccccaccgtgaagcccagccgggacaaccactttgccatcttcatcatcccccagggccgggagacagagtggctgtttggcatggatgagggcaggaagcagctggccgccagcgctggcttcagaagactcatcaccgtggccctgcaccggggccagcagtatgagagcatggaccacatccaggccgagctgagcgcccgggtgatggagctggccccagctggcatgcccacccagcagcaggtgcccttcctgtctgtgggcggggacattggagtgaggacagtgcagcaccaggactgcagccccctgagcggggactatgtgattgaagatgtgcagggagatgacaagcgctacttccggcggctcatcttcctgagcaacagaaatgtggtgcagagcgaggcccggctgctgaaggatgtgagccacaaggcccagaagaagaggaagaaggacaggaagaagcagaggcctgcagatgctgaggacctgcctgctgcccctggccagagcattgacaagagctacctgtgctgtgagcaccacaaggccatgattgctggcctggccctgctgagaaatcctgagctgctgctggagatccccctggccctgctggtggtgggcctgggcggcggcagcctgcccctgtttgtgcatgaccacttccccaagagctgcattgatgctgtggagattgaccccagcatgctggaggtggccacccagtggtttggcttcagccagagcgacaggatgaaggtgcacatcgcagatggcctggactacatcgccagcctggccggcggcggggaggcccggccctgctatgatgtgatcatgtttgatgtggacagcaaggaccccaccctgggcatgagctgccccccaccagcctttgtggagcagagcttcctgcagaaggtgaagagcatcctgaccccagagggcgtcttcatcctgaacctggtgtgccgggacctgggcctgaaggacagcgtgctggccggcctgaaggctgtgttccccctgctgtatgtgcggcgcatcgagggggaggtgaatgagatcctcttctgccagctgcaccctgagcagaagctggccaccccagagctgctggagacagcccaggccctggagaggaccctgaggaagccaggccggggctgggatgacacctacgtgctgagtgacatgctgaagacagtgaagatcgtgtag

SEQ ID NO: 40014 - DNA, 1632 bp, Artificial Sequence
  Description of Artificial Sequence: Synthetic coding sequence
atgaacctgctgcccaagagcagccgggagtttggatctgtggactactgggagaagttcttccagcagaggggcaagaaggcctttgagtggtacggcacctacctggagctgtgtggggtgctgcacaagtacatcaagccccgggagaaggtgctggtgattggctgcggcaacagcgagctgtctgagcagctgtatgatgtgggctacagagacatcgtgaacatcgacatcagcgaggtggtgatcaagcagatgaaggaatgtaatgccacccggcggccccagatgtccttcctgaagatggacatgacccagatggagttcccagatgccagcttccaggtggtgctggacaagggcaccctggatgctgtgctgacagatgaggaggagaagaccctgcagcaggtggacaggatgctggccgaggtgggccgggtgctgcagggccgggagacagagtggctgtttggcatggatgagggcaggaagcagctggccgccagcgctggcttcagaagactcatcaccgtggccctgcaccggggccagcagtatgagagcatggaccacatccaggccgagctgagcgcccgggtgatggagctggccccagctggcatgcccacccagcagcaggtgcccttcctgtctgtgggcggggacattggagtgaggacagtgcagcaccaggactgcagccccctgagcggggactatgtgattgaagatgtgcagggagatgacaagcgctacttccggcggctcatcttcctgagcaacagaaatgtggtgcagagcgaggcccggctgctgaaggatgtgagccacaaggcccagaagaagaggaagaaggacaggaagaagcagaggcctgcagatgctgaggacctgcctgctgcccctggccagagcattgacaagagctacctgtgctgtgagcaccacaaggccatgattgctggcctggccctgctgagaaatcctgagctgctgctggagatccccctggccctgctggtggtgggcctgggcggcggcagcctgcccctgtttgtgcatgaccacttccccaagagctgcattgatgctgtggagattgaccccagcatgctggaggtggccacccagtggtttggcttcagccagagcgacaggatgaaggtgcacatcgcagatggcctggactacatcgccagcctggccggcggcggggaggcccggccctgctatgatgtgatcatgtttgatgtggacagcaaggaccccaccctgggcatgagctgccccccaccagcctttgtggagcagagcttcctgcagaaggtgaagagcatcctgaccccagagggcgtcttcatcctgaacctggtgtgccgggacctgggcctgaaggacagcgtgctggccggcctgaaggctgtgttccccctgctgtatgtgcggcgcatcgagggggaggtgaatgagatcctcttctgccagctgcaccctgagcagaagctggccaccccagagctgctggagacagcccaggccctggagaggaccctgaggaagccaggccggggctgggatgacacctacgtgctgagtgacatgctgaagacagtgaagatcgtgtag

SEQ ID NO: 40015 - DNA, 2097 bp, Artificial Sequence
  Description of Artificial Sequence: Synthetic coding sequence
atgagggcctttgtggtgtcccgggagtttggatctgtggactactgggagaagttcttccagcagaggggcaagaaggcctttgagtggtacggcacctacctggagctgtgtggggtgctgcacaagtacatcaagccccgggagaaggtgctggtgattggctgcggcaacagcgagctgtctgagcagctgtatgatgtgggctacagagacatcgtgaacatcgacatcagcgaggtggtgatcaagcagatgaaggagtgcaatgccacccggcggccccagatgtccttcctgaagatggacatgacccagatggagttcccagatgccagcttccaggtggtgctggacaagggcaccctggatgctgtgctgacagatgaggaggagaagaccctgcagcaggtggacaggatgctggccgaggtgggccgggtgctgcaggtgggcggccgctacctgtgcatcagcctggcccaggcccacatcctgaagaaggctgtgggccacttcagccgggagggctggatggtgcgggtgcaccaggtggccaacagccaggaccaggtgctggaggccgagccccagttcagcctgcctgtgtttgccttcatcatgaccaagttccggcctgtgcccggcagcgccctgcagatctttgagctgtgtgcccaggagcagaggaagcctgtgcggctggagagcgctgagcggctggccgaggccgtgcaggagcggcagcagtatgcctggctgtgcagccagctgcggaggaaggcccggctgggctctgtgtccctggacctgtgtgatggagacaccggggagccccgctacaccctgcacgtggtggacagccccaccgtgaagcccagccgggacaaccactttgccatcttcatcatcccccagggccgggagacagagtggctgtttggcatggatgagggcaggaagcagctggccgccagcgctggcttccggcggctcatcaccgtggccctgcaccggggccagcagtatgaatccatggaccacatccaggccgagctgagcgcccgggtgatggagctggccccagctggcatgcccacccagcagcaggtgcccttcctgtctgtgggcggggacatcggcgtgaggacagtgcagcaccaggactgcagccccctgagcggggactatgtgattgaagatgtgcagggagatgacaagcgctacttcagaagactcatcttcctgagcaacagaaatgtggtgcagagcgaggcccggctgctgaaggatgtgagccacaaggcccagaagaagaggaagaaggacaggaagaagcagaggcctgcagatgctgaggacctgcctgctgcccctggccagagcattgacaagagctacctgtgctgtgagcaccacaaggccatgattgctggcctggccctgctgaggaaccctgagctgctgctggagatccccctggccctgctggtggtgggcctgggcggcggcagcctgcccctgtttgtgcatgaccacttccccaagagctgcattgatgctgtggagattgaccccagcatgctggaggtggccacccagtggtttggcttcagccagagcgacaggatgaaggtgcacatcgcagatggcctggactacatcgccagcctggccggcggcggggaggcccggccctgctatgatgtgatcatgtttgatgtggacagcaaggaccccaccctgggcatgagctgccccccaccagcctttgtggagcagagcttcctgcagaaggtgaagagcatcctgaccccagagggcgtcttcatcctgaacctggtgtgccgggacctgggcctgaaggacagcgtgctggccggcctgaaggctgtgttccccctgctgtatgtgagaagaattgaaggagaggtgaatgagatcctcttctgccagctgcaccctgagcagaagctggccaccccagagctgctggagacagcccaggccctggagaggaccctgaggaagccaggccggggctgggatgacacctacgtgctgagtgacatgctgaagacagtgaagatcgtgtag

SEQ ID NO: 40016 - DNA, 822 bp, Artificial Sequence
  Description of Artificial Sequence: Synthetic coding sequence
atgctgcgctacccctacttctgcaggatgtacaaggaatgtctgagctgctggctggagagcggcatccccaacctgggcgtgtggcccaaccgcatccacaccacagctgagaagtaccgggagtatgaggcccgggagcagacagaccagacccaggcccaggagctgcacaggagccaggaccgggactttgagaccatggccaagctgcacatccctgtgatggtggatgaggtggtgcactgcctgagcccccagaagggccagatcttcctggacatgacctttggaagtggcggccacaccaaggccatcctgcagaaggagagtgacatcgtgctgtatgccctggaccgggaccccacagcctatgccctggccgagcacctgtctgagctgtaccccaagcagatccgggccatgctgggccagttcagccaggccgaggccctgctgatgaaggccggcgtgcagcccggcacctttgatggagtgctgatggacctgggctgcagctccatgcagctggacaccccagagcggggcttcagcctgaggaaggatggccccctggacatgaggatggatggcggccgctacccagacatgcccacagctgctgatgtggtgaatgccctggaccagcaggccctggccagcatcctgcggacctacggggaggagaagcacgccaagaagatcgccagcgccatcgtgcaggcccggagcatctaccccatcaccaggacccagcagctggccagcatcgtggccgagtacagcgagacctacttccctgtggcccagaccctgtactag

SEQ ID NO: 40017 - DNA, 822 bp, Artificial Sequence; identical to SEQ ID NO: 40016
  Description of Artificial Sequence: Synthetic coding sequence

SEQ ID NO: 40018 - DNA, 300 bp, Artificial Sequence
  Description of Artificial Sequence: Synthetic coding sequence
atgctgcgctacccctacttctgcaggatgtacaaggaatgtctgagctgctggctggagagcggcatccccaacctgggcgtgtggcccaaccgcatccacaccacagctgagaagtaccgggagtatgaggcccgggagcagacagaccagacccaggcccaggagctgcacaggagccaggaccgggactttgagaccatggccaagctgcacatccctgtgatggtggatgaggtggtgcactgcctgagcccccagaagggccagagcctgggcgtgcgctctgtgggcatctag

SEQ ID NO: 40019 - DNA, 1224 bp, Artificial Sequence
  Description of Artificial Sequence: Synthetic coding sequence
atgctgcgctacccctacttctgcaggatgtacaaggaatgtctgagctgctggctggagagcggcatccccaacctgggcgtgtggcccaaccgcatccacaccacagctgagaagtaccgggagtatgaggcccgggagcagacagaccagacccaggcccaggagctgcacaggagccaggaccgggactttgagaccatggccaagctgcacatccctgtgatggtggatgaggtggtgcactgcctgagcccccagaagggccagatcttcctggacatgacctttggaagtggcggccacaccaaggccatcctgcagaaggagagtgacatcgtgctgtatgccctggaccgggaccccacagcctatgccctggccgagcacctgtctgagctgtaccccaagcagatccgggccatgctgggccagttcagccaggccgaggccctgctgatgaaggccggcgtgcagcccggcacctttgatggagtgctgatggacctgggctgcagctccatgcagctggacaccccagagcggggcttcagcctgaggaaggatggccccctggacatgaggatggatggcggccgctacccagacatgcccacagctgctgatgtggtgaatgccctggaccagcaggccctggccagcatcctgcggacctacggggaggagaagcacgccaagaagatcgccagcgccatcgtgcaggcccggagcatctaccccatcaccaggacccagcagctggccagcatcgtggccggggccttccccccatctgccatctacaccaggaaggacctgctgcagaggagcacccacatcgccaccaagaccttccaggccctgcgcatctttgtgaacaatgagctgaatgagctgtacacaggcctgaagacagcccagaagttcctgcggcctgggggccgcctggtggccctgtccttccacagcctggaggaccgcatcgtgaagcgcttcctgctgggcatctccatgacagagcgcttcaacctgtctgtgcggcagcaggtgatgaagaccagccagctgggcagtgaccatgaaaatacagaggaggtgtccatgagaagagcccccctgatgtgggagctgatccacaagaaggtgctgagcccccaggaccaggatgtgcaggacaacccccggggccgcagcgccaagctgcgggccgccatcaagctgtag

SEQ ID NO: 40020 - DNA, 1689 bp, Artificial Sequence
  Description of Artificial Sequence: Synthetic coding sequence
atggccctgagcaagtccatgcacgccaggaaccgctacaaggacaagcccccagactttgcctacctggccagcaagtacccagacttcaagcagcacgtgcagatcaacctgaatggccgggtgtccctgaacttcaaggaccctgaggccgtgcgggccctgacctgcaccctgctgcgggaggactttggcctgagcattgacatccccctggagcggctcatccccaccgtgcccctgcggctgaactacatccactgggtggaggacctgattggccaccaggacagcgacaagagcaccctgcggcggggcattgatattggaactggagccagctgcatctaccccctgctgggcgccaccctgaatggctggtacttcctggccacagaggtggatgacatgtgcttcaactatgccaagaagaatgtggagcagaacaacctgagtgacctgatcaaggtggtgaaggtgccccagaagaccctgctgatggatgccctgaaggaggagagcgagatcatctatgacttctgcatgtgcaacccccccttctttgccaaccagctggaggccaagggcgtgaacagcaggaacccccggcggcccccacccagctctgtgaacacaggaggcatcacagagatcatggccgagggcggggagctggagtttgtgaagaggatcatccatgacagcctgcagctgaagaagaggctgcgctggtacagctgcatgctgggcaagaagtgcagcctggcccccctgaaggaggagctgcgcatccagggcgtgcccaaggtgacctacacagagttctgccagggccgcaccatgcgctgggccctggcctggagcttctatgatgatgtgacagtgcccagcccccccagcaagaggaggaagctggagaagcccaggaagcccatcacctttgtggtgctggcctctgtgatgaaggagctgagcctgaaggccagccccctgcggagtgaaacagctgagggcatcgtggtggtgaccacctggattgagaagatcctgacagacctgaaggtgcagcacaagagggtgccctgtgggaaggaggaggtgtccctcttcctgacagccattgaaaattcctggatccacctgcggaggaagaagcgggagcgggtgcggcagctgcgggaggtgccccgggccccagaagatgtgatccaggccctggaggagaagaagcccacccccaaggagagcggcaacagccaggagctggcccggggcccccaggagaggaccccctgtggccctgccctgcgggagggggaggccgctgctgtggagggcccctgccccagccaggagagcctgagccaggaggagaaccctgagcccacagaagatgagaggtctgaggagaagggcggcgtggaggtgctggagagctgccagggcagcagcaatggagcccaggaccaggaggccagcgagcagtttggcagccctgtggccgagcggggcaagaggctgcccggggtggccggccagtacctgttcaagtgcctgatcaacgtgaagaaggaggtggatgatgccctggtggagatgcactgggtggagggccagaacagagacctgatgaaccagctgtgcacctacatccggaaccagatcttccggctggtggccgtgaactag

SEQ ID NO: 40021 - DNA, 675 bp, Artificial Sequence
  Description of Artificial Sequence: Synthetic coding sequence
atggccctgagcaagtccatgcacgccaggaaccgctacaaggacaagcccccagactttgcctacctggccagcaagtacccagacttcaagcagcacgtgcagatcaacctgaatggccgggtgtccctgaacttcaaggaccctgaggccgtgcgggccctgacctgcaccctgctgcgggaggactttggcctgagcattgacatccccctggagcggctcatccccaccgtgcccctgcggctgaactacatccactgggtggaggacctgattggccaccaggacagcgacaagagcaccctgcggcggggcattgatattggaactggagccagctgcatctaccccctgctgggcgccaccctgaatggctggtacttcctggccacagaggtggatgacatgtgcttcaactatgccaagaagaatgtggagcagaacaacctgagtgacctgatcaaggtggtgaaggtgccccagaagaccctgctgatggatgccctgaaggaggagagcgagatcatctatgacttctgcatgtgcaacccccccttctttgccaaccagctggaggccaagggcgtgaacagcaggaacccccggcggcccccacccagctctgtgaacacaggagagagcctggagcccggcagaagaaggctgcagtag

SEQ ID NO: 40022 - DNA, 606 bp, Artificial Sequence
  Description of Artificial Sequence: Synthetic coding sequence
atgaaggagctgagcctgaaggccagccccctgcggagtgaaacagctgagggcatcgtggtggtgaccacctggattgagaagatcctgacagacctgaaggtgcagcacaagagggtgccctgtgggaaggaggaggtgtccctcttcctgacagccattgaaaattcctggatccacctgcggaggaagaagcgggagcgggtgcggcagctgcgggaggtgccccgggccccagaagatgtgatccaggccctggaggagaagaagcccacccccaaggagagcggcaacagccaggagctggcccggggcccccaggagaggaccccctgtggccctgccctgcgggagggggaggccgctgctgtggagggcccctgccccagccaggagagcctgagccaggaggagaaccctgagcccacagaagatgagaggtctgaggagaagggcggcgtggaggtgctggagagctgccagggcagcagcaatggagcccaggaccaggaggcctgctggctgaagctggccccccagctgtggacagccagcgcccggtctgagggcctgtttgtggagagcggcctgggcagcacagcctag

SEQ ID NO: 40023 - DNA, 1035 bp, Artificial Sequence
  Description of Artificial Sequence: Synthetic coding sequence
atggccgagggcggggagctggagtttgtgaagaggatcatccatgacagcctgcagctgaagaagaggctgcgctggtacagctgcatgctgggcaagaagtgcagcctggcccccctgaaggaggagctgcgcatccagggcgtgcccaaggtgacctacacagagttctgccagggccgcaccatgcgctgggccctggcctggagcttctatgatgatgtgacagtgcccagcccccccagcaagaggaggaagctggagaagcccaggaagcccatcacctttgtggtgctggcctctgtgatgaaggagctgagcctgaaggccagccccctgcggagtgaaacagctgagggcatcgtggtggtgaccacctggattgagaagatcctgacagacctgaaggtgcagcacaagagggtgccctgtgggaaggaggaggtgtccctcttcctgacagccattgaaaattcctggatccacctgcggaggaagaagcgggagcgggtgcggcagctgcgggaggtgccccgggccccagaagatgtgatccaggccctggaggagaagaagcccacccccaaggagagcggcaacagccaggagctggcccggggcccccaggagaggaccccctgtggccctgccctgcgggagggggaggccgctgctgtggagggcccctgccccagccaggagagcctgagccaggaggagaaccctgagcccacagaagatgagaggtctgaggagaagggcggcgtggaggtgctggagagctgccagggcagcagcaatggagcccaggaccaggaggccagcgagcagtttggcagccctgtggccgagcggggcaagaggctgcccggggtggccggccagtacctgttcaagtgcctgatcaacgtgaagaaggaggtggatgatgccctggtggagatgcactgggtggagggccagaacagagacctgatgaaccagctgtgcacctacatccggaaccagatcttccggctggtggccgtgaactag

SEQ ID NO: 40024 - DNA, 795 bp, Artificial Sequence
  Description of Artificial Sequence: Synthetic coding sequence
atggatgtgtgcctgagcagcgcccagcagcctggaagaagaggagagggcctgagcagccctgggggctggctggaggccgagaagaagggggccccccagaaggacagcactggaggagtgctggaggagagcaacaagattgagcccagcctgcacagcctgcagaagtttgtgcccacagattatgccagctacacccaggagcactacagatttgctgggaaggagatcgtcatccaggagagcattgagagctatggagctgtggtgtggccaggggccatggccctgtgccagtacctggaggagcacgccgaggagctgaacttccaggatgccaagatcctggagattggagctggccctggcctggtgtccatcgtggccagcatcctgggcgcccaggtgacagccacagacctgcctgatgtgctgggcaacctgcagtacaacctgctgaagaacaccctgcagtgcacagcccacctgcctgaggtgaaggagctggtgtggggcgaggacctggacaagaacttccccaagagcgccttctactatgactatgtgctggccagtgatgtggtgtaccaccactacttcctggacaagctgctgaccaccatggtgtacctgagccagcccggcaccgtgctgctgtgggccaacaagttccgcttcagcacagattatgagttcctggacaagttcaagcaggtgtttgacaccaccctgctggccgagtacccagagagctctgtgaagctgttcaagggcatcctgaagtgggactag

SEQ ID NO: 40025 - DNA, 489 bp, Artificial Sequence
  Description of Artificial Sequence: Synthetic coding sequence
atgtggggccgcctgctggccgccttcccccctgtgcccaccccccagagcaccctcttctacagagcagatgtggtggtgacagacctggaggagctgcaggacctgctgaagatgaacatcaacatgaacaagcacctggtgactggatctgtgcaggccaaggtgctgaagtggggcgaggagattgagggcttccccagccccccagacttcatcctgatggctgactgcatctactatgaggagagcctggagcccctgctgaagaccctgaaggacatcagcggctttgagacctgcatcatctgctgctatgagcagaggaccatgggcaagaaccctgagattgagaagaagtactttgagctgctgcagctggactttgattttgagaagatccccctggagaagcatgatgaggagtacagaagtgaggacatccacatcatctacatcaggaagaagaagagcaagttccccagctag

SEQ ID NO: 40026 - DNA, 585 bp, Artificial Sequence
  Description of Artificial Sequence: Synthetic coding sequence
atggctgacaccctggagagcagcctggaggaccccctgcggagctttgtgcgggtgctggagaagagagatggcaccgtgctgcggctgcagcagtacagcagtggaggagtgggctgtgtggtgtgggatgctgccatcgtgctgagcaagtacctggagaccccagagttctctggagatggagcccacgccctgagccgccgctctgtgctggagctgggcagcggcaccggggctgtgggcctgatggccgccaccctgggcgcagatgtggtggtgacagacctggaggagctgcaggacctgctgaagatgaacatcaacatgaacaagcacctggtgacaggctctgtgcaggccaaggtgctgaagtggggcgaggagattgagggcttccccagccccccagacttcatcctgatggctgactgcatctactatgaggagagcctggagcccctgctgaagaccctgaaggacatcagcggctttgagacctgcatcatctgctgctatgagcagaggaccatgggcaagaaccctgagattgagaagaagtactttgagaagttccccagctag

SEQ ID NO: 40027 - DNA, 690 bp, Artificial Sequence
  Description of Artificial Sequence: Synthetic coding sequence
atggctgacaccctggagagcagcctggaggaccccctgcggagctttgtgcgggtgctggagaagagagatggcaccgtgctgcggctgcagcagtacagcagtggaggagtgggctgtgtggtgtgggatgctgccatcgtgctgagcaagtacctggagaccccagagttctctggagatggagcccacgccctgagccgccgctctgtgctggagctgggcagcggcaccggggctgtgggcctgatggccgccaccctgggcgcagatgtggtggtgacagacctggaggagctgcaggacctgctgaagatgaacatcaacatgaacaagcacctggtgacaggctctgtgcaggccaaggtgctgaagtggggcgaggagattgagggcttccccagccccccagacttcatcctgatggctgactgcatctactatgaggagagcctggagcccctgctgaagaccctgaaggacatcagcggctttgagacctgcatcatctgctgctatgagcagaggaccatgggcaagaaccctgagattgagaagaagtactttgagctgctgcagctggactttgattttgagaagatccccctggagaagcatgatgaggagtacagaagtgaggacatccacatcatctacatcaggaagaagaagagcaagttccccagctag

SEQ ID NO: 40028 - DNA, 618 bp, Artificial Sequence
  Description of Artificial Sequence: Synthetic coding sequence
atggtgcagctggccccagctgctgccatggatgaggtgaccttcagaagtgacacagtgctgagtgatgtgcacctgtacacccccaaccaccgccacctgatggtgcggctgaacagcgtgggccagcccgtcttcctgagccagttcaagctgctgtggagccaggacagctggacagacagcggggccaagggcggcagccacagagatgtgcacaccaaggagcccccatctgctgagaccggcagcacaggcagccccccaggcagcggccatggaaatgaaggcttcagcctgcaggccggcacagacaccaccggccaggaggtggccgaggcccagctggatgaagatggagacctggatgtggtgcggcggccccgggccgccagtgacagcaacccagctggccccctgcgggacaaggtgcaccccatgatcctggcccaggaggaggatgatgtgctgggggaggaggcccagggcagcccccatgacatcatcagaattggagtggccggccgcccagcccctggccgcctgcaccctgtgcccaccggccccctgcccaggatgtacagcgctggggcccggggccgccacggggccaggtag

SEQ ID NO: 40029 - DNA, 1215 bp, Artificial Sequence
  Description of Artificial Sequence: Synthetic coding sequence
atggtgcagctggccccagctgctgccatggatgaggtgaccttcagaagtgacacagtgctgagtgatgtgcacctgtacacccccaaccaccgccacctgatggtgcggctgaacagcgtgggccagcccgtcttcctgagccagttcaagctgctgtggagccaggacagctggacagacagcggggccaagggcggcagccacagagatgtgcacaccaaggagcccccatctgctgagaccggcagcacaggcagccccccaggcagcggccatggaaatgaaggcttcagcctgcaggccggcacagacaccaccggccaggaggtggccgaggcccagctggatgaagatggagacctggatgtggtgcggcggccccgggccgccagtgacagcaacccagctggccccctgcgggacaaggtgcaccccatgatcctggcccaggaggaggatgatgtgctgggggaggaggcccagggcagcccccatgacatcatcagaattgagcacaccatggccacccccctggaggatgtgggcaagcaggtgtggaggggggccctgctgctggccgactacatcctcttccggcaggacctcttccggggctgcacagccctggagctgggcgccggcaccggcctggccagcatcatcgccgccaccatggccaggacagtgtactgcacagatgtgggcgctgacctgctgtccatgtgccagagaaatattgccctgaacagccacctggccgccaccggcggcggcatcgtgcgggtgaaggagctggactggctgaaggatgacctgtgcacagaccccaaggtgcccttctcctggagccaggaggagatcagtgacctgtatgaccacaccaccatcctgtttgctgctgaggtgttctatgatgatgacctgacagatgctgtgttcaagaccctgagccggctggcccaccggctgaagaatgcctgcacagccatcctgtctgtggagaagaggctgaacttcaccctgcggcacctggatgtgacctgtgaggcctatgaccacttccgcagctgcctgcacgccctggagcagctggctgatggcaagctgcgctttgtggtggagcctgtggaggccagcttcccccagctgctggtgtatgagcggctgcagcagctggagctgtggaagatcatcgccgagcctgtgacctag

SEQ ID NO: 40030 - DNA, 1137 bp, Artificial Sequence
  Description of Artificial Sequence: Synthetic coding sequence
atggccggcagctacccagagggcgccccagctgtgctggccgacaagaggcagcagtttggcagccgcttcctgcgggaccctgcccgggtcttccaccacaatgcctgggacaacgtggagtggagcgaggagcaggccgctgctgctgagaggaaggtgcaggagaacagcatccagagggtgtgccaggagaagcaggtggactatgagatcaatgcccacaagtactggaatgacttctacaagatccatgaaaatggcttcttcaaggacagacactggctgttcacagagttccctgagctggcccccagccagaaccagaaccacctgaaggactggttcctggagaacaagtctgaggtgcctgaatgtagaaataatgaagatggccctggcctcatcatggaggagcagcacaagtgcagcagcaagagcctggagcacaagacccagaccctgcctgtggaggagaatgtgacccagaagatcagtgacctggagatctgtgctgatgagttccctggcagcagcgccacctaccgcatcctggaggtgggctgcggcgtgggcaacacagtgttccccatcctgcagaccaacaatgaccccggcctgtttgtgtactgctgtgacttcagcagcacagccatcgagctggtgcagaccaacagtgaatatgaccccagccgctgctttgcctttgtgcatgacctgtgtgatgaggagaagagctaccctgtgcccaagggcagcctggacatcatcatcctgatctttgtgctgagcgccatcgtgcctgacaagatgcagaaggccatcaaccggctgagccggctgctgaagccaggcggcatgatgctgctgcgggactatggccgctatgacatggcccagctgcgcttcaagaagggccagtgcctgagcggcaacttctacgtgagaggagatggcaccagggtgtacttcttcacccaggaggagctggacaccctcttcaccacagctggcctggagaaggtgcagaacctggtggaccggcggctgcaggtgaacagaggcaagcagctgaccatgtacagagtgtggatccagtgcaagtactgcaagcccctgctgagcagcaccagctag

SEQ ID NO: 40031 - DNA, 654 bp, Artificial Sequence
  Description of Artificial Sequence: Synthetic coding sequence
atggccggcagctacccagagggcgccccagctgtgctggccgacaagaggcagcagtttggcagccgcttcctgcgggaccctgcccgggtcttccaccacaatgcctgggacaacgtggagtggagcgaggagcaggccgctgctgctgagaggaaggtgcaggagaacagcatccagagggtgtgccaggagaagcaggtggactatgagatcaatgcccacaagtactggaatgacttctacaagatccatgaaaatggcttcttcaaggacagacactggctgttcacagagttccctgagctggcccccagccagaaccagaaccacctgaaggactggttcctggagaacaagtctgaggtgcctgaatgtagaaataatgaagatggccctggcctcatcatggaggagcagcacaagtgcagcagcaagagcctggagcacaagacccagaccctgcctgtggaggagaatgtgacccagaagatcagtgacctggagatctgtgctgatgagttccctggccagcccccaacagagtactggaggctggccgtggtgtgggagacccagagcttccagttctacaagaggaccatgacccaggacagcctcttcatcgccgtcatcttcctgccccagctgtag

SEQ ID NO: 40032 - DNA, 1137 bp, Artificial Sequence
  Description of Artificial Sequence: Synthetic coding sequence
atggccggcagctacccagagggcgccccagccatcctggccgacaagaggcagcagtttggcagccgcttcctgagtgaccctgcccgggtcttccaccacaatgcctgggacaacgtggagtggagcgaggagcaggccgctgctgctgagaggaaggtgcaggagaacagcatccagagggtgtgccaggagaagcaggtggactatgagatcaatgcccacaagtactggaatgacttctacaagatccatgaaaatggcttcttcaaggacagacactggctgttcacagagttccctgagctggcccccagccagaaccagaaccacctgaaggactggttcctggagaacaagtctgaggtgtgtgaatgtagaaataatgaagatggccctggcctcatcatggaggagcagcacaagtgcagcagcaagagcctggagcacaagacccagaccccacctgtggaggagaatgtgacccagaagatcagtgacctggagatctgtgctgatgagttccctggcagcagcgccacctaccgcatcctggaggtgggctgcggcgtgggcaacacagtgttccccatcctgcagaccaacaatgaccccggcctgtttgtgtactgctgtgacttcagcagcacagccatcgagctggtgcagaccaacagtgaatatgaccccagccgctgctttgcctttgtgcatgacctgtgtgatgaggagaagagctaccctgtgcccaagggcagcctggacatcatcatcctgatctttgtgctgtctgctgtggtgcctgacaagatgcagaaggccatcaaccggctgagccggctgctgaagccaggcggcatggtgctgctgcgggactatggccgctatgacatggcccagctgcgcttcaagaagggccagtgcctgagcggcaacttctacgtgagaggagatggcaccagggtgtacttcttcacccaggaggagctggacaccctcttcaccacagctggcctggagaaggtgcagaacctggtggaccggcggctgcaggtgaacagaggcaagcagctgaccatgtacagagtgtggatccagtgcaagtactgcaagcccctgctgagcagcaccagctag

SEQ ID NO: 40033 - DNA, 1419 bp, Artificial Sequence
  Description of Artificial Sequence: Synthetic coding sequence
atgtctgtggtgcaccagctgtctgctggctggctgctggaccacctgtccttcatcaacaagatcaactaccagctgcaccagcaccacgagccctgctgcaggaagaaggagttcaccacctctgtgcactttgagagcctgcagatggacagcgtgagcagcagcggcgtgtgtgccgccttcatcgccagtgacagcagcaccaagccagaaaatgatgatggcggcaactatgagatgttcaccaggaagtttgtgttccggcctgagctgtttgatgtgaccaagccctacatcaccccagctgtgcacaaggagtgccagcagagcaatgagaaggaggacctgatgaatggagtgaagaaggagatcagcatcagcatcatcggcaagaagaggaagagatgtgtggtgttcaaccagggcgagctggatgccatggagtaccacaccaagatccgggagctgatcctggatggcagcctgcagctgatccaggagggcctgaagagcggcttcctgtaccccctgtttgagaagcaggacaagggcagcaagcccatcaccctgcccctggatgcctgcagcctgtctgagctgtgtgagatggccaagcacctgcccagcctgaatgagatggagcaccagaccctgcagctggtggaggaggacacctctgtgacagagcaggacctcttcctgcgggtggtggagaacaacagcagcttcaccaaggtgatcaccctgatgggccagaagtacctgctgccccccaagagcagcttcctgctgagtgacatcagctgcatgcagcccctgctgaactacaggaagacctttgatgtgattgtcatcgaccccccctggcagaacaagtctgtgaagaggagcaaccgctacagctacctgagccccctgcagatccagcagatccccatccccaagctggccgcccccaactgcctgctggtgacctgggtgaccaaccggcagaagcacctgcgcttcatcaaggaggagctgtaccccagctggagcgtggaggtggtggccgagtggcactgggtgaagatcaccaacagcggggagtttgtgttccccctggacagcccccacaagaagccctatgagggcctcatcctgggccgggtgcaggagaagacagccctgcccctgagaaatgctgatgtgaatgtgctgcccatcccagaccacaagctgattgtgtctgtgccctgcaccctgcacagccacaagccacccctggccgaggtgctgaaggactacatcaagccagatggagagtacctggagctgtttgccaggaacctgcagcccggctggacctcctggggcaatgaggtgctgaagttccagcacgtggactacttcatcgctgtggagagcggcagctag

SEQ ID NO: 40034 - DNA, 1419 bp, Artificial Sequence; identical to SEQ ID NO: 40033
  Description of Artificial Sequence: Synthetic coding sequence

SEQ ID NO: 40035 - DNA, 855 bp, Artificial Sequence
  Description of Artificial Sequence: Synthetic coding sequence
atggccagcctgcagaggaagggcctgcaggcccgcatcctgaccagcgaggaggaggagaagctgaagagggaccagaccctggtgtctgacttcaagcagcagaagctggagcaggaggcccagaagaactgggacctcttctacaagaggaacagcaccaacttcttcaaggacagacactggaccacccgggagtttgaggagctgcggagctgccgggagtttgaggaccagaagctgaccatgctggaggccggctgcggcgtgggcaactgcctcttccccctgctggaggaggaccccaacatctttgcctatgcctgtgacttcagcccccgggccatcgagtatgtgaagcagaaccccctgtatgacacagagcgctgcaaggtgttccagtgtgacctgaccaaggatgacctgctggaccacgtgcccccagagagcgtggatgtggtgatgctgatctttgtgctgtctgctgtgcacccagacaagatgcacctggtgctgcagaacatctacaaggtgctgaagccaggcaagtctgtgctcttccgggactatggcctgtatgaccacgccatgctgcgcttcaaggccagcagcaagctgggggagaacttctacgtgcggcaggacggcaccaggagctacttcttcacagatgacttcctggcccagctgttcatggacaccggctatgaggaggtggtgaatgaatatgtgttccgggagaccgtgaacaagaaggagggcctgtgtgtgcccagggtcttcctgcagagcaagttcctgaagccacccaagaaccccagccctgtggtgctgggcctggaccccaagagctag

SEQ ID NO: 40036 - DNA, 855 bp, Artificial Sequence; identical to SEQ ID NO: 40035
  Description of Artificial Sequence: Synthetic coding sequence

SEQ ID NO: 40037 - DNA, 735 bp, Artificial Sequence
  Description of Artificial Sequence: Synthetic coding sequence
atggacatcctggtgcccctgctgcagctgctggtgctgctgctgaccctgcccctgcacctgatggccctgctgggctgctggcagcccctgtgcaagagctacttcccctacctgatggctgtgctgacccccaagagcaacaggaagatggagagcaagaagcgggagctgttcagccagatcaagggcctgaccggggccagcggcaaggtggccctgctggagctgggctgcggcactggagccaacttccagttctacccacctggctgccgggtgacctgcctggaccccaacccccactttgagaagttcctgaccaagtccatggctgaaaatagacacctgcagtatgaaagatttgtggtggcccctggagaggacatgaggcagctggctgatggctccatggatgtggtggtgtgcaccctggtgctgtgcagcgtgcagagccccaggaaggtgctgcaggaggtgagaagagtgctgcggcctgggggcgtgctcttcttctgggagcacgtggccgagccctacggctcctgggccttcatgtggcagcaggtgtttgagcccacctggaagcacatcggagatggctgctgcctgacccgggagacctggaaggacctggagaatgcccagttcagcgagatccagatggagcggcagcccccacccctgaagtggctgcctgtgggcccccacatcatgggcaaggctgtgaagtag

SEQ ID NO: 40038 - DNA, 957 bp, Artificial Sequence
  Description of Artificial Sequence: Synthetic coding sequence
atgaggctgctggccggctggctgtgcctgagcctggcctctgtgtggctggcccggaggatgtggaccctgcggagccccctgaccaggagcctgtatgtgaacatgaccagcggccctgggggccctgctgctgctgctgggggcaggaaggagaaccaccagtggtacgtgtgcaaccgggagaagctgtgtgagagcctgcaggccgtgtttgtgcagagctacctggaccagggcacccagatcttcctgaacaacagcattgagaagagcggctggctgttcatccagctgtaccacagctttgtgagcagcgtcttcagcctcttcatgagcaggaccagcatcaatggcctgctgggccggggctccatgtttgtgttctccccagaccagttccagaggctgctgaagatcaacccagactggaagacccaccggctgctggacctgggcgctggagatggagaggtgaccaagatcatgagcccccactttgaggagatctatgccacagagctgtctgagaccatgatctggcagctgcagaagaagaagtacagagtgctgggcatcaatgagtggcagaacacaggcttccagtatgatgtgatcagctgcctgaacctgctggacagatgtgaccagcccctgaccctgctgaaggacatccgctctgtgctggagcccacccggggccgggtcatcctggccctggtgctgcccttccacccctacgtggagaatgtgggcggcaagtgggagaagcccagcgagatcctggagatcaagggccagaactgggaggagcaggtgaacagcctgcctgaggtgttcaggaaggccggctttgtgattgaggccttcacccggctgccctacctgtgtgagggggacatgtacaatgactactacgtgctggatgatgctgtgtttgtgctgaagcctgtgtag

SEQ ID NO: 40039 - DNA, 954 bp, Artificial Sequence
  Description of Artificial Sequence: Synthetic coding sequence
atgaggctgctggccggctggctgtgcctgagcctggcctctgtgtggctggcccggaggatgtggaccctgcggagccccctgaccaggagcctgtatgtgaacatgaccagcggccctgggggccctgctgctgctgctgggggcaggaaggagaaccaccagtggtacgtgtgcaaccgggagaagctgtgtgagagcctgcaggccgtgtttgtgcagagctacctggaccagggcacccagatcttcctgaacaacagcattgagaagagcggctggctgttcatccagctgtaccacagctttgtgagcagcgtcttcagcctcttcatgagcaggaccagcatcaatggcctgctgggccggggctccatgtttgtgttctccccagaccagttccagaggctgctgaagatcaacccagactggaagacccaccggctgctggacctgggcgctggagatggagaggtgaccaagatcatgagcccccactttgaggagatctatgccacagagctgtctgagaccatgatctggcagctgcagaagaagaagtacagagtgctgggcatcaatgagtggcagaacacaggcttccagtatgatgtgatcagctgcctgaacctgctggacagatgtgaccagcccctgaccctgctgaaggacatccgctctgtgctggagcccacccggggccgggtcatcctggccctggtgctgcccttccacccctacgtggagaatggaggcaagtgggagaagcccagcgagatcctggagatcaagggccagaactgggaggagcaggtgaacagcctgcctgaggtgttcaggaaggccggcttcgtcatcgaggccttcacccggctgccctacctgtgtgagggggacatgtacaatgactactacgtgctggatgatgctgtgtttgtgctgaagcctgtgtag

SEQ ID NO: 40040 - DNA, 849 bp, Artificial Sequence
  Description of Artificial Sequence: Synthetic coding sequence
atgtggaccctgcggagccccctgaccaggagcctgtatgtgaaggagaaccaccagtggtacgtgtgcaaccgggagaagctgtgtgagagcctgcaggccgtgtttgtgcagagctacctggaccagggcacccagatcttcctgaacaacagcattgagaagagcggctggctgttcatccagctgtaccacagctttgtgagcagcgtcttcagcctcttcatgagcaggaccagcatcaatggcctgctgggccggggctccatgtttgtgttctccccagaccagttccagaggctgctgaagatcaacccagactggaagacccaccggctgctggacctgggcgctggagatggagaggtgaccaagatcatgagcccccactttgaggagatctatgccacagagctgtctgagaccatgatctggcagctgcagaagaagaagtacagagtgctgggcatcaatgagtggcagaacacaggcttccagtatgatgtgatcagctgcctgaacctgctggacagatgtgaccagcccctgaccctgctgaaggacatccgctctgtgctggagcccacccggggccgggtcatcctggccctggtgctgcccttccacccctacgtggagaatgtgggcggcaagtgggagaagcccagcgagatcctggagatcaagggccagaactgggaggagcaggtgaacagcctgcctgaggtgttcaggaaggccggctttgtgattgaggccttcacccggctgccctacctgtgtgagggggacatgtacaatgactactacgtgctggatgatgctgtgtttgtgctgaagcctgtgtag

SEQ ID NO: 40041 - DNA, 165 bp, Artificial Sequence
  Description of Artificial Sequence: Synthetic coding sequence
atgatgaagccccaggccgagaccggggaggccgcccgggaccccagcctgcggcctgccaggacagtgctggtgggcagcctgtcctggctgaggaagcagctgcagcccacccactgcaagtatgagggccccaggaaggcccggcggctgtggtttgcctag

SEQ ID NO: 40042 - DNA, 231 bp, Artificial Sequence
  Description of Artificial Sequence: Synthetic coding sequence
atgattgctggggagcaccggctggaccctgccaccatcagcctgggcgtggaccagacagatgaccaccagcagcccacccacagccgcatcaggaagaagagggtgagccccacctctgtgtggttccagccctacttctgcatcctgaagaccctgtgcaccaccctggacacagtgcaggatgatgccaccagctcctggatgctgatctgccacgtggacttctag

SEQ ID NO: 40043 - DNA, 7290 bp, Artificial Sequence
  Description of Artificial Sequence: Synthetic coding sequence
atggacatgtctgaccccaacttctggacagtgctgagcaacttcaccctgccccacctgcggagcggcaaccggctgcggaggacccagagctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgccaggagaacagatggccgccgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagaaaatcgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgaaagtggagagctggccttcatcaagcagctggtgaggaagatcctgattgtcatcgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgacagcggcacagctgagaccccagagacagatgaatctgtgagcagcagcaatgccagcctgaagctgcggaggaagccccgggagagtgactttgagaccatcaagctgatcagcaatggagcctatggagctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagacccggcggcacctgtgcatggtgatggagtatgtggagggcggggactgtgccaccctgatgaagaacatgggccccctgcctgtggacatggccaggatgtactttgctgagaccgtgctggccctggagtacctgcacaactatggaattgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcaactggccagagaaggatgaggcccctcctccagatgcccaggacctgatcaccctgctgctgcggcagaaccccctggagcggctgggcactggaggagcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaggccgccagctgccctggggacccccatgaggagcccgggaagccagccctgcccccagaggagtgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaacggggagcctgtgcacggcctggtgcacacagaggtgattgagctgctgctgaagagcggcaacaaggtgtccatcaccaccaccccatttgagaacaccagcatcaagacaggccctgcccggaggaacagctacaagagcaggatggtgagaagaagcaagaagagcaagaagaaggagagcctggagaggagaagaagcctcttcaagaagctggccaagcagcccagccccctgctgcacaccagccgctccttcagctgcctgaacagaagcctgagcagtggagagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctacagaagtggaagaaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagcccccaagaagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttcagaagagccccagcccctggcaccctgcaggacggcctgtgccacagcctggaccggggcatcagcggcaagggggagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgagtgcctgcccggcaaccctgtgcggcccaccggcggccagcaggagcccccaccagccagcgagagccgggcctttgtgagcagcacccatgctgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgcggcggggcgtggagcccaagccagaggccctgctggcccggcgcagcctgcagcccccaggcattgaaagtgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagccccggcccggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgcccaggcctggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagacagaagagctgagggcaagaagtgcacagaggccctgtatgccccagctgagggggacaagctggaggccggcctgagctttgtgcacagtgaaaatcggctgaagggagctgagaggcctgctgctggggtgggcaagggcttccctgaggcccggggcaagggccctggcccccagaagcccccaacagaagctgacaagcccaacggcatgaagaggagccccagcgccaccggccagagcagcttccgcagcacagccctgcctgagaagagcctgagctgcagcagcagcttccctgagacccgggccggcgtgcgggaggccagcgctgccagcagtgacaccagcagcgccaaggccgccggcggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40044 - DNA, 7335 bp, Artificial Sequence
  Description of Artificial Sequence: Synthetic coding sequence
atgaaggcccagcgggagcggctgcagatccctggcctgaccctggacctgacccccaggagcctgagccccacccccagcagccctggcagcccctgcagccccctgctggccttccacttctggagctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgcccggagcctgaacagaacagatggaagacgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagagaaccgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgagagcggggagctggccttcatcaagcagctggtgaggaagatcctgattgtgattgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgattctggaacagctgagaccccagagacagatgagagcgtgagcagcagcaatgccagcctgaagctgcggaggaagccccgggagagtgactttgagaccatcaagctgatcagcaatggagcctacggggctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagaccaggaggcacctgtgcatggtgatggagtatgtggagggcggggactgtgccaccctgatgaagaacatgggccccctgcctgtggacatggccaggatgtactttgctgagaccgtgctggccctggagtacctgcacaactacggcatcgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttctttggagacaccccagaggagctgtttggccaggtgatcagtgatgagatcaactggccagagaaggatgaggcccctcctccagatgcccaggacctgatcaccctgctgctgcggcagaaccccctggagcggctgggcaccggcggggcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaagctgccagctgccctggggacccccatgaggagcccgggaagccagccctgcccccagaagaatgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaatggagagcctgtgcacggcctggtgcacacagaggtgattgagctgctgctgaagagcggcaacaaggtgtccatcaccaccaccccatttgagaacaccagcatcaagacaggccctgccaggagaaattcctacaagagcaggatggtgcggcgcagcaagaagagcaagaagaaggagagcctggagcggcggcgcagcctcttcaagaagctggccaagcagcccagccccctgctgcacaccagccgctccttcagctgcctgaacagaagcctgagcagcggggagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctaccgcagcggccgcaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagccccccaggagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttccggcgggccccagcccctggcaccctgcaggacggcctgtgccacagcctggaccggggcatctctggaaaaggagagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgaatgtctgcccggcaaccctgtgcggcccactggaggccagcaggagcccccaccagccagcgagagccgggcctttgtgagcagcacccacgccgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgagaagaggagtggagcccaagccagaggccctgctggcccggcgcagcctgcagcccccaggcatcgagagcgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagcccaggcctggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgccccggcccggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagaccggcgggcagagggcaagaagtgcacagaggccctgtatgccccagctgagggggacaagctggaggccggcctgagctttgtgcacagcgagaaccggctgaagggagctgagaggcctgctgctggggtgggcaagggcttccctgaggcccggggcaaaggacctggcccccagaagccacccacagaggccgacaagcccaacggcatgaagaggagccccagcgccaccggccagagcagcttccgcagcacagccctgcctgagaagagcctgagctgcagcagcagcttccctgagaccagggctggggtgcgggaggccagcgctgccagcagtgacaccagcagcgccaaggctgctgggggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40045 - DNA, 7305 bp, Artificial Sequence
  Description of Artificial Sequence: Synthetic coding sequence
atggatgagagcagcatcctgcggcggcggggcctgcagaaggagctgagcctgccccggcggggcagcctgattgacagccagaagtggaactgcctggtgaagcgctgcaggaccagcaacaggaagagcctgattggaaatggccagagccctgccctgccccggccccacagccccctgagcgcccatgctggcaacagcccccaggacagccccaggaacttcagccccagcgccagcgcccacttctcctttgcccggaggacagatggaagacgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagagaaccgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgagagcggggagctggccttcatcaagcagctggtgaggaagatcctgattgtgattgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgattctggaacagctgagaccccagagacagatgagagcgtgagcagcagcaatgccagcctgaagctgcggaggaagccccgggagagtgactttgagaccatcaagctgatcagcaatggagcctacggggctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagaccaggaggcacctgtgcatggtgatggagtatgtggagggcggggactgtgccaccctgatgaagaacatgggccccctgcctgtggacatggccaggatgtactttgctgagaccgtgctggccctggagtacctgcacaactacggcatcgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttctttggagacaccccagaggagctgtttggccaggtgatcagtgatgagatcaactggccagagaaggatgaggcccctcctccagatgcccaggacctgatcaccctgctgctgcggcagaaccccctggagcggctgggcaccggcggggcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaagctgccagctgccctggggacccccatgaggagcccgggaagccagccctgcccccagaagaatgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaatggagagcctgtgcacggcctggtgcacacagaggtgattgagctgctgctgaagagcggcaacaaggtgtccatcaccaccaccccatttgagaacaccagcatcaagacaggccctgccaggagaaattcctacaagagcaggatggtgcggcgcagcaagaagagcaagaagaaggagagcctggagcggcggcgcagcctcttcaagaagctggccaagcagcccagccccctgctgcacaccagccgctccttcagctgcctgaacagaagcctgagcagcggggagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctaccgcagcggccgcaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagccccccaggagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttccggcgggccccagcccctggcaccctgcaggacggcctgtgccacagcctggaccggggcatctctggaaaaggagagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgaatgtctgcccggcaaccctgtgcggcccactggaggccagcaggagcccccaccagccagcgagagccgggcctttgtgagcagcacccacgccgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgagaagaggagtggagcccaagccagaggccctgctggcccggcgcagcctgcagcccccaggcatcgagagcgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagcccaggcctggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgccccggcccggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagaccggcgggcagagggcaagaagtgcacagaggccctgtatgccccagctgagggggacaagctggaggccggcctgagctttgtgcacagcgagaaccggctgaagggagctgagaggcctgctgctggggtgggcaagggcttccctgaggcccggggcaaaggacctggcccccagaagccacccacagaggccgacaagcccaacggcatgaagaggagccccagcgccaccggccagagcagcttccgcagcacagccctgcctgagaagagcctgagctgcagcagcagcttccctgagaccagggctggggtgcgggaggccagcgctgccagcagtgacaccagcagcgccaaggctgctgggggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40046 - DNA, 7881 bp, Artificial Sequence
  Description of Artificial Sequence: Synthetic coding sequence
atgggagagaaggtgtctgaggcccctgagcctgtgccccggggctgcagcggccacggcagcaggaccccagccagcgccctggtggccgccagcagccctggggccagcagcgctgagagcagcagcggcagcgagaccctgtctgaggagggggagcccggcggcttcagccgggagcaccagcccccacctcctccacccctgggcggcaccctgggcgcccgggccccagctgcctgggccccagcctctgtgctgctggagcggggcgtgctggccctgcccccacccctgcccggcggcgctgtgcccccagccccccggggcagcagcgccagccaggaggagcaggatgaggagctggaccacatcctgagccccccacccatgcccttcaggaagtgcagcaacccagatgtggccagcggccctgggaagagcctgaagtacaagaggcagctgtctgaagatggccggcagctgcggcggggcagcctgggcggggccctgaccggccgctacctgctgcccaaccctgtggccggccaggcctggccagccagcgctgagaccagcaacctggtgaggatgaggagccaggccctgggccagagcgcccccagcctgacagccagcctgaaggagctgagcctgccccggcggggcagcttctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgcccggagcctgaacagaacagatggaagacgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagagaaccgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgagagcggggagctggccttcatcaagcagctggtgaggaagatcctgattgtgattgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgattctggaacagctgagaccccagagacagatgagagcgtgagcagcagcaatgccagcctgaagctgcggaggaagccccgggagagtgactttgagaccatcaagctgatcagcaatggagcctacggggctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagaccaggaggcacctgtgcatggtgatggagtatgtggagggcggggactgtgccaccctgatgaagaacatgggccccctgcctgtggacatggccaggatgtactttgctgagaccgtgctggccctggagtacctgcacaactacggcatcgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttctttggagacaccccagaggagctgtttggccaggtgatcagtgatgagatcaactggccagagaaggatgaggcccctcctccagatgcccaggacctgatcaccctgctgctgcggcagaaccccctggagcggctgggcaccggcggggcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaagctgccagctgccctggggacccccatgaggagcccgggaagccagccctgcccccagaagaatgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaatggagagcctgtgcacggcctggtgcacacagaggtgattgagctgctgctgaagagcggcaacaaggtgtccatcaccaccaccccatttgagaacaccagcatcaagacaggccctgccaggagaaattcctacaagagcaggatggtgcggcgcagcaagaagagcaagaagaaggagagcctggagcggcggcgcagcctcttcaagaagctggccaagcagcccagccccctgctgcacaccagccgctccttcagctgcctgaacagaagcctgagcagcggggagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctaccgcagcggccgcaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagccccccaggagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttccggcgggccccagcccctggcaccctgcaggacggcctgtgccacagcctggaccggggcatctctggaaaaggagagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgaatgtctgcccggcaaccctgtgcggcccactggaggccagcaggagcccccaccagccagcgagagccgggcctttgtgagcagcacccacgccgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgagaagaggagtggagcccaagccagaggccctgctggcccggcgcagcctgcagcccccaggcatcgagagcgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagcccaggcctggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgccccggcccggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagaccggcgggcagagggcaagaagtgcacagaggccctgtatgccccagctgagggggacaagctggaggccggcctgagctttgtgcacagcgagaaccggctgaagggagctgagaggcctgctgctggggtgggcaagggcttccctgaggcccggggcaaaggacctggcccccagaagccacccacagaggccgacaagcccaacggcatgaagaggagccccagcgccaccggccagagcagcttccgcagcacagccctgcctgagaagagcctgagctgcagcagcagcttccctgagaccagggctggggtgcgggaggccagcgctgccagcagtgacaccagcagcgccaaggctgctgggggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40047 - DNA, 7335 bp, Artificial Sequence
  Description of Artificial Sequence: Synthetic coding sequence
atgaaggcccagcgggagcggctgcagatccctggcctgaccctggacctgacccccaggagcctgagccccacccccagcagccctggcagcccctgcagccccctgctggccttccacttctggagctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgccaggagaaatgacagaacagatggaagacgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagagaaccgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgagagcggggagctggccttcatcaagcagctggtgaggaagatcctgattgtgattgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgattctggaacagctgagaccccagagacagatgagagcgtgagcagcagcaatgccagcctgaagctgcggaggaagccccgggagagtgactttgagaccatcaagctgatcagcaatggagcctacggggctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagaccaggaggcacctgtgcatggtgatggagtatgtggagggcggggactgtgccaccctgatgaagaacatgggccccctgcctgtggacatggccaggatgtactttgctgagaccgtgctggccctggagtacctgcacaactacggcatcgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttctttggagacaccccagaggagctgtttggccaggtgatcagtgatgagatcaactggccagagaaggatgaggcccctcctccagatgcccaggacctgatcaccctgctgctgcggcagaaccccctggagcggctgggcaccggcggggcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaagctgccagctgccctggggacccccatgaggagcccgggaagccagccctgcccccagaagaatgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaatggagagcctgtgcacggcctggtgcacacagaggtgattgagctgctgctgaagagcggcaacaaggtgtccatcaccaccaccccatttgagaacaccagcatcaagacaggccctgccaggagaaattcctacaagagcaggatggtgcggcgcagcaagaagagcaagaagaaggagagcctggagcggcggcgcagcctcttcaagaagctggccaagcagcccagccccctgctgcacaccagccgctccttcagctgcctgaacagaagcctgagcagcggggagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctaccgcagcggccgcaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagccccccaggagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttccggcgggccccagcccctggcaccctgcaggacggcctgtgccacagcctggaccggggcatctctggaaaaggagagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgaatgtctgcccggcaaccctgtgcggcccactggaggccagcaggagcccccaccagccagcgagagccgggcctttgtgagcagcacccacgccgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgagaagaggagtggagcccaagccagaggccctgctggcccggcgcagcctgcagcccccaggcatcgagagcgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagcccaggcctggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgccccggcccggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagaccggcgggcagagggcaagaagtgcacagaggccctgtatgccccagctgagggggacaagctggaggccggcctgagctttgtgcacagcgagaaccggctgaagggagctgagaggcctgctgctggggtgggcaagggcttccctgaggcccggggcaaaggacctggcccccagaagccacccacagaggccgacaagcccaacggcatgaagaggagccccagcgccaccggccagagcagcttccgcagcacagccctgcctgagaagagcctgagctgcagcagcagcttccctgagaccagggctggggtgcgggaggccagcgctgccagcagtgacaccagcagcgccaaggctgctgggggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40048 - DNA, 753 bp, Artificial Sequence
  Description of Artificial Sequence: Synthetic coding sequence
atgggagagaaggtgtctgaggcccctgagcctgtgccccggggctgcagcggccacggcagcaggaccccagccagcgccctggtggccgccagcagccctggggccagcagcgctgagagcagcagcggcagcgagaccctgtctgaggagggggagcccggcggcttcagccgggagcaccagcccccacctcctccacccctgggcggcaccctgggcgcccgggccccagctgcctgggccccagcctctgtgctgctggagcggggcgtgctggccctgcccccacccctgcccggcggcgctgtgcccccagccccccggggcagcagcgccagccaggaggagcaggatgaggagctggaccacatcctgagccccccacccatgcccttcaggaagtgcagcaacccagatgtggccagcggccctgggaagagcctgaagtacaagaggcagctgtctgaagatggccggcagctgcggcggggcagcctgggcggggccctgaccggccgctacctgctgcccaaccctgtggccggccaggcctggccagccagcgctgagaccagcaacctggtgaggatgaggagccaggccctgggccagagcgcccccagcctgacagccagcctgaaggagctgagcctgccccggcggggcagcctgattgacagccagaagtggaactgcctggtgaagaggcctgtgtgccccaatgccggccgcaccagccccctgggctag

SEQ ID NO: 40049 - DNA, 2982 bp, Artificial Sequence
  Description of Artificial Sequence: Synthetic coding sequence
atggacatgtctgaccccaacttctggacagtgctgagcaacttcaccctgccccacctgcggagcggcaaccggctgcggaggacccagagctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgccaggagaacagatggccgccgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagaaaatcgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgaaagtggagagctggccttcatcaagcagctggtgaggaagatcctgattgtcatcgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgacagcggcacagctgagaccccagagacagatgaatctgtgagcagcagcaatgccagcctgaagctgcggaggaagccccgggagagtgactttgagaccatcaagctgatcagcaatggagcctatggagctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagacccggcggcacctgtgcatggtgatggagtatgtggagggcggggactgtgccaccctgatgaagaacatgggccccctgcctgtggacatggccaggatgtactttgctgagaccgtgctggccctggagtacctgcacaactatggaattgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcaactggccagagaaggatgaggcccctcctccagatgcccaggacctgatcaccctgctgctgcggcagaaccccctggagcggctgggcactggaggagcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaggccgccagctgccctggggacccccatgaggagcccgggaagccagccctgcccccagaggagtgtgcccaggaggagcctgaggtgaccaccccagccagcaccatcagcagcagcaccctgagtgacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaatggagagcctgtgcacggcctggtgcacacagaggtgattgagctgctgctgaagagcggcaacaaggtgtccatcaccaccaccccatttgagaacaccagcatcaagacaggccctgccaggagaaattcctacaagagcaggatggtgcggcgcagcaagaagagctag

SEQ ID NO: 40050 - DNA, 507 bp, Artificial Sequence
  Description of Artificial Sequence: Synthetic coding sequence
atggacatgtctgaccccaacttctggacagtgctgagcaacttcaccctgccccacctgcggagcggcaaccggctgcggaggacccagagctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgccaggagaacagatggccgccgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagaaaatcgctgcaggaacacccccatgaggcccaggagccgcagcctgagccctggccgcagcccctag

SEQ ID NO: 40051 - DNA, 7872 bp, Artificial Sequence
  Description of Artificial Sequence: Synthetic coding sequence
atgggagagaaggtgtctgaggcccctgagcctgtgccccggggctgcagcggccacggcagcaggaccccagccagcgccctggtggccgccagcagccctggggccagcagcgctgagagcagcagcggcagcgagaccctgtctgaggagggggagcccggcggcttcagccgggagcaccagcccccacctcctccacccctgggcggcaccctgggcgcccgggccccagctgcctgggccccagcctctgtgctgctggagcggggcgtgctggccctgcccccacccctgcccggcggcgctgtgcccccagccccccggggcagcagcgccagccaggaggagcaggatgaggagctggaccacatcctgagccccccacccatgcccttcaggaagtgcagcaacccagatgtggccagcggccctgggaagagcctgaagtacaagaggcagctgtctgaagatggccggcagctgcggcggggcagcctgggcggggccctgaccggccgctacctgctgcccaaccctgtggccggccaggcctggccagccagcgctgagaccagcaacctggtgaggatgaggagccaggccctgggccagagcgcccccagcctgacagccagcctgaaggagctgagcctgccccggcggggcagcttctgcaggaccagcaacaggaagagcctgattggaaatggccagagccctgccctgccccggccccacagccccctgagcgcccacgccggcaacagcccccaggacagccccaggaacttcagccccagcgccagcgcccacttctcctttgccaggagaacagatggccgccgctggagcctggccagcctgcccagcagcggctacggcaccaacacccccagcagcacagtgagcagcagctgcagcagccaggagaagctgcaccagctgccctaccagcccaccccagatgagctgcacttcctgagcaagcacttctgcaccacagagagcatcgccacagaaaatcgctgcaggaacacccccatgaggcccaggagccgcagcctgagccctggccgcagccctgcctgctgtgaccacgagatcatcatgatgaaccacgtgtacaaggagcgcttccccaaggccacagcccagatggaggagcggctgaaggagatcatcaccagctacagcccagacaacgtgctgcccctggctgatggagtgctgtccttcacccaccaccagatcatcgagctggcccgggactgcctggacaagagccaccagggcctcatcaccagccgctacttcctggagctgcagcacaagctggacaagctgctgcaggaggcccatgacagaagtgaaagtggagagctggccttcatcaagcagctggtgaggaagatcctgattgtcatcgcccggcctgcccggctgctggagtgcctggagtttgatcctgaggagttctactacctgctggaggccgctgagggccacgccaaggagggccagggcatcaagacagacatcccccgctacatcatcagccagctgggcctgaacaaggaccccctggaggagatggcccacctgggcaactatgacagcggcacagctgagaccccagagacagatgaatctgtgagcagcagcaatgccagcctgaagctgcggaggaagccccgggagagtgactttgagaccatcaagctgatcagcaatggagcctatggagctgtgtactttgtgcgccacaaggagagccggcagagatttgccatgaagaagatcaacaagcagaacctgatcctgaggaaccagatccagcaggcctttgtggagcgggacatcctgacctttgctgagaacccctttgtggtgtccatgtactgcagctttgagacccggcggcacctgtgcatggtgatggagtatgtggagggcggggactgtgccaccctgatgaagaacatgggccccctgcctgtggacatggccaggatgtactttgctgagaccgtgctggccctggagtacctgcacaactatggaattgtgcaccgggacctgaagccagacaacctgctggtgacctccatgggccacatcaagctgacagactttggcctgagcaaggtgggcctgatgtccatgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcaactggccagagaaggatgaggcccctcctccagatgcccaggacctgatcaccctgctgctgcggcagaaccccctggagcggctgggcactggaggagcctatgaggtgaagcagcaccgcttcttccgcagcctggactggaacagcctgctgcggcagaaggccgagttcatcccccagctggagagtgaagatgacaccagctactttgacaccaggtctgagaagtaccaccacatggagacagaggaggaggatgacaccaatgatgaggacttcaacgtggagatccggcagttcagcagctgcagccaccgcttcagcaaggtgttcagcagcattgaccgcatcacccagaacagcgctgaggagaaggaggacagcgtggacaagaccaagagcaccaccctgcccagcacagagaccctgtcctggagcagcgagtacagcgagatgcagcagctgagcaccagcaacagcagtgacacagagagcaacagacacaagctgagcagcggcctgctgcccaagctggccatcagcacagaaggagagcaggatgaggccgccagctgccctggggacccccatgaggagcccgggaagccagccctgcccccagaggagtgtgcccaggaggagcctgaggtgaccaccccagccagcaccatcagcagcagcaccctgtctgtgggcagcttcagcgagcacctggaccagatcaatggccgctcagaatgtgtggacagcacagacaacagcagcaagcccagcagcgagcccgccagccacatggcccggcagaggctggagagcacagagaagaagaagatcagcggcaaggtgaccaagagcctgagcgccagcgccctgagcctgatgatccctggggacatgtttgctgtgagccccctgggcagccccatgagcccccacagcctgagcagtgaccccagcagcagccgggacagcagccccagccgggacagcagcgctgccagcgccagcccccaccagcccatcgtcatccacagcagcggcaagaactacggcttcaccatccgggccatccgggtgtatgtgggggacagcgacatctacacagtgcaccacatcgtgtggaatgtggaggagggcagccctgcctgccaggccggcctgaaggccggggacctgatcacccacatcaacggggagcctgtgcacggcctggtgcacacagaggtgattgagctgctgctgaagagcggcaacaaggtgtccatcaccaccaccccatttgagaacaccagcatcaagacaggccctgcccggaggaacagctacaagagcaggatggtgagaagaagcaagaagagcaagaagaaggagagcctggagaggagaagaagcctcttcaagaagctggccaagcagcccagccccctgctgcacaccagccgctccttcagctgcctgaacagaagcctgagcagtggagagagcctgcccggcagccccacccacagcctgagccccaggagccccacccccagctaccgcagcaccccagacttccccagcggcaccaacagcagccagagcagcagccccagcagcagcgcccccaacagccctgctggcagcggccacatccggcccagcaccctgcacggcctggcccccaagctgggcggccagcgctacagaagtggaagaaggaagtctgctggcaacatccccctgagccccctggcccggacccccagccccaccccccagcccaccagcccccagaggagccccagccccctgctgggccacagcctgggcaacagcaagatcgcccaggccttccccagcaagatgcacagcccccccaccatcgtgcgccacatcgtgcggcccaagtctgctgagcccccaagaagccccctgctgaagagggtgcagagcgaggagaagctgagccccagctatggcagtgacaagaagcacctgtgcagcaggaagcacagcctggaggtgacccaggaggaggtgcagcgggagcagagccagcgggaggcccccctgcagagcctggatgaaaatgtgtgtgatgtgccccccctgagccgggcccggcctgtggagcagggctgcctgaagaggcctgtgtccaggaaggtgggccggcaggagagcgtggatgacctggaccgggacaagctgaaggccaaggtggtggtgaagaaggcagatggcttccctgagaagcaggagagccaccagaagagccacggccctggcagtgacctggagaactttgccctcttcaagctggaggagcgggagaagaaggtgtaccccaaggctgtggagaggagcagcacctttgagaacaaggcctccatgcaggaggccccacccctgggcagcctgctgaaggatgccctgcacaagcaggcctctgtgcgggccagcgagggcgccatgtctgatggccgggtgcctgctgagcaccggcagggcggcggggacttcagaagagccccagcccctggcaccctgcaggacggcctgtgccacagcctggaccggggcatcagcggcaagggggagggcacagagaagagcagccaggccaaggagctgctgcgctgtgagaagctggacagcaagctggccaacatcgactacctgaggaagaagatgagcctggaggacaaggaggacaacctgtgccctgtgctgaagcccaagatgacagctggcagccatgagtgcctgcccggcaaccctgtgcggcccaccggcggccagcaggagcccccaccagccagcgagagccgggcctttgtgagcagcacccatgctgcccagatgtctgctgtgtcctttgtgcccctgaaggccctgaccggccgggtggacagcggcacagagaagccaggcctggtggcccctgagagccctgtgaggaagagccccagcgagtacaagctggagggccgctctgtgtcctgcctgaagcccatcgagggcaccctggacatcgccctgctgagcggcccccaggccagcaagacagagctgcccagccctgagagcgcccagagccccagccccagcggagatgtgcgggcctctgtgccccctgtgctgcccagcagcagcggcaagaagaatgacaccaccagcgcccgggagctgagccccagcagcctgaagatgaacaagagctacctgctggagccctggttcctgccccccagccggggcctgcagaacagccctgctgtgtccctgcctgaccctgagttcaagagggacaggaagggcccccaccccacagcccggagccctggcaccgtgatggagagcaacccccagcagcgggagggcagcagccccaagcaccaggaccacaccacagaccccaagctgctgacctgcctgggccagaacctgcacagcccagacctggcccggccccgctgccccctgcccccagaggccagccccagccgggagaagccaggcctgcgggagagcagcgagcggggccccccaacagcccggtctgagaggtctgctgcccgggctgacacctgccgggagcccagcatggagctgtgcttccctgagacagccaagaccagtgacaacagcaagaacctgctgtctgtgggccgcacccacccagacttctacacccagacccaggccatggagaaggcctgggcccctgggggcaagaccaaccacaaggatggccctggagaggcccggcccccaccccgggacaacagcagcctgcacagcgctggcatcccctgtgagaaggagctgggcaaggtgcggcggggcgtggagcccaagccagaggccctgctggcccggcgcagcctgcagcccccaggcattgaaagtgagaagtctgagaagctgagcagcttccccagcctgcagaaggatggagccaaggagcctgagaggaaggagcagcccctgcagaggcaccccagcagcatccccccaccacccctgacagccaaggacctgagcagccctgctgcccggcagcactgcagcagccccagccacgccagcggccgggagcccggggccaagcccagcacagctgagcccagcagcagcccccaggacccccccaagcctgtggccgcccacagcgagagcagcagccacaagccccggcccggccctgaccccggcccccccaagaccaagcacccagacaggagcctgagcagccagaagcccagcgtgggcgccaccaagggcaaggagcccgccacccagagcctgggcggcagcagccgggagggcaagggccacagcaagagcggcccagatgtgtttcctgccaccccaggcagccagaacaaggccagtgatggcatcggccagggcgagggcggccccagcgtgcccctgcacacagaccgggcccccctggatgccaagccccagcccaccagcggcggccggcccctggaggtgctggagaagcctgtgcacctgcccaggcctggccaccctggccccagcgagcctgctgaccagaagctgtctgctgtgggggagaagcagaccctgagccccaagcaccccaagcccagcacagtgaaggactgccccaccctgtgcaagcagacagacaaccggcagacagacaagagccccagccagcctgctgccaacacagacagaagagctgagggcaagaagtgcacagaggccctgtatgccccagctgagggggacaagctggaggccggcctgagctttgtgcacagtgaaaatcggctgaagggagctgagaggcctgctgctggggtgggcaagggcttccctgaggcccggggcaagggccctggcccccagaagcccccaacagaagctgacaagcccaacggcatgaagaggagccccagcgccaccggccagagcagcttccgcagcacagccctgcctgagaagagcctgagctgcagcagcagcttccctgagacccgggccggcgtgcgggaggccagcgctgccagcagtgacaccagcagcgccaaggccgccggcggcatgctggagctgcctgcccccagcaacagagaccacaggaaggcccagcctgctggggagggccgcacccacatgaccaagagtgacagcctgcccagcttccgggtgtccaccctgcccctggagagccaccacccagaccccaacaccatgggcggggccagccaccgggaccgggccctgtctgtgacagccaccgtgggggagaccaagggcaaggaccctgccccagcccagcccccaccagccaggaagcagaatgtgggcagagatgtgaccaagcccagccctgcccccaacacagaccggcccatcagcctgagcaatgagaaggactttgtggtgcggcagaggcggggcaaggagagcctgcggagcagcccccacaagaaggccctgtag

SEQ ID NO: 40052 - DNA, 1152 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggccgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttccgggagaatgccaaggccaagacagaccacggggctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40053 - DNA, 1239 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagctgaggccgaggaggccggcattggagacacccccagcctggaggatgaagctgctggccacgtgacccaggccaggatggtgtccaagagcaaggatggcaccggcagtgatgacaagaaggccaagggagcagatggcaagaccaagatcgccacccccaggggggccgcccctcctggccagaagggccaggccaatgccacccgcatcccagccaagaccccaccagcccccaagaccccacccagcagcggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40054 - DNA, 1326 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttccgggagaatgccaaggccaagacagaccacggggctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40055 - DNA, 795 bp, Artificial Sequence
  Description of Artificial Sequence: Synthetic coding sequence
acccgggaggccgagggcgcagatggcaagaccaagatcgccacccccaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40056 - DNA, 651 bp, Artificial Sequence
  Description of Artificial Sequence: Synthetic coding sequence
atggccgagccccggcaggagtttgaggtgatggaggaccatgctggcacctacggcctgggggacaggaaggaccagcgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40057 - DNA, 1152 bp, Artificial Sequence; identical to SEQ ID NO: 40052
  Description of Artificial Sequence: Synthetic coding sequence

SEQ ID NO: 40058 - DNA, 951 bp, Artificial Sequence
  Description of Artificial Sequence: Synthetic coding sequence
atgctgcgggccctgcagcagaggaagcgggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40059 - DNA, 2277 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggagcctgagagcggcaaggtggtgcaggagggcttcctgcgggagcccggccccccaggcctgagccaccagctgatgagcggcatgcctggggcccccctgctgcctgagggcccccgggaggccacccggcagcccagcggcactggacctgaggacacagagggcggcagacatgcccctgagctgctgaagcaccagctgctgggggacctgcaccaggagggccccctgctgaagggggccggcggcaaggagcggcccggcagcaaggaggaggtggatgaggacagagatgtggatgagagcagcccccaggacagcccccccagcaaggccagccctgcccaggacggccggcccccccagacagctgcccgggaggccaccagcatccctggcttccctgctgagggcgccatccccctgcctgtggacttcctgagcaaggtgtccacagagatcccagccagcgagcccaacggccccagcgctggccgggccaagggccaggatgcccccctggagttcaccttccacgtggagatcacccccaacgtgcagaaggagcaggcccacagcgaggagcacctgggccgggccgccttccctggggcccctggagagggccctgaggcccggggccccagcctgggggaggacaccaaggaggccgacctgcctgagcccagcgagaagcagcctgctgctgccccccggggcaagcctgtgtcctgggtgccccagctgaaggccaggatggtgtccaagagcaaggatggcaccggcagtgatgacaagaaggccaagaccagcaccaggagcagcgccaagaccctgaagaaccggccctgcctgagccccaagcaccccaccccaggcagcagtgaccccctcatccagcccagcagccctgctgtgtgcccagagccccccagcagccccaagtatgtgtcctctgtgacccccaggacaggcagcagcggggccaaggagatgaagctgaagggagcagatggcaagaccaagatcgccacccccaggggggccgcccctcctggccagaagggccaggccaatgccacccgcatcccagccaagaccccaccagcccccaagaccccacccagcagcggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40060 - DNA, 2331 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggagcctgagagcggcaaggtggtgcaggagggcttcctgcgggagcccggccccccaggcctgagccaccagctgatgagcggcatgcctggggcccccctgctgcctgagggcccccgggaggccacccggcagcccagcggcactggacctgaggacacagagggcggcagacatgcccctgagctgctgaagcaccagctgctgggggacctgcaccaggagggccccctgctgaagggggccggcggcaaggagcggcccggcagcaaggaggaggtggatgaggacagagatgtggatgagagcagcccccaggacagcccccccagcaaggccagccctgcccaggacggccggcccccccagacagctgcccgggaggccaccagcatccctggcttccctgctgagggcgccatccccctgcctgtggacttcctgagcaaggtgtccacagagatcccagccagcgagcccaacggccccagcgctggccgggccaagggccaggatgcccccctggagttcaccttccacgtggagatcacccccaacgtgcagaaggagcaggcccacagcgaggagcacctgggccgggccgccttccctggggcccctggagagggccctgaggcccggggccccagcctgggggaggacaccaaggaggccgacctgcctgagcccagcgagaagcagcctgctgctgccccccggggcaagcctgtgtcctgggtgccccagctgaaggccaggatggtgtccaagagcaaggatggcaccggcagtgatgacaagaaggccaagaccagcaccaggagcagcgccaagaccctgaagaaccggccctgcctgagccccaagcaccccaccccaggcagcagtgaccccctcatccagcccagcagccctgctgtgtgcccagagccccccagcagccccaagtatgtgtcctctgtgacccccaggacaggcagcagcggggccaaggagatgaagctgaagggagcagatggcaagaccaagatcgccacccccaggggggccgcccctcctggccagaagggccaggccaatgccacccgcatcccagccaagaccccaccagcccccaagaccccacccagcagcgccaccaagcaggtgcagaggaggcctcctcctgctggccccaggtctgagcggggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40061 - DNA, 1233 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 40062 - DNA, 1167 bp, Artificial Sequence
  Description of Artificial Sequence: Synthetic coding sequence
atggtggaggccgaggagctggcccagctgcggctgctgaacctggagctgctgcggcagctgtgggtgggccaggatgctgtgagaagatctgtggcccgggccgccagcgagagcagcctggagagcagcagcagctacaacagcgagacccccagcaccccagagaccagcagcaccagcctgagcaccagctgcccccggggccgcagctctgtgtggggccccccagatgcctgccgcggggacctgagagatgtggcccggtctggagtggccagcctgcccccagccaagtgccagcaccaggagagcctgggccggccccggccccacagcgcccccagcctgggcaccagcagcctgcgggaccctgagcccagcggccgcctgggggaccccggcccccaggaggcccagacccccaggagcatcctggcccagcagagcaagctgagcaagccccgggtgaccttcagcgaggagagcgctgtgcccaagaggtcctggaggctgcggccctacctgggctatgactggattgctggcagcctggacaccagcagcagcatcaccagccagcctgaggccttcttcagcaagctgcaggagttccgggagaccaacaaggaggagtgcatctgcagccaccctgagccccagctgcccggcctgcgggagagcagcggcagcggcgtggaggaggaccatgaatgtgtgtactgctacagagtgaacagaagactcttccctgtgcctgtggaccccggcaccccctgccgcctgtgcaggaccccccgggaccagcagggccctggcaccctggcccagcctgcccacgtgcgggtgtccatccccctgagcatcctggagcccccccaccgctaccacatccacaggaggaagagctttgatgccagtgacaccctggccctgcccaggcactgcctgctgggctgggacatcttcccccccaagtctgagaagagcagcgcccccaggaacctggacctgtggagctctgtgtctgctgaggcccagcaccagaagctgagcggcaccagcagccccttccacccagccagccccatgcagatgctgccccccacccccacctggagcgtgccccaggtgccccggccccacgtgccccggcagaagccctag

SEQ ID NO: 40063 - DNA, 1077 bp, Artificial Sequence
  Description of Artificial Sequence: Synthetic coding sequence
atggtggaggccgaggagctggcccagctgcggctgctgaacctggagctgctgcggcagctgtgggtgggccaggatgctgtgagaagatctgtggcccgggccgccagcgagagcagcctggagagcagcagcagctacaacagcgagacccccagcaccccagagaccagcagcaccagcctgagcaccagctgcccccggggccgcagctctgtgtggggccccccagatgcctgccgcggggacctgagagatgtggcccggtctggagtggccagcctgcccccagccaagtgccagcaccaggagagcctgggccggccccggccccacagcgcccccagcctgggcaccagcagcctgcgggaccctgagcccagcggccgcctgggggaccccggcccccaggaggcccagacccccaggagcatcctggcccagcagagcaagctgagcaagccccgggtgaccttcagcgaggagagcgctgtgcccaagaggtcctggaggctgcggccctacctgggctatgactggattgctggcagcctggacaccagcagcagcatcaccagccagcctgaggccttcttcagcaagctgcaggagttccgggagaccaacaaggaggagtgcatctgcagccaccctgagccccagctgcccggcctgcgggagagcagcggcagcggcgtggaggaggaccatgaatgtgtgtactgctacagagtgaacagaagactcttccctgtgcctgtggaccccggcaccccctgccgcctgtgcaggaccccccgggaccagcagggccctggcaccctggcccagcctgcccacgtgtccacagcctgctgggccggcaccttcttcctgcggagcctgaggaaggcccagcccccaggcacctggaccagcggccccctgagccccctgcggcccagcaccaggagctgcccagccccagctgccctcttcacccggccccaccagtgccgctgctgcccccggccccggcccggccagtgccccaggagcctgggccccaccagccacggccgcagcccagaagattag

SEQ ID NO: 40064 - DNA, 2070 bp, Artificial Sequence
  Description of Artificial Sequence: Synthetic coding sequence
agcagcggcctgactgtgacagctgtgaaggacagcggggagtggaacctggaggccggggccctggtgctggctgatgctggcctgtgctgcattgatgagttcaacagcctgaaggagcatgacaggaccagcatccacgaggccatggagcagcagaccatctctgtggccaaggccggcctggtgtgcaagctgaacaccaggaccaccatcctggccgccaccaaccccaagggccagtatgacccccaggagagcgtgtctgtgaacatcgccctgggcagccccctgctgagcagatttgacctgatcctggtgctgctggacaccaagaatgaagactgggaccgcatcatcagcagcttcatcctggagaacaagggctaccccagcaagtctgagaagctgtggagcatggagaagatgaagacctacttctgcctgatccggaacctgcagcccaccctgagtgatgtgggcaaccaggtgctgctgcgctactaccagatgcagaggcagagcgactgcagaaatgctgcccggaccaccatccggctgctggagagcctcatccggctggccgaggcccacgcccggctgatgttccgggacacagtgaccctggaggatgccatcaccgtggtgtctgtgatggagagctccatgcagggcggggccctgctgggcggcgtgaatgccctgcacaccagcttcccagaaaatcctggagagcagtaccagaggcagtgtgagctgatcctggagaagctggagctgcagagcctgctgtctgaggagctgcggcggctggagcggctgcagaaccagagcgtgcaccagagccagccccgggtgctggaggtggagaccaccccaggcagcctgagaaatggacctggagaggagagcaacttccgcaccagcagccagcaggagatcaactacagcacccacatcttcagccctgggggcagccctgagggcagccctgtgctggaccccccaccccacctggagcccaacagaagcaccagcaggaagcacagcgcccagcacaagaacaacagagatgacagcctggactggtttgacttcatggccacccaccagagcgagcccaagaacacagtggtggtgagcccccaccccaagaccagcggggagaacatggccagcaagatcagcaacagcaccagccagggcaaggagaagtctgagcccggccagaggagcaaggtggacatcggcctgctgcccagccctggagaaacaggagtgccctggagggctgacaacgtggagagcaacaagaagaagaggctggccctggacagcgaggccgctgtgtctgctgacaagccagattctgtgctgacccaccacgtgcccaggaacctgcagaagctgtgcaaggagcgggcccagaagctgtgcaggaacagcaccagggtgcctgcccagtgcaccgtgcccagccacccccagagcacccctgtgcacagcccagacaggatgctggacagccccaagaggaagaggcccaagagcctggcccaggtggaggagcccgccattgaaaatgtgaagcccccaggcagccctgtggccaagctggccaagttcaccttcaagcagaagagcaagctgatccacagctttgaggaccacagccacgtgtcccctggggccaccaagattgctgtgcacagccccaagatcagccagaggaggaccaggagagatgctgccctgcctgtgaagaggcctgggaagctgaccagcaccccaggcaaccagatcagcagccagccccagggcgagaccaaggaggtgtcccagcagcccccagagaagcacggcccccgggagaaggtgatgtgtgcccctgagaagaggatcatccagcctgagctggagctgggcaatgaaacaggctgtgcccacctgacctgtgagggggacaagaaggaggaggtgtctggcagcaacaagagcggcaaggtgcacgcctgcaccctggcccggctggccaacttctgcttcaccccacccagcgagagcaagtag

SEQ ID NO: 40065 - DNA, 1176 bp, Artificial Sequence
  Description of Artificial Sequence: Synthetic coding sequence
atgaacagcgaccaggtgaccctggtgggccaggtgtttgagagctatgtgtctgagtaccacaagaatgacatcctgctgatcctgaaggagagagatgaagatgcccactaccctgtggtggtgaatgccatgaccctgtttgagaccaacatggagatcggggagtacttcaacatgttccccagcgaggtgctgaccatctttgattctgccctgcggcgcagcgccctgaccatcctgcagagcctgagccagcctgaggccgtgtccatgaagcagaacctgcacgcccgcatcagcggcctgcctgtgtgcccagagctggtgcgggagcacatccccaagaccaaggatgtgggccacttcctgtctgtgactggaacagtcatccgcaccagcctggtgaaggtgctggagtttgagcgggactacatgtgcaacaagtgcaagcacgtgtttgtgatcaaggctgactttgagcagtactacaccttctgccggcccagcagctgccccagcctggagagctgtgacagcagcaagttcacctgcctgagcggcctgagcagcagccccacccgctgccgggactaccaggagatcaagatccaggagcaggtgcagaggctgtctgtgggcagcatccccaggtccatgaaggtgatcctggaggatgacctggtggacagctgcaagtctggagatgacctgaccatctatggaattgtgatgcagcgctggaagcccttccagcaggatgtgcgctgtgaggtggagatcgtgctgaaggccaactacatccaggtgaacaatgagcagagcagcggcatcatcatggatgaggaggtgcagaaggagtttgaggacttctgggagtactacaagagtgacccctttgctggaagaaatgtcatcctggccagcctgtgcccccaggtgtttggcatgtacctggtgaagctggccgtggccatggtgctggccggcggcatccagaggacagatgccaccggcaccagggtgcggggggagagccacctgctgctggtgggggaccccggcaccgggaagagccagttcctgaagtatgctgccaagatcacccccaggtctgtgctgaccaccggcatcggcagcaccagcgctggcatcgtgtgtgacaacttcaagtag

SEQ ID NO: 40066 - DNA, 3432 bp, Artificial Sequence
  Description of Artificial Sequence: Synthetic coding sequence
atgaacagcgaccaggtgaccctggtgggccaggtgtttgagagctatgtgtctgagtaccacaagaatgacatcctgctgatcctgaaggagagagatgaagatgcccactaccctgtggtggtgaatgccatgaccctgtttgagaccaacatggagatcggggagtacttcaacatgttccccagcgaggtgctgaccatctttgattctgccctgcggcgcagcgccctgaccatcctgcagagcctgagccagcctgaggccgtgtccatgaagcagaacctgcacgcccgcatcagcggcctgcctgtgtgcccagagctggtgcgggagcacatccccaagaccaaggatgtgggccacttcctgtctgtgactggaacagtcatccgcaccagcctggtgaaggtgctggagtttgagcgggactacatgtgcaacaagtgcaagcacgtgtttgtgatcaaggctgactttgagcagtactacaccttctgccggcccagcagctgccccagcctggagagctgtgacagcagcaagttcacctgcctgagcggcctgagcagcagccccacccgctgccgggactaccaggagatcaagatccaggagcaggtgcagaggctgtctgtgggcagcatccccaggtccatgaaggtgatcctggaggatgacctggtggacagctgcaagtctggagatgacctgaccatctatggaattgtgatgcagcgctggaagcccttccagcaggatgtgcgctgtgaggtggagatcgtgctgaaggccaactacatccaggtgaacaatgagcagagcagcggcatcatcatggatgaggaggtgcagaaggagtttgaggacttctgggagtactacaagagtgacccctttgctggaagaaatgtcatcctggccagcctgtgcccccaggtgtttggcatgtacctggtgaagctggccgtggccatggtgctggccggcggcatccagaggacagatgccaccggcaccagggtgcggggggagagccacctgctgctggtgggggaccccggcaccgggaagagccagttcctgaagtatgctgccaagatcacccccaggtctgtgctgaccaccggcatcggcagcaccagcgctggcctgactgtgacagctgtgaaggacagcggggagtggaacctggaggccggggccctggtgctggctgatgctggcctgtgctgcattgatgagttcaacagcctgaaggagcatgacaggaccagcatccacgaggccatggagcagcagaccatctctgtggccaaggccggcctggtgtgcaagctgaacaccaggaccaccatcctggccgccaccaaccccaagggccagtatgacccccaggagagcgtgtctgtgaacatcgccctgggcagccccctgctgagcagatttgacctgatcctggtgctgctggacaccaagaatgaagactgggaccgcatcatcagcagcttcatcctggagaacaagggctaccccagcaagtctgagaagctgtggagcatggagaagatgaagacctacttctgcctgatccggaacctgcagcccaccctgagtgatgtgggcaaccaggtgctgctgcgctactaccagatgcagaggcagagcgactgcagaaatgctgcccggaccaccatccggctgctggagagcctcatccggctggccgaggcccacgcccggctgatgttccgggacacagtgaccctggaggatgccatcaccgtggtgtctgtgatggagagctccatgcagggcggggccctgctgggcggcgtgaatgccctgcacaccagcttccctgagaaccctggagagcagtaccagaggcagtgtgagctgatcctggagaagctggagctgcagagcctgctgtctgaggagctgcggcggctggagcggctgcagaaccagagcgtgcaccagagccagccccgggtgctggaggtggagaccaccccaggcagcctgagaaatggacctggagaggagagcaacttccgcaccagcagccagcaggagatcaactacagcacccacatcttcagccctgggggcagccctgagggcagccctgtgctggaccccccaccccacctggagcccaacagaagcaccagcaggaagcacagcgcccagcacaagaacaacagagatgacagcctggactggtttgacttcatggccacccaccagagcgagcccaagaacacagtggtggtgagcccccaccccaagaccagcggggagaacatggccagcaagatcagcaacagcaccagccagggcaaggagaagtctgagcccggccagaggagcaaggtggacatcggcctgctgcccagccctggagagaccggggtgccctggagggctgacaacgtggagagcaacaagaagaagaggctggccctggacagcgaggccgctgtgtctgctgacaagccagacagcgtgctgacccaccacgtgcccaggaacctgcagaagctgtgcaaggagcgggcccagaagctgtgcaggaacagcaccagggtgcctgcccagtgcaccgtgcccagccacccccagagcacccctgtgcacagcccagacaggatgctggacagccccaagaggaagaggcccaagagcctggcccaggtggaggagcccgccattgaaaatgtgaagcccccaggcagccctgtggccaagctggccaagttcaccttcaagcagaagagcaagctgatccacagctttgaggaccacagccacgtgtcccctggggccaccaagattgctgtgcacagccccaagatcagccagaggaggaccaggagagatgctgccctgcctgtgaagaggcctgggaagctgaccagcaccccaggcaaccagatcagcagccagccccagggcgagaccaaggaggtgtcccagcagcccccagagaagcacggcccccgggagaaggtgatgtgtgcccctgagaagaggatcatccagcctgagctggagctgggcaatgagaccggctgtgcccacctgacctgtgagggggacaagaaggaggaggtgtctggcagcaacaagagcggcaaggtgcacgcctgcaccctggcccggctggccaacttctgcttcaccccaccttctgagagcaagagcaagagccccccacctgagaggaagaacagaggagagcggggccccagcagcccccccaccaccacagcccccatgagggtgtccaagaggaagagcttccagctgcggggcagcacagagaagctgattgtgtccaaggagagcctcttcaccctgcctgagctgggagatgaggcctttgactgtgactgggatgaggagatgaggaagaagagctag

SEQ ID NO: 40067 - DNA, 471 bp, Artificial Sequence
  Description of Artificial Sequence: Synthetic coding sequence
atgaacagcgaccaggtgaccctggtgggccaggtgtttgagagctatgtgtctgagtaccacaagaatgacatcctgctgatcctgaaggagagagatgaagatgcccactaccctgtggtggtgaatgccatgaccctgtttgagaccaacatggagatcggggagtacttcaacatgttccccagcgaggtgctgaccatctttgattctgccctgcggcgcagcgccctgaccatcctgcagagcctgagccagcctgaggccgtgtccatgaagcagaacctgcacgcccgcatcagcggcctgcctgtgtgcccagagctggtgcgggagcacatccccaagaccaaggatgtgggccacttcctgtctgtgactggaacagtcatccgcaccagcctggtgaaggtgctggagtttgagcgggactacatgtgcaacaagtgcaagcacgtgtttgtgatctag

SEQ ID NO: 40068 - DNA, 237 bp, Artificial Sequence
  Description of Artificial Sequence: Synthetic coding sequence
atgaacagcgaccaggtgaccctggtgggccaggtgtttgagagctatgtgtctgagtaccacaagaatgacatcctgctgatcctgaaggagagagatgaagatgcccactaccctgtggtggtgaatgccatgaccctgtttgagaccaacatggagatcggggagtacttcaacatgttccccagcgaggtgctgaccatctttgattctgccctgcggcgcagcgccctgtag

SEQ ID NO: 40069 - DNA, 2628 bp, Artificial Sequence
  Description of Artificial Sequence: Synthetic coding sequence
atgagcggcaccaagccagacatcctgtgggccccccaccacgtggacagatttgtggtgtgtgacagcgagctgagcctgtaccacgtggagagcacagtgaacagcgagctgaaggccggcagcctgcggctgtctgaagattctgctgccaccctgctgagcatcaacagcgacaccccctacatgaagtgtgtggcctggtacctgaactatgaccctgaatgtctgctggccgtgggccaggccaacggccgggtggtgctgaccagcctgggccaggaccacaacagcaagttcaaggacctgattggcaaggagtttgtgcccaagcacgcccggcagtgcaacaccctggcctggaaccccctggacagcaactggctggccgccggcctggacaagcacagagctgacttctctgtgctgatctgggacatctgcagcaagtacaccccagacatcgtgcccatggagaaggtgaagctgtctgctggggagacagagaccaccctgctggtgaccaagcccctgtatgagctgggccagaatgatgcctgcctgagcctgtgctggctgccccgggaccagaagctgctgctggccggcatgcacaggaacctggccatctttgacctgaggaacaccagccagaagatgtttgtgaacaccaaggctgtgcagggcgtgacagtggacccctacttccatgacagagtggccagcttctatgagggccaggtggccatctgggacctgaggaagtttgagaagcctgtgctgaccctgacagagcagcccaagcccctgaccaaggtggcctggtgccccaccaggacaggcctgctggccaccctgacccgggacagcaacatcatccggctgtatgacatgcagcacacccccacccccatcggagatgaaacagagcccaccatcatcgagaggtctgtgcagccctgtgacaactacatcgccagctttgcctggcaccccaccagccagaacaggatgattgtggtgacccccaacagaaccatgtctgacttcaccgtgtttgagcgcatcagcctggcctggagccccatcaccagcctgatgtgggcctgtggccgccacctgtatgagtgcacagaggaggagaatgacaacagcctggagaaggacatcgccaccaagatgaggctgcgggccctgagccgctatggcctggacacagagcaggtgtggaggaaccacatcctggccggaaatgaagacccccagctgaagagcctgtggtacaccctgcacttcatgaagcagtacacagaggacatggaccagaagagccctggcaacaagggcagcctggtgtatgccggcatcaagagcatcgtgaagagcagcctgggcatggtggagagcagccgccacaactggagcggcctggacaagcagagcgacatccagaacctgaatgaggagcgcatcctggccctgcagctgtgtggctggatcaagaagggcacagatgtggatgtgggccccttcctgaacagcctggtgcaggagggggagtgggagagagctgctgctgtggccctcttcaacctggacatcagaagagccatccagatcctgaatgaaggagccagcagcgagaagggggacctgaacctgaatgtggtggccatggccctgagcggctacacagatgagaagaacagcctgtggagggagatgtgcagcaccctgcggctgcagctgaacaacccctacctgtgtgtgatgtttgccttcctgaccagcgagaccggcagctatgatggagtgctgtatgagaacaaggtggccgtgcgggacagagtggcctttgcctgcaagttcctgagtgacacccagctgaaccgctacatcgagaagctgaccaatgagatgaaggaggccggcaacctggagggcatcctgctgaccggcctgaccaaggatggagtggacctgatggagagctatgtggacagaactggagatgtgcagacagccagctactgcatgctgcagggcagccccctggatgtgctgaaggatgagcgggtgcagtactggattgagaactacagaaacctgctggatgcctggaggttctggcacaagagagctgagtttgacatccacaggagcaagctggaccccagcagcaagcccctggcccaggtgtttgtgtcctgcaacttctgtgggaagagcatctcctacagctgcagcgctgtgccccaccagggccggggcttcagccagtatggagtgtctggcagccccaccaagagcaaggtgaccagctgccccggctgcaggaagcccctgccccgctgtgccctgtgcctgatcaacatgggcacccctgtgagcagctgccctgggggcaccaagagtgatgagaaggtggacctgagcaaggacaagaagctggcccagttcaacaactggttcacctggtgccacaactgccgccacggcggccacgccggccacatgctgtcctggttccgggaccatgctgagtgccctgtgtctgcctgcacctgcaagtgcatgcagctggacaccaccggcaacctggtgcctgctgagaccgtgcagccctag

SEQ ID NO: 40070 - DNA, 2628 bp, Artificial Sequence; identical to SEQ ID NO: 40069
  Description of Artificial Sequence: Synthetic coding sequence

SEQ ID NO: 40071 - DNA, 195 bp, Artificial Sequence
  Description of Artificial Sequence: Synthetic coding sequence
atgagcggcaccaagccagacatcctgtgggccccccaccacgtggacagatttgtggtgtgtgacagcgagctgagcctgtaccacgtggagagcacagtgaacagcgagctgaaggccggcagcctgcggctgtctgaagattctgctgccaccctgctgagcatcaacagcgacaccccctacatgaagtag

SEQ ID NO: 40072 - DNA, 453 bp, Artificial Sequence
  Description of Artificial Sequence: Synthetic coding sequence
atgagcggcaccaagccagacatcctgtgggccccccaccacgtggacagatttgtggtgtgtgacagcgagctgagcctgtaccacgtggagagcacagtgaacagcgagctgaaggccggcagcctgcggctgtctgaagattctgctgccaccctgctgagcatcaacagcgacaccccctacatgaagtgtgtggcctggtacctgaactatgaccctgaatgtctgctggccgtgggccaggccaacggccgggtggtgctgaccagcctgggccaggaccacaacagcaagttcaaggacctgattggcaaggagtttgtgcccaagcacgcccggcagtgcaacaccctggcctggaaccccctggacagcaactggctggccgccggcctggacaagcacagagctgacttctctgtgctgatctgggacatctgcagcaagtag

SEQ ID NO: 40073 - DNA, 195 bp, Artificial Sequence; identical to SEQ ID NO: 40071
  Description of Artificial Sequence: Synthetic coding sequence

SEQ ID NO: 40074 - DNA, 540 bp, Artificial Sequence
  Description of Artificial Sequence: Synthetic coding sequence
atgagcggcaccaagccagacatcctgtgggccccccaccacgtggacagatttgtggtgtgtgacagcgagctgagcctgtaccacgtggagagcacagtgaacagcgagctgaaggccggcagcctgcggctgtctgaagattctgctgccaccctgctgagcatcaacagcgacaccccctacatgaagtgtgtggcctggtacctgaactatgaccctgaatgtctgctggccgtgggccaggccaacggccgggtggtgctgaccagcctgggccaggaccacaacagcaagttcaaggacctgattggcaaggagtttgtgcccaagcacgcccggcagtgcaacaccctggcctggaaccccctggacagcaactggctggccgccggcctggacaagcacagagctgacttctctgtgctgatctgggacatctgcagcaagtacaccccagacatcgtgcccatggagaaggtgaagctgtctgctggggagacagagaccaccctgctggtgaccaagcccctgtactag

SEQ ID NO: 40075 - DNA, 789 bp, Artificial Sequence
  Description of Artificial Sequence: Synthetic coding sequence
atggccctgggcctgaagtgcagcaggatggtgcacccagccttcaggaactacctggccgccagcatccggcctgtgtctgaggtgaccctgaagaaggtgtatgagcggcagcacggccaccggcagtatgtggcctacagcgctgtgcctgtgcaccactttgccaccaagaaggccaaggccaagggcaagggcaagagccagaccagggtgaacatctctgctgcctttgtggaggacatcatcaacctggaggaggtgaatgaggagatgaagagcgtcatcgaggccaggaaggacaacttcaacaagaccctgaacatcggcaccagccctggcagcctggacaagattgctgtggtgacagcagatggcaagctggccctgaaccagatccggcagatctctgtgaagctgccccagctgatcctggtgaacatggccagcttccctgagttcaccgtggccgccatcaaggccatccgggagagcggcatgaacctgaaccctgaggtggagggcaccctcatccgggtgcccatcccccaggtgatccgggagcaccgggagatgctggtgaagctggccaagcagaacaccaacaaggccacctacagcctgaggaaggtgtgcaccaatgccatgaacaagctgaagaagagcaaggacacagtgtctgagggcaccatccggctgacagagaagcagatcagccagatggctgatgacacagtggccgagctgtaccgccacctggccgtgaagaccaaggagctgctgggctag

SEQ ID NO: 40076 - DNA, 738 bp, Artificial Sequence
  Description of Artificial Sequence: Synthetic coding sequence
atgtctgatgagttcagcctggctgatgccctgcctgagcacagccctgccaagaccagcgctgtgagcaacaccaagccaggccagcccccccagggctggccaggcagcaacccctggaacaaccccagcgcccccagctctgtgcccagcggcctgccccccagcgccacccccagcacagtgcccttcggccctgcccccaccggcatgtaccccagcgtgccccccaccggccccccacctggccccccagcccccttccccccatctggccccagctgccccccacctgggggcccctacccagcccccaccgtgcccggccctggccccaccggcccctaccccacccccaacatgcccttccctgagctgccccggccctacggggcccccacagatcctgctgctgctggccccctgggcccctggggctccatgagcagcggcccctgggcccctggcatgggcggccagtaccccacccccaacatgccctaccccagccctggcccctacccagcccctcctccaccccaggcccctggagctgcccctcctgtgccctggggcaccgtgcccccaggggcctggggccccccagccccctacccagcccccaccggcagctaccccaccccaggcctgtaccccacccccagcaaccccttccaggtgcccagcggccccagcggggccccacccatgcctgggggcccccacagctaccactag

SEQ ID NO: 40077 - DNA, 690 bp, Artificial Sequence
  Description of Artificial Sequence: Synthetic coding sequence
atgagcagccacctggtggagcccccaccacccctgcacaacaacaacaacaactgtgaagaaaatgagcagagcctgcccccacctgctggcctgaacagctcctgggtggagctgcccatgaacagcagcaatggaaatgacaatggaaatggcaagaatggaggcctggagcacgtgcccagcagcagcagcatccacaacggggacatggagaagatcctgctggatgcccagcacgagagcggccagagcagcagccggggcagcagccactgtgacagccccagcccccaggaggatggccagatcatgtttgatgtggagatgcacaccagccgggaccacagcagccagagcgaggaggaggtggtggagggggagaaggaggtggaggccctgaagaagtctgctgactgggtgtctgactggagcagcaggcctgagaacatcccccccaaggagttccacttccgccaccccaagaggtctgtgtccctgtccatgaggaagagcggggccatgaagaagggcggcatcttctctgctgagttcctgaaggtgttcatccccagcctcttcctgagccacgtgctggccctgggcctgggcatctacatcggcaagaggctgagcaccccctgccagcacctgctgcgggagaggaagagcccctggaagtgtgtgtag

SEQ ID NO: 40078 - DNA, 4044 bp, Artificial Sequence
  Description of Artificial Sequence: Synthetic coding sequence
atgcctgctgtgcgggtgtgggatgtggccgagcacagccaggtggccgagctgcaggagcacaagtatggagtggcctgtgtggccttcagccccagcgccaagtacatcgtgtctgtgggctaccagcacgacatgattgtgaatgtgtgggcctggaagaagaacatcgtggtggccagcaacaaggtgagcagccgggtgacagctgtgtccttcagcgaggactgcagctactttgtgacagctggcaacagacacatcaagttctggtacctggatgacagcaagaccagcaaggtgaatgccaccgtgcccctgctgggccgcagcggcctgctgggggagctgaggaacaacctcttcacagatgtggcctgtggccggggcaagaaggctgacagcaccttctgcatcaccagcagcggcctgctgtgtgagttcagtgaccggcggctgctggacaagtgggtggagctgcggaccaccgtggcccactgcatctctgtgtcccaggactacatcttctgtggctgtgctgatggcaccgtgcggctcttcaaccccagcaacctgcacttcctgagcaccctgccccggccccacgccctgggcacagacatcgcctctgtgacagaggccagccgcctcttctctggagtggccaatgcccgctacccagacaccatcgccctgacctttgaccccaccaaccagtggctgagctgtgtgtacaatgaccacagcatctacgtgtgggatgtgcgggaccccaagaaggtgggcaaggtgtacagcgccctgtaccacagcagctgtgtgtggagcgtggaggacctgatcaagatcatctacgtggatggcaacacccaggccctgctggacacagagctgcctggaggagacaaggcagatgccagcctgctggacccccgggtgggcatccgctctgtgtgtgtgagccccaacggccagcacctggccagcggggacaggatgggcaccctgcgggtgcatgagctgcagagcctgtctgagatgctgaaggtggaggcccatgattctgagatcctgtgcctggagtacagcaagccagacaccggcctgaagctgctggccagcgccagccgggacaggctcatccacgtgctggatgctggccgggagtacagcctgcagcagaccctggatgagcacagcagcagcatcacagctgtgaagtttgctgccagtgatggccaggtgaggatgatcagctgtggggctgacaagagcatctacttcagaacagcccagaagtctggagatggagtgcagttcaccaggacccaccacgtggtgaggaagaccaccctgtatgacatggatgtggagcccagctggaagtacacagccatcggctgccaggacaggaacatccgcatcttcaacatcagcagcggcaagcagaagaagctgttcaagggcagccagggagaagatggcaccctcatcaaggtgcagacagaccccagcggcatctacatcgccaccagctgcagcgacaagaacctgagcatctttgacttcagcagtggagaatgtgtggccaccatgtttggccacagcgagatcgtgacaggcatgaagttcagcaatgactgcaagcacctgatctctgtgtctggggacagctgcatctttgtgtggaggctgagcagcgagatgaccatctccatgaggcagaggctggccgagctgcggcagaggcagaggggcggcaagcagcagggccccagcagcccccagagggccagcggccccaacagacaccaggcccccagcatgctgagccctggccctgccctgagcagtgacagcgacaaggagggagaagatgagggcacagaggaggagctgcctgccctgcctgtgctggccaagagcaccaagaaggccctggcctctgtgcccagccctgccctgcccaggagcctgagccactgggagatgagccgggcccaggagagcgtgggcttcctggaccctgccccagctgccaaccctggcccccggcggcggggccgctgggtgcagcccggggtggagctgtctgtgcgctccatgctggacctgcggcagctggagaccctggcccccagcctgcaggaccccagccaggacagcctggccatcatccccagcggccccaggaagcacggccaggaggccctggagaccagcctgaccagccagaatgagaagccaccccggccccaggccagccagccctgcagctacccccacatcatccggctgctgagccaggaggagggcgtgtttgcccaggacctggagcccgcccccattgaagatggcatcgtgtacccagagcccagcgacaaccccaccatggacaccagcgagttccaggtgcaggccccagcccggggcaccctgggccgggtgtacccaggcagccgcagcagcgagaagcacagcccagacagcgcctgcagcgtggactacagcagcagctgcctgagcagccctgagcaccccacagaagattctgagagcacagagcccctgtctgtggatggcatcagcagtgacctggaggagccagcagaaggagatgaggaggaggaggaggaggagggcggcatgggcccctacggcctgcaggagggcagcccccagaccccagaccaggagcagttcctgaagcagcactttgagaccctggccagcggggccgcccctggggcccctgtgcaggtgcctgagaggtctgagagccgcagcatcagcagccgcttcctgctgcaggtgcagacccggcccctgcgggagcccagccccagcagcagcagcctggccctgatgagcaggcctgcccaggtgccccaggccagcggggagcagcccagaggaaatggagccaaccccccaggggcccctcctgaggtggagcccagcagcggcaaccccagcccccagcaggccgcctctgtgctgctgccccgctgccgcctgaacccagacagctcctgggcccccaagagggtggccacagccagccccttcagcggcctgcagaaggcccagagcgtgcacagcctggtgccccaggagagacatgaggccagcctgcaggcccccagccctggggccctgctgagccgggagattgaggcccaggacggcctgggcagcctgcccccagcagatggccggcccagccggccccacagctaccagaaccccaccaccagctccatggccaagatcagccgcagcatctctgtgggggagaacctgggcctggtggccgagccccaggcccacgcccccatccgggtgagccccctgagcaagctggccctgcccagccgggcccacctggtgctggacatccccaagcccctgcctgaccggcccaccctggccgccttcagccctgtgaccaagggccgggcccctggagaggccgagaagccaggcttccctgtgggcctgggcaaggcccacagcaccacagagcgctgggcctgcctgggggagggcaccacccccaagcccaggacagagtgccaggcccaccctggccccagcagcccctgtgcccagcagctgcctgtgagcagcctcttccagggccctgagaacctgcagcccccacctcctgagaagacccccaaccccatggagtgcaccaagccaggagctgccctgagccaggacagcgagcctgctgtgtccctggagcagtgtgagcagctggtggccgagctgcggggctctgtgcggcaggccgtgcggctgtaccacagcgtggccggctgcaagatgcccagcgctgagcagagccgcatcgcccagctgctgcgggacaccttcagctctgtgcggcaggagctggaggccgtggccggggctgtgctgagcagccctggcagcagccctggagctgtgggcgctgagcagacccaggccctgctggagcagtacagcgagctgctgctgcgggctgtggagaggaggatggagaggaagctgtag

SEQ ID NO: 40079 - DNA, 4545 bp, Artificial Sequence
  Description of Artificial Sequence: Synthetic coding sequence
atggctgtggagggcagcaccatcaccagccgcatcaagaacctgctgcggagccccagcatcaagctgcggcgcagcaaggccggcaacagaagagaggacctgagcagcaaggtgaccctggagaaggtgctgggcatcaccgtgtctgggggccggggcctggcctgtgaccccaggagcggcctggtggcctacccagctggctgtgtggtggtgctcttcaaccccaggaagcacaagcagcaccacatcctgaacagcagcaggaagaccatcacagccctggccttctccccagatggcaagtacctggtgactggagagagcggccacatgcctgctgtgcgggtgtgggatgtggccgagcacagccaggtggccgagctgcaggagcacaagtatggagtggcctgtgtggccttcagccccagcgccaagtacatcgtgtctgtgggctaccagcacgacatgattgtgaatgtgtgggcctggaagaagaacatcgtggtggccagcaacaaggtgagcagccgggtgacagctgtgtccttcagcgaggactgcagctactttgtgacagctggcaacagacacatcaagttctggtacctggatgacagcaagaccagcaaggtgaatgccaccgtgcccctgctgggccgcagcggcctgctgggggagctgaggaacaacctcttcacagatgtggcctgtggccggggcaagaaggctgacagcaccttctgcatcaccagcagcggcctgctgtgtgagttcagtgaccggcggctgctggacaagtgggtggagctgagaaatattgacagcttcaccaccaccgtggcccactgcatctctgtgtcccaggactacatcttctgtggctgtgctgatggcaccgtgcggctcttcaaccccagcaacctgcacttcctgagcaccctgccccggccccacgccctgggcacagacatcgcctctgtgacagaggccagccgcctcttctctggagtggccaatgcccgctacccagacaccatcgccctgacctttgaccccaccaaccagtggctgagctgtgtgtacaatgaccacagcatctacgtgtgggatgtgcgggaccccaagaaggtgggcaaggtgtacagcgccctgtaccacagcagctgtgtgtggagcgtggaggtgtacccagaggtgaaggacagcaaccaggcctgcctgccccccagcagcttcatcacctgcagcagtgacaacaccatccggctgtggaacacagagagcagtggagtgcacggcagcaccctgcacaggaacatcctgagcagtgacctgatcaagatcatctacgtggatggcaacacccaggccctgctggacacagagctgcccggcggggacaaggcagatgccagcctgctggacccccgggtgggcatccgctctgtgtgtgtgagccccaacggccagcacctggccagcggggacaggatgggcaccctgcgggtgcatgagctgcagagcctgtctgagatgctgaaggtggaggcccatgacagcgagatcctgtgcctggagtacagcaagccagacaccggcctgaagctgctggccagcgccagccgggacaggctcatccacgtgctggatgctggccgggagtacagcctgcagcagaccctggatgagcacagcagcagcatcacagctgtgaagtttgctgccagtgatggccaggtgaggatgatcagctgtggggctgacaagagcatctacttcagaacagcccagaagtctggagatggagtgcagttcaccaggacccaccacgtggtgaggaagaccaccctgtatgacatggatgtggagcccagctggaagtacacagccatcggctgccaggacaggaacatccgcatcttcaacatcagcagcggcaagcagaagaagctgttcaagggcagccagggagaagatggcaccctcatcaaggtgcagacagaccccagcggcatctacatcgccaccagctgcagcgacaagaacctgagcatctttgacttcagcagcggggagtgtgtggccaccatgtttggccacagcgagatcgtgacaggcatgaagttcagcaatgactgcaagcacctgatctctgtgtctggggacagctgcatctttgtgtggaggctgagcagcgagatgaccatctccatgaggcagaggctggccgagctgcggcagaggcagagaggaggcaagcagcagggccccagcagcccccagagggccagcggccccaacagacaccaggcccccagcatgctgagccctggccctgccctgagcagtgacagcgacaaggagggggaggatgagggcacagaggaggagctgcctgccctgcctgtgctggccaagagcaccaagaaggccctggcctctgtgcccagccctgccctgcccaggagcctgagccactgggagatgagccgggcccaggagagcgtgggcttcctggaccctgccccagctgccaaccctggccccaggagaagaggccgctgggtgcagcccggggtggagctgtctgtgcgctccatgctggacctgcggcagctggagaccctggcccccagcctgcaggaccccagccaggacagcctggccatcatccccagcggccccaggaagcacggccaggaggccctggagaccagcctgaccagccagaatgagaagccaccccggccccaggccagccagccctgcagctacccccacatcatccggctgctgagccaggaggagggcgtgtttgcccaggacctggagcccgcccccattgaagatggcatcgtgtacccagagcccagcgacaaccccaccatggacaccagcgagttccaggtgcaggccccagcccggggcaccctgggccgggtgtacccaggcagccgcagcagcgagaagcacagcccagattctgcctgcagcgtggactacagcagcagctgcctgagcagccctgagcaccccacagaggacagcgagagcacagagcccctgtctgtggatggcatcagcagtgacctggaggagccagcagaaggagatgaggaggaggaggaggaggagggcggcatgggcccctacggcctgcaggagggcagcccccagaccccagaccaggagcagttcctgaagcagcactttgagaccctggccagcggggccgcccctggggcccctgtgcaggtgcctgagaggtctgagagccgcagcatcagcagccgcttcctgctgcaggtgcagacccggcccctgcgggagcccagccccagcagcagcagcctggccctgatgagcaggcctgcccaggtgccccaggccagcggggagcagcccagaggaaatggagccaaccccccaggggcccctcctgaggtggagcccagcagcggcaaccccagcccccagcaggccgcctctgtgctgctgccccgctgccgcctgaacccagacagctcctgggcccccaagagggtggccacagccagccccttcagcggcctgcagaaggcccagagcgtgcacagcctggtgccccaggagagacatgaggccagcctgcaggcccccagccctggggccctgctgagccgggagattgaggcccaggacggcctgggcagcctgcccccagcagatggccggcccagccggccccacagctaccagaaccccaccaccagctccatggccaagatcagccgcagcatctctgtgggggagaacctgggcctggtggccgagccccaggcccacgcccccatccgggtgagccccctgagcaagctggccctgcccagccgggcccacctggtgctggacatccccaagcccctgcctgaccggcccaccctggccgccttcagccctgtgaccaagggccgggcccctggagaggccgagaagccaggcttccctgtgggcctgggcaaggcccacagcaccacagagcgctgggcctgcctgggggagggcaccacccccaagcccaggacagagtgccaggcccaccctggccccagcagcccctgtgcccagcagctgcctgtgagcagcctcttccagggccctgagaacctgcagcccccacctcctgagaagacccccaaccccatggagtgcaccaagccaggggccgccctgagccaggacagcgagcctgctgtgtccctggagcagtgtgagcagctggtggccgagctgcggggctctgtgcggcaggccgtgcggctgtaccacagcgtggccggctgcaagatgcccagcgctgagcagagcagaattgcccagctgctgcgggacaccttcagctctgtgcggcaggagctggaggccgtggccggggctgtgctgagcagccctggcagcagccctggagctgtgggcgctgagcagacccaggccctgctggagcagtacagcgagctgctgctgcgggctgtggagaggaggatggagaggaagctgtag

SEQ ID NO: 40080 - DNA, 4527 bp, Artificial Sequence
  Description of Artificial Sequence: Synthetic coding sequence
atggctgtggagggcagcaccatcaccagccgcatcaagaacctgctgcggagccccagcatcaagctgcggcgcagcaaggccggcaacagaagagaggacctgagcagcaaggtgaccctggagaaggtgctgggcatcaccgtgtctgggggccggggcctggcctgtgaccccaggagcggcctggtggcctacccagctggctgtgtggtggtgctcttcaaccccaggaagcacaagcagcaccacatcctgaacagcagcaggaagaccatcacagccctggccttctccccagatggcaagtacctggtgactggagagagcggccacatgcctgctgtgcgggtgtgggatgtggccgagcacagccaggtggccgagctgcaggagcacaagtatggagtggcctgtgtggccttcagccccagcgccaagtacatcgtgtctgtgggctaccagcacgacatgattgtgaatgtgtgggcctggaagaagaacatcgtggtggccagcaacaaggtgagcagccgggtgacagctgtgtccttcagcgaggactgcagctactttgtgacagctggcaacagacacatcaagttctggtacctggatgacagcaagaccagcaaggtgaatgccaccgtgcccctgctgggccgcagcggcctgctgggggagctgaggaacaacctcttcacagatgtggcctgtggccggggcaagaaggctgacagcaccttctgcatcaccagcagcggcctgctgtgtgagttcagtgaccggcggctgctggacaagtgggtggagctgcggaccaccgtggcccactgcatctctgtgtcccaggactacatcttctgtggctgtgctgatggcaccgtgcggctcttcaaccccagcaacctgcacttcctgagcaccctgccccggccccacgccctgggcacagacatcgcctctgtgacagaggccagccgcctcttctctggagtggccaatgcccgctacccagacaccatcgccctgacctttgaccccaccaaccagtggctgagctgtgtgtacaatgaccacagcatctacgtgtgggatgtgcgggaccccaagaaggtgggcaaggtgtacagcgccctgtaccacagcagctgtgtgtggagcgtggaggtgtacccagaggtgaaggacagcaaccaggcctgcctgccccccagcagcttcatcacctgcagcagtgacaacaccatccggctgtggaacacagagagcagtggagtgcacggcagcaccctgcacaggaacatcctgagcagtgacctgatcaagatcatctacgtggatggcaacacccaggccctgctggacacagagctgcccggcggggacaaggcagatgccagcctgctggacccccgggtgggcatccgctctgtgtgtgtgagccccaacggccagcacctggccagcggggacaggatgggcaccctgcgggtgcatgagctgcagagcctgtctgagatgctgaaggtggaggcccatgacagcgagatcctgtgcctggagtacagcaagccagacaccggcctgaagctgctggccagcgccagccgggacaggctcatccacgtgctggatgctggccgggagtacagcctgcagcagaccctggatgagcacagcagcagcatcacagctgtgaagtttgctgccagtgatggccaggtgaggatgatcagctgtggggctgacaagagcatctacttcagaacagcccagaagtctggagatggagtgcagttcaccaggacccaccacgtggtgaggaagaccaccctgtatgacatggatgtggagcccagctggaagtacacagccatcggctgccaggacaggaacatccgcatcttcaacatcagcagcggcaagcagaagaagctgttcaagggcagccagggagaagatggcaccctcatcaaggtgcagacagaccccagcggcatctacatcgccaccagctgcagcgacaagaacctgagcatctttgacttcagcagcggggagtgtgtggccaccatgtttggccacagcgagatcgtgacaggcatgaagttcagcaatgactgcaagcacctgatctctgtgtctggggacagctgcatctttgtgtggaggctgagcagcgagatgaccatctccatgaggcagaggctggccgagctgcggcagaggcagagaggaggcaagcagcagggccccagcagcccccagagggccagcggccccaacagacaccaggcccccagcatgctgagccctggccctgccctgagcagtgacagcgacaaggagggggaggatgagggcacagaggaggagctgcctgccctgcctgtgctggccaagagcaccaagaaggccctggcctctgtgcccagccctgccctgcccaggagcctgagccactgggagatgagccgggcccaggagagcgtgggcttcctggaccctgccccagctgccaaccctggccccaggagaagaggccgctgggtgcagcccggggtggagctgtctgtgcgctccatgctggacctgcggcagctggagaccctggcccccagcctgcaggaccccagccaggacagcctggccatcatccccagcggccccaggaagcacggccaggaggccctggagaccagcctgaccagccagaatgagaagccaccccggccccaggccagccagccctgcagctacccccacatcatccggctgctgagccaggaggagggcgtgtttgcccaggacctggagcccgcccccattgaagatggcatcgtgtacccagagcccagcgacaaccccaccatggacaccagcgagttccaggtgcaggccccagcccggggcaccctgggccgggtgtacccaggcagccgcagcagcgagaagcacagcccagattctgcctgcagcgtggactacagcagcagctgcctgagcagccctgagcaccccacagaggacagcgagagcacagagcccctgtctgtggatggcatcagcagtgacctggaggagccagcagaaggagatgaggaggaggaggaggaggagggcggcatgggcccctacggcctgcaggagggcagcccccagaccccagaccaggagcagttcctgaagcagcactttgagaccctggccagcggggccgcccctggggcccctgtgcaggtgcctgagaggtctgagagccgcagcatcagcagccgcttcctgctgcaggtgcagacccggcccctgcgggagcccagccccagcagcagcagcctggccctgatgagcaggcctgcccaggtgccccaggccagcggggagcagcccagaggaaatggagccaaccccccaggggcccctcctgaggtggagcccagcagcggcaaccccagcccccagcaggccgcctctgtgctgctgccccgctgccgcctgaacccagacagctcctgggcccccaagagggtggccacagccagccccttcagcggcctgcagaaggcccagagcgtgcacagcctggtgccccaggagagacatgaggccagcctgcaggcccccagccctggggccctgctgagccgggagattgaggcccaggacggcctgggcagcctgcccccagcagatggccggcccagccggccccacagctaccagaaccccaccaccagctccatggccaagatcagccgcagcatctctgtgggggagaacctgggcctggtggccgagccccaggcccacgcccccatccgggtgagccccctgagcaagctggccctgcccagccgggcccacctggtgctggacatccccaagcccctgcctgaccggcccaccctggccgccttcagccctgtgaccaagggccgggcccctggagaggccgagaagccaggcttccctgtgggcctgggcaaggcccacagcaccacagagcgctgggcctgcctgggggagggcaccacccccaagcccaggacagagtgccaggcccaccctggccccagcagcccctgtgcccagcagctgcctgtgagcagcctcttccagggccctgagaacctgcagcccccacctcctgagaagacccccaaccccatggagtgcaccaagccaggggccgccctgagccaggacagcgagcctgctgtgtccctggagcagtgtgagcagctggtggccgagctgcggggctctgtgcggcaggccgtgcggctgtaccacagcgtggccggctgcaagatgcccagcgctgagcagagcagaattgcccagctgctgcgggacaccttcagctctgtgcggcaggagctggaggccgtggccggggctgtgctgagcagccctggcagcagccctggagctgtgggcgctgagcagacccaggccctgctggagcagtacagcgagctgctgctgcgggctgtggagaggaggatggagaggaagctgtag

SEQ ID NO: 40081 - DNA, 471 bp, Artificial Sequence
  Description of Artificial Sequence: Synthetic coding sequence
atggctgtggagggcagcaccatcaccagccgcatcaagaacctgctgcggagccccagcatcaagctgcggcgcagcaaggccggcaacagaagagaggacctgagcagcaaggtgaccctggagaaggtgctgggcatcaccgtgtctgggggccggggcctggcctgtgaccccaggagcggcctggtggcctacccagctggctgtgtggtggtgctcttcaaccccaggaagcacaagcagcaccacatcctgaacagcagcaggaagaccatcacagccctggccttctccccagatggcaagtacctggtgactggagagagcggccacatgcctgctgtgcgggtgtgggatgtggccgagcacagccaggtggccgagctgcaggagcacaagtatggagtggcctgtgtggccttcagccccagcgccaagtacatcgtgtctgtgggctaccagcactag

SEQ ID NO: 40082 - DNA, 3696 bp, Artificial Sequence
  Description of Artificial Sequence: Synthetic coding sequence
atggctgtggagggcagcaccatcaccagccgcatcaagaacctgctgcggagccccagcatcaagctgcggcgcagcaaggccggcaacagaagagaggacctgagcagcaaggtgaccctggagaaggtgctgggcatcaccgtgtctgggggccggggcctggcctgtgaccccaggagcggcctggtggcctacccagctggctgtgtggtggtgctcttcaaccccaggaagcacaagcagcaccacatcctgaacagcagcaggaagaccatcacagccctggccttctccccagatggcaagtacctggtgactggagagagcggccacatgcctgctgtgcgggtgtgggatgtggccgagcacagccaggtggccgagctgcaggagcacaagtatggagtggcctgtgtggccttcagccccagcgccaagtacatcgtgtctgtgggctaccagcacgacatgattgtgaatgtgtgggcctggaagaagaacatcgtggtggccagcaacaaggtgagcagccgggtgacagctgtgtccttcagcgaggactgcagctactttgtgacagctggcaacagacacatcaagttctggtacctggatgacagcaagaccagcaaggtgaatgccaccgtgcccctgctgggccgcagcggcctgctgggggagctgaggaacaacctcttcacagatgtggcctgtggccggggcaagaaggctgacagcaccttctgcatcaccagcagcggcctgctgtgtgagttcagtgaccggcggctgctggacaagtgggtggagctgcggaccaccgtggcccactgcatctctgtgtcccaggactacatcttctgtggctgtgctgatggcaccgtgcggctcttcaaccccagcaacctgcacttcctgagcaccctgccccggccccacgccctgggcacagacatcgcctctgtgacagaggccagccgcctcttctctggagtggccaatgcccgctacccagacaccatcgccctgacctttgaccccaccaaccagtggctgagctgtgtgtacaatgaccacagcatctacgtgtgggatgtgcgggaccccaagaaggtgggcaaggtgtacagcgccctgtaccacagcagctgtgtgtggagcgtggaggtgtacccagaggtgaaggacagcaaccaggcctgcctgccccccagcagcttcatcacctgcagcagtgacaacaccatccggctgtggaacacagagagcagtggagtgcacggcagcaccctgcacaggaacatcctgagcagtgacctgatcaagatcatctacgtggatggcaacacccaggccctgctggacacagagctgcccggcggggacaaggcagatgccagcctgctggacccccgggtgggcatccgctctgtgtgtgtgagccccaacggccagcacctggccagcggggacaggatgggcaccctgcgggtgcatgagctgcagagcctgtctgagatgctgaaggtggaggcccatgacagcgagatcctgtgcctggagtacagcaagccagacaccggcctgaagctgctggccagcgccagccgggacaggctcatccacgtgctggatgctggccgggagtacagcctgcagcagaccctggatgagcacagcagcagcatcacagctgtgaagtttgctgccagtgatggccaggtgaggatgatcagctgtggggctgacaagagcatctacttcagaacagcccagaagtctggagatggagtgcagttcaccaggacccaccacgtggtgaggaagaccaccctgtatgacatggatgtggagcccagctggaagtacacagccatcggctgccaggacaggaacatccgcatcttcaacatcagcagcggcaagcagaagaagctgttcaagggcagccagggagaagatggcaccctcatcaaggtgcagacagaccccagcggcatctacatcgccaccagctgcagcgacaagaacctgagcatctttgacttcagcagcggggagtgtgtggccaccatgtttggccacagcgagatcgtgacaggcatgaagttcagcaatgactgcaagcacctgatctctgtgtctggggacagctgcatctttgtgtggaggctgagcagcgagatgaccatctccatgaggcagaggctggccgagctgcggcagaggcagagaggaggcaagcagcagggccccagcagcccccagagggccagcggccccaacagacaccaggcccccagcatgctgagccctggccctgccctgagcagtgacagcgacaaggagggggaggatgagggcacagaggaggagctgcctgccctgcctgtgctggccaagagcaccaagaaggccctggcctctgtgcccagccctgccctgcccaggagcctgagccactgggagatgagccgggcccaggagagcgtgggcttcctggaccctgccccagctgccaaccctggccccaggagaagaggccgctgggtgcagcccggggtggagctgtctgtgcgctccatgctggacctgcggcagctggagaccctggcccccagcctgcaggaccccagccaggacagcctggccatcatccccagcggccccaggaagcacggccaggaggccctggagaccagcctgaccagccagaatgagaagccaccccggccccaggccagccagccctgcagctacccccacatcatccggctgctgagccaggaggagggcgtgtttgcccaggacctggagcccgcccccattgaagatggcatcgtgtacccagagcccagcgacaaccccaccatggacaccagcgagttccaggtgcaggccccagcccggggcaccctgggccgggtgtacccaggcagccgcagcagcgagaagcacagcccagattctgcctgcagcgtggactacagcagcagctgcctgagcagccctgagcaccccacagaggacagcgagagcacagagcccctgtctgtggatggcatcagcagtgacctggaggagccagcagaaggagatgaggaggaggaggaggaggagggcggcatgggcccctacggcctgcaggagggcagcccccagaccccagaccaggagcagttcctgaagcagcactttgagaccctggccagcggggccgcccctggggcccctgtgcaggtgcctgagaggtctgagagccgcagcatcagcagccgcttcctgctgcaggtgcagacccggcccctgcgggagcccagccccagcagcagcagcctggccctgatgagcaggcctgcccaggtgccccaggccagcgagcctgctgtgtccctggagcagtgtgagcagctggtggccgagctgcggggctctgtgcggcaggccgtgcggctgtaccacagcgtggccggctgcaagatgcccagcgctgagcagagccgcatcgcccagctgctgcgggacaccttcagctctgtgcggcaggagctggaggccgtggccggggctgtgctgagcagccctggcagcagccctggagctgtgggcgctgagcagacccaggccctgctggagcagtacagcgagctgctgctgcgggctgtggagaggaggatggagaggaagctgtag

SEQ ID NO: 40083 - DNA, 2685 bp, Artificial Sequence
  Description of Artificial Sequence: Synthetic coding sequence
atgaaccctggctttgacctgagcagaagaaacccccaggaggactttgagctgatccagagaattggcagcggcacctatggagatgtgtacaaggccagaaatgtgaacacaggagagctggccgccatcaaggtgatcaagctggagcctggagaagattttgctgtggtgcagcaggagatcatcatgatgaaggactgcaagcaccccaacatcgtggcctacttcggcagctacctgcggcgggacaagctgtggatctgcatggagttctgtggcggcggcagcctgcaggacatctaccacgtgacaggccccctgtctgagctgcagatcgcctacgtgtcccgggagaccctgcagggcctgtactacctgcacagcaagggcaagatgcaccgggacatcaagggggccaacatcctgctgacagacaatggacatgtgaagctggccgactttggagtgtctgcccagatcacagccaccatcgccaagaggaagagcttcatcggcaccccctactggatggcccctgaggtggccgctgtggagaggaagggcggctacaaccagctgtgtgacctgtgggccgtgggcatcacagccatcgagctggccgagctgcagccccccatgtttgacctgcaccccatgagggccctcttcctgatgaccaagagcaacttccagccccccaagctgaaggacaagatgaagtggagcaacagcttccaccactttgtgaagatggccctgaccaagaaccccaagaagaggcccacagctgagaagctgctgcagcacccctttgtgacccagcacctgaccaggagcctggccatcgagctgctggacaaggtgaacaacccagaccacagcacctaccatgactttgatgatgatgatcctgagcccctggtggccgtgccccaccgcatccacagcaccagcagaaatgtgcgggaggagaagaccaggtctgagatcaccttcggccaggtgaagtttgacccccccctgaggaaggagacagagccccaccacgagctgcctgacagtgatggcttcctggacagcagcgaggagatctactacacagcccggagcaacctggacctgcagctggagtatggccagggccaccagggcggctacttcctgggcgccaacaagagcctgctgaagtctgtggaggaggagctgcaccagaggggccacgtggcccacctggaggatgatgaaggagatgatgatgagagcaagcacagcaccctgaaggccaagatccccccacccctgccccccaagcccaagagcatcttcatcccccaggagatgcacagcacagaagatgagaaccagggcaccatcaagcgctgccccatgagcggcagccctgccaagcccagccaggtgcccccccggcccccaccaccccggctgcccccccacaagcctgtggccctgggcaatggcatgagcagcttccagctgaatggagagagagatggcagcctgtgccagcagcagaatgagcaccggggcaccaacctgagcaggaaggagaagaaggatgtgcccaagcccatcagcaatggcctgccccccacccccaaggtgcacatgggcgcctgcttcagcaaggtgttcaacggctgccccctgaagatccactgtgccagctcctggatcaacccagacacccgggaccagtacctgatctttggagctgaggagggcatctacaccctgaacctgaatgagctgcacgagacctccatggagcagctgttcccccggcgctgcacctggctgtatgtgatgaacaactgcctgctgagcatcagcggcaaggccagccagctgtacagccacaacctgcccggcctgtttgattatgcccggcagatgcagaagctgcctgtggccatcccagcccacaagctgcctgaccgcatcctgcccaggaagttctctgtgtctgccaagatccctgagaccaagtggtgccagaagtgctgcgtggtgaggaacccctacacaggccacaagtacctgtgtggggccctgcagaccagcatcgtgctgctggagtgggtggagcccatgcagaagttcatgctgatcaagcacatcgacttccccatcccctgccccctgaggatgtttgagatgctggtggtgcctgagcaggagtaccccctggtgtgtgtgggcgtgtcccggggccgggacttcaaccaggtggtgcgctttgagaccgtgaaccccaacagcaccagctcctggttcacagaaagtgacaccccccagaccaacgtgacccacgtgacccagctggagcgggacaccatcctggtgtgcctggactgctgcatcaagatcgtgaacctgcagggccgcctgaagagcagcaggaagctgagcagcgagctgacctttgacttccagatcgagagcatcgtgtgcctgcaggacagcgtgctggccttctggaagcacggcatgcagggccgctccttccgcagcaatgaggtgacccaggagatcagtgacagcacccgcatcttccggctgctgggcagtgacagagtggtggtgctggagagccggcccacagacaaccccacagccaacagcaacctgtacatcctggccggccatgaaaattcctactag

SEQ ID NO: 40084 - DNA, 2622 bp, Artificial Sequence
  Description of Artificial Sequence: Synthetic coding sequence
atgaaccctggctttgacctgagcagaagaaacccccaggaggactttgagctgatccagagaattggcagcggcacctatggagatgtgtacaaggccagaaatgtgaacacaggagagctggccgccatcaaggtgatcaagctggagcctggagaagattttgctgtggtgcagcaggagatcatcatgatgaaggactgcaagcaccccaacatcgtggcctacttcggcagctacctgcggcgggacaagctgtggatctgcatggagttctgtggcggcggcagcctgcaggacatctaccacgtgacaggccccctgtctgagctgcagatcgcctacgtgtcccgggagaccctgcagggcctgtactacctgcacagcaagggcaagatgcaccgggacatcaagggggccaacatcctgctgacagacaatggacatgtgaagctggccgactttggagtgtctgcccagatcacagccaccatcgccaagaggaagagcttcatcggcaccccctactggatggcccctgaggtggccgctgtggagaggaagggcggctacaaccagctgtgtgacctgtgggccgtgggcatcacagccatcgagctggccgagctgcagccccccatgtttgacctgcaccccatgagggccctcttcctgatgaccaagagcaacttccagccccccaagctgaaggacaagatgaagtggagcaacagcttccaccactttgtgaagatggccctgaccaagaaccccaagaagaggcccacagctgagaagctgctgcagcacccctttgtgacccagcacctgaccaggagcctggccatcgagctgctggacaaggtgaacaacccagaccacagcacctaccatgactttgatgatgatgatcctgagcccctggtggccgtgccccaccgcatccacagcaccagcagaaatgtgcgggaggagaagaccaggtctgagatcaccttcggccaggtgaagtttgacccccccctgaggaaggagacagagccccaccacgagctggacctgcagctggagtatggccagggccaccagggcggctacttcctgggcgccaacaagagcctgctgaagtctgtggaggaggagctgcaccagaggggccacgtggcccacctggaggatgatgaaggagatgatgatgagagcaagcacagcaccctgaaggccaagatccccccacccctgccccccaagcccaagagcatcttcatcccccaggagatgcacagcacagaagatgagaaccagggcaccatcaagcgctgccccatgagcggcagccctgccaagcccagccaggtgccccccaggcctcctccaccccggctgcccccccacaagcctgtggccctgggcaatggcatgagcagcttccagctgaatggagagagagatggcagcctgtgccagcagcagaatgagcaccggggcaccaacctgagcaggaaggagaagaaggatgtgcccaagcccatcagcaatggcctgccccccacccccaaggtgcacatgggcgcctgcttcagcaaggtgttcaacggctgccccctgaagatccactgtgccagctcctggatcaacccagacacccgggaccagtacctgatctttggagctgaggagggcatctacaccctgaacctgaatgagctgcacgagacctccatggagcagctgttcccccggcgctgcacctggctgtatgtgatgaacaactgcctgctgagcatcagcggcaaggccagccagctgtacagccacaacctgcccggcctgtttgattatgcccggcagatgcagaagctgcctgtggccatcccagcccacaagctgcctgaccgcatcctgcccaggaagttctctgtgtctgccaagatccctgagaccaagtggtgccagaagtgctgcgtggtgaggaacccctacacaggccacaagtacctgtgtggggccctgcagaccagcatcgtgctgctggagtgggtggagcccatgcagaagttcatgctgatcaagcacatcgacttccccatcccctgccccctgaggatgtttgagatgctggtggtgcctgagcaggagtaccccctggtgtgtgtgggcgtgtcccggggccgggacttcaaccaggtggtgcgctttgaaacagtgaaccccaacagcaccagctcctggttcacagaaagtgacaccccccagaccaacgtgacccacgtgacccagctggagcgggacaccatcctggtgtgcctggactgctgcatcaagatcgtgaacctgcagggccgcctgaagagcagcaggaagctgagcagcgagctgacctttgacttccagatcgagagcatcgtgtgcctgcaggacagcgtgctggccttctggaagcacggcatgcagggccgctccttccgcagcaatgaggtgacccaggagatcagtgacagcacccgcatcttccggctgctgggcagtgacagagtggtggtgctggagagccggcccacagacaaccccacagccaacagcaacctgtacatcctggccggccacgagaacagctactag

SEQ ID NO: 40085 - DNA, 1344 bp, Artificial Sequence
  Description of Artificial Sequence: Synthetic coding sequence
atgcacagcacagaagatgagaaccagggcaccatcaagcgctgccccatgagcggcagccctgccaagcccagccaggtgccccccaggcctcctccaccccggctgcccccccacaagcctgtggccctgggcaatggcatgagcagcttccagctgaatggagagagagatggcagcctgtgccagcagcagaatgagcaccggggcaccaacctgagcaggaaggagaagaaggatgtgcccaagcccatcagcaatggcctgccccccacccccaaggtgcacatgggcgcctgcttcagcaaggtgttcaacggctgccccctgaagatccactgtgccagctcctggatcaacccagacacccgggaccagtacctgatctttggagctgaggagggcatctacaccctgaacctgaatgagctgcacgagacctccatggagcagctgttcccccggcgctgcacctggctgtatgtgatgaacaactgcctgctgagcatcagcggcaaggccagccagctgtacagccacaacctgcccggcctgtttgattatgcccggcagatgcagaagctgcctgtggccatcccagcccacaagctgcctgaccgcatcctgcccaggaagttctctgtgtctgccaagatccctgagaccaagtggtgccagaagtgctgcgtggtgaggaacccctacacaggccacaagtacctgtgtggggccctgcagaccagcatcgtgctgctggagtgggtggagcccatgcagaagttcatgctgatcaagcacatcgacttccccatcccctgccccctgaggatgtttgagatgctggtggtgcctgagcaggagtaccccctggtgtgtgtgggcgtgtcccggggccgggacttcaaccaggtggtgcgctttgaaacagtgaaccccaacagcaccagctcctggttcacagaaagtgacaccccccagaccaacgtgacccacgtgacccagctggagcgggacaccatcctggtgtgcctggactgctgcatcaagatcgtgaacctgcagggccgcctgaagagcagcaggaagctgagcagcgagctgacctttgacttccagatcgagagcatcgtgtgcctgcaggacagcgtgctggccttctggaagcacggcatgcagggccgctccttccgcagcaatgaggtgacccaggagatcagtgacagcacccgcatcttccggctgctgggcagtgacagagtggtggtgctggagagccggcccacagacaaccccacagccaacagcaacctgtacatcctggccggccacgagaacagctactag

SEQ ID NO: 40086 - DNA, 480 bp, Artificial Sequence
  Description of Artificial Sequence: Synthetic coding sequence
atgcagaagttcatgctgatcaagcacatcgacttccccatcccctgccccctgaggatgtttgagatgctggtggtgcctgagcaggagtaccccctggtgtgtgtgggcgtgtcccggggccgggacttcaaccaggtggtgcgctttgagaccgtgaaccccaacagcaccagctcctggttcacagaaagtgacaccccccagaccaacgtgacccacgtgacccagctggagcgggacaccatcctggtgtgcctggactgctgcatcaagatcgtgaacctgcagggccgcctgaagagcagcaggaagctgagcagcgagctgacctttgacttccagatcgagagcatcgtgtgcctgcaggacagcgtgctggccttctggaagcacggcatgcagggccgctccttccgcagcaatgaggtgacccaggagatcagtgacagcaagaacttccaggccgcctggatctag

SEQ ID NO: 40087 - DNA, 1449 bp, Artificial Sequence
  Description of Artificial Sequence: Synthetic coding sequence
atgttcttcctggtgaccagtgatgagagcaacaagacctggggcaggaacacagtgttccggcaggaggagtttgaagatgtgaagaggaacttcaagaagaagggctgcacctggggccccaacagcatccagatgaaggacagaacagactgcaaggagcgcatccggcccctgagtgatggcaacagcccctggagcaccatcctgatcaagaaccagaagaccatgcccctggccagcctgtttgtggaccagcccggcagctgtgaggagcccaagctgagcccagatggcctggagcacaggaagcccaagcagatcaagctgcccagccaggcctacatcgacctgcccctgggcaaggatgcccagagagaaaatcctgctgaggccgagagctgggaggaggccgccagcgccaatgctgccaccgtgtccattgagatgacccccaccaacagcctgagccgcagcccccagaggaagaagacagaaagtgccctgtatggctgcaccgtgctgctggcctctgtggccctgggcctggacctgcgggagctgcacaaggcccaggccgctgaggagcccctgcccaaggaggagaagaagaagcgggagggcatcttccagagggccagcaagagcagaagaagtgccagcccccccaccagcctgcccagcacctgtggggaggccagcagcccccccagcctgcccctgagcagcgccctgggcatcctgagcacccccagcttcagcaccaagtgcctgctgcagatggattctgaggaccccctggtggacagcgcccctgtgacctgtgacagcgagatgctgaccccagacttctgccccacagcccctggcagcggccgggagcccgccctgatgccccggctggacacagactgcagcgtgtccaggaacctgcccagcagcttcctgcagcagacctgtggaaatgtgccctactgtgccagcagcaagcaccggcccagccaccacaggaggaccatgtctgatggcaaccccacccccaccggggccaccatcatcagcgccaccggggccagcgccctgcccctgtgccccagccctgccccccacagccacctgccccgggaggtgagccccaagaagcacagcacagtgcacatcgtgccccagaggaggcctgccagcctgcggagcagaagtgacctgccccaggcctacccccagacagctgtgtcccagctggcccagacagcctgtgtggtgggccggcccggcccccaccccacccagttcctggccgccaaggagaggaccaagagccacgtgcccagcctgctggatgctgatgtggagggccagagccgggactacacagtgcccctgtgcaggatgaggagcaagaccagccggcccagcatctatgagctggagaaggagttcctgtcctag

SEQ ID NO: 40088 - DNA, 1713 bp, Artificial Sequence
  Description of Artificial Sequence: Synthetic coding sequence
atggccctgcggggagctgctggggccacagacacccctgtgagcagcgctggaggagcccctgggggcagcgccagcagcagcagcaccagcagcggcggcagcgccagcgctggggccggcctgtgggccgccctgtatgactatgaggcccggggggaggatgagctgagcctgcggcggggccagctggtggaggtgctgagccaggatgctgctgtgtctggagatgagggctggtgggccggccaggtgcagaggcggctgggcatcttccctgccaactacgtggccccctgcaggcctgctgccagccctgcccccccacccagccggcccagcagccctgtgcacgtggcctttgagcggctggagctgaaggagctgattggagctgggggcttcggccaggtgtaccgggccacctggcagggccaggaggtggccgtgaaggccgcccggcaggaccctgagcaggatgctgctgctgctgctgagagcgtgagaagagaggcccggctgtttgccatgctgcggcaccccaacatcatcgagctgcggggcgtgtgcctgcagcagccccacctgtgcctggtgctggagtttgcccggggcggggccctgaacagagccctggccgccgccaatgctgccccagacccccgggcccctggcccccggcgggcccggcgcatcccccctcatgtgctggtgaactgggccgtgcagatcgcccggggcatgctgtacctgcacgaggaggcctttgtgcccatcctgcaccgggacctgaagagcagcaacatcctgctgctggagaagattgaacatgatgacatctgcaacaagaccctgaagatcacagactttggcctggcccgggagtggcacaggaccaccaagatgagcacagctggcacctacgcctggatggcccctgaggtgatcaagagcagcctcttcagcaaaggaagtgacatctggagctatggagtgctgctgtgggagctgctgactggagaggtgccctaccggggcattgatggcctggccgtggcctacggcgtggccgtgaacaagctgaccctgcccatccccagcacctgcccagagccctttgccaagctgatgaaggagtgctggcagcaggacccccacatccggcccagctttgccctgatcctggagcagctgacagccattgaaggagctgtgatgacagagatgccccaggagagcttccacagcatgcaggatgactggaagctggagatccagcagatgtttgatgagctgcggaccaaggagaaggagctgcggagccgggaggaggagctgaccagggctgccctgcagcagaagagccaggaggagctgctgaagaggcgggagcagcagctggccgagcgggagattgatgtgctggagcgggagctgaacatcctgatcttccagctgaaccaggagaagcccaaggtgaagaagaggaagggcaagttcaagaggagccggctgaagctgaaggatggccaccgcatcagcctgcccagcgacttccagcacaagatcaccgtgcaggccagccccaacctggacaagaggaggagcctgaacagcagcagcagcagcccccccagcagccccaccatgatgccccggctgcgggccatccagtgtgagctgagcgccctgccccggggcctgctgtgctag

SEQ ID NO: 40089 - DNA, 3111 bp, Artificial Sequence
  Description of Artificial Sequence: Synthetic coding sequence
atggccctgcggggagctgctggggccacagacacccctgtgagcagcgctggaggagcccctgggggcagcgccagcagcagcagcaccagcagcggcggcagcgccagcgctggggccggcctgtgggccgccctgtatgactatgaggcccggggggaggatgagctgagcctgcggcggggccagctggtggaggtgctgagccaggatgctgctgtgtctggagatgagggctggtgggccggccaggtgcagaggcggctgggcatcttccctgccaactacgtggccccctgcaggcctgctgccagccctgcccccccacccagccggcccagcagccctgtgcacgtggcctttgagcggctggagctgaaggagctgattggagctgggggcttcggccaggtgtaccgggccacctggcagggccaggaggtggccgtgaaggccgcccggcaggaccctgagcaggatgctgctgctgctgctgagagcgtgagaagagaggcccggctgtttgccatgctgcggcaccccaacatcatcgagctgcggggcgtgtgcctgcagcagccccacctgtgcctggtgctggagtttgcccggggcggggccctgaacagagccctggccgccgccaatgctgccccagacccccgggcccctggcccccggcgggcccggcgcatcccccctcatgtgctggtgaactgggccgtgcagatcgcccggggcatgctgtacctgcacgaggaggcctttgtgcccatcctgcaccgggacctgaagagcagcaacatcctgctgctggagaagattgaacatgatgacatctgcaacaagaccctgaagatcacagactttggcctggcccgggagtggcacaggaccaccaagatgagcacagctggcacctacgcctggatggcccctgaggtgatcaagagcagcctcttcagcaaaggaagtgacatctggagctatggagtgctgctgtgggagctgctgactggagaggtgccctaccggggcattgatggcctggccgtggcctacggcgtggccgtgaacaagctgaccctgcccatccccagcacctgcccagagccctttgccaagctgatgaaggagtgctggcagcaggacccccacatccggcccagctttgccctgatcctggagcagctgacagccattgaaggagctgtgatgacagagatgccccaggagagcttccacagcatgcaggatgactggaagctggagatccagcagatgtttgatgagctgcggaccaaggagaaggagctgcggagccgggaggaggagctgaccagggctgccctgcagcagaagagccaggaggagctgctgaagaggcgggagcagcagctggccgagcgggagattgatgtgctggagcgggagctgaacatcctgatcttccagctgaaccaggagaagcccaaggtgaagaagaggaagggcaagttcaagaggagccggctgaagctgaaggatggccaccgcatcagcctgcccagcgacttccagcacaagatcaccgtgcaggccagccccaacctggacaagaggaggagcctgaacagcagcagcagcagcccccccagcagccccaccatgatgccccggctgcgggccatccagctgaccagtgatgagagcaacaagacctggggcaggaacacagtgttccggcaggaggagtttgaagatgtgaagaggaacttcaagaagaagggctgcacctggggccccaacagcatccagatgaaggacagaacagactgcaaggagcgcatccggcccctgagtgatggcaacagcccctggagcaccatcctgatcaagaaccagaagaccatgcccctggccagcctgtttgtggaccagcccggcagctgtgaggagcccaagctgagcccagatggcctggagcacaggaagcccaagcagatcaagctgcccagccaggcctacatcgacctgcccctgggcaaggatgcccagagagaaaatcctgctgaggccgagagctgggaggaggccgccagcgccaatgctgccaccgtgtccattgagatgacccccaccaacagcctgagccgcagcccccagaggaagaagacagaaagtgccctgtatggctgcaccgtgctgctggcctctgtggccctgggcctggacctgcgggagctgcacaaggcccaggccgctgaggagcccctgcccaaggaggagaagaagaagcgggagggcatcttccagagggccagcaagagcagaagaagtgccagcccccccaccagcctgcccagcacctgtggggaggccagcagcccccccagcctgcccctgagcagcgccctgggcatcctgagcacccccagcttcagcaccaagtgcctgctgcagatggattctgaggaccccctggtggacagcgcccctgtgacctgtgacagcgagatgctgaccccagacttctgccccacagcccctggcagcggccgggagcccgccctgatgccccggctggacacagactgcagcgtgtccaggaacctgcccagcagcttcctgcagcagacctgtggaaatgtgccctactgtgccagcagcaagcaccggcccagccaccacaggaggaccatgtctgatggcaaccccacccccaccggggccaccatcatcagcgccaccggggccagcgccctgcccctgtgccccagccctgccccccacagccacctgccccgggaggtgagccccaagaagcacagcacagtgcacatcgtgccccagaggaggcctgccagcctgcggagcagaagtgacctgccccaggcctacccccagacagctgtgtcccagctggcccagacagcctgtgtggtgggccggcccggcccccaccccacccagttcctggccgccaaggagaggaccaagagccacgtgcccagcctgctggatgctgatgtggagggccagagccgggactacacagtgcccctgtgcaggatgaggagcaagaccagccggcccagcatctatgagctggagaaggagttcctgtcctag

SEQ ID NO: 40090 - DNA, 792 bp, Artificial Sequence
  Description of Artificial Sequence: Synthetic coding sequence
atggagaacctgaagcacatcatcaccctgggccaggtgatccacaagagatgtgaggagatgaagtactgcaagaagcagtgccggcggctgggccaccgggtgctgggcctcatcaagcccctggagatgctgcaggaccagggcaagaggtctgtgcccagcgagaagctgaccacagccatgaaccgcttcaaggccgccctggaggaggccaatggagaaattgagaagttcagcaacagaagcaacatctgccgcttcctgacagccagccaggacaagatcctcttcaaggatgtgaacaggaagctgagtgatgtgtggaaggagctgagcctgctgctgcaggtggagcagaggatgcctgtgagccccatcagccagggcgcctcctgggcccaggaggaccagcaggatgctgatgaagatagaagagccttccagatgctgcggcgggacaatgagaagattgaggccagcctgcggcggctggagatcaacatgaaggagatcaaggagaccctgcggcagagcctggagagcagcagcggcaagagccccctggagatcagccgcttcaaggtgaagaatgtgaagacaggcagcgccagcggctgcaacagcgagaagatcaggaagctggtggccgtgaagaggcagcaggagcccctgggggaggactgccccagcgagctgcgggagatcattgatgaatgtcgggcccatgaccccagcgtgcggcccagcgtggatgagatcctgaagaagctgagcaccttcagcaagtag

SEQ ID NO: 40091 - DNA, 1416 bp, Artificial Sequence
  Description of Artificial Sequence: Synthetic coding sequence
atggagaacctgaagcacatcatcaccctgggccaggtgatccacaagagatgtgaggagatgaagtactgcaagaagcagtgccggcggctgggccaccgggtgctgggcctcatcaagcccctggagatgctgcaggaccagggcaagaggtctgtgcccagcgagaagctgaccacagccatgaaccgcttcaaggccgccctggaggaggccaatggagaaattgagaagttcagcaacagaagcaacatctgccgcttcctgacagccagccaggacaagatcctcttcaaggatgtgaacaggaagctgagtgatgtgtggaaggagctgagcctgctgctgcaggtggagcagaggatgcctgtgagccccatcagccagggcgcctcctgggcccaggaggaccagcaggatgctgatgaagatagaagagccttccagatgctgcggcgggacaatgagaagattgaggccagcctgcggcggctggagatcaacatgaaggagatcaaggagaccctgcggcagtacctgccccccaagtgcatgcaggagatcccccaggagcagatcaaggagatcaagaaggagcagctgagcggcagcccctggatcctgctgagagaaaatgaggtgtccaccctgtacaagggggagtaccaccgggcccctgtggccatcaaggtgttcaagaagctgcaggccggcagcatcgccatcgtgcggcagaccttcaacaaggagatcaagaccatgaagaagtttgagagccccaacatcctgcgcatcttcggcatctgcattgatgaaacagtgaccccaccccagttcagcatcgtgatggagtactgtgagctgggcaccctgcgggagctgctggaccgggagaaggacctgaccctgggcaagaggatggtgctggtgctgggcgccgcccggggcctgtaccgcctgcaccacagcgaggcccctgagctgcacggcaagatccgcagcagcaacttcctggtgacccagggctaccaggtgaagctggccggctttgagctgaggaagacccagacctccatgagcctgggcaccacccgggagaagacagacagagtgaagagcacagcctacctgagcccccaggagctggaggatgtgttctaccagtatgatgtgaagtctgagatctacagctttggcatcgtgctgtgggagatcgccactggagacatccccttccagggctgcaacagcgagaagatcaggaagctggtggccgtgaagaggcagcaggagcccctgggggaggactgccccagcgagctgcgggagatcattgatgaatgtcgggcccatgaccccagcgtgcggcccagcgtggatgagatcctgaagaagctgagcaccttcagcaagtag

SEQ ID NO: 40092 - DNA, 651 bp, Artificial Sequence
  Description of Artificial Sequence: Synthetic coding sequence
atgtccttcctgttcagcagccgcagcagcaagaccttcaagcccaagaagaacatccctgagggcagccaccagtatgagctgctgaagcacgccgaggccaccctgggcagcggcaacctgcggcaggccgtgatgctgcctgaaggagaggacctgaatgagtggattgctgtgaacacagtggacttcttcaaccagatcaacatgctgtatggcaccatcacagagttctgcacagaggccagctgccctgtgatgtctgctggccccaggtatgagtaccactgggcagatggcaccaacatcaagaagcccatcaagtgcagcgcccccaagtacatcgactacctgatgacctgggtgcaggaccagctggatgatgagaccctcttccccagcaagattggagtgcccttccccaagaacttcatgtctgtggccaagaccatcctgaagaggctcttccgggtgtatgcccacatctaccaccagcactttgattctgtgatgcagctgcaggaggaggcccacctgaacaccagcttcaagcacttcatcttctttgtgcaggagttcaacctgattgaccggcgggagctggcccccctgcaggagctgattgagaagctgggcagcaaggacagatag

SEQ ID NO: 40093 - DNA, 447 bp, Artificial Sequence
  Description of Artificial Sequence: Synthetic coding sequence
atgctgttctacctgagcagccgcagcagcaagaccttcaagcccaagaagaacatccctgagggcagccaccagtatgagctgctgaagcacgccgaggccaccctgggcagcggcaacctgcggcaggccgtgatgctgcctgaaggagaggacctgaatgagtggattgctgtgaacacagtggacttcttcaaccagatcaacatgctgtatggcaccatcacagagttctgcacagaggccagctgccctgtgatgtctgctggccccaggtatgagtaccactgggcagatggcaccaacatcaagaagcccatcaagtgcagcgcccccaagtacatcgactacctgatgacctgggtgcaggaccagctggatgatgagaccctcttccccagcaagatcggggagctgaccctgagcaagtacagcttcttcttctag

SEQ ID NO: 40094 - DNA, 807 bp, Artificial Sequence
  Description of Artificial Sequence: Synthetic coding sequence
atgctgggggaccactgcagcctgcctgaggaccaggcccggcccggccagagcctgcagagcggcctgtgctgcaagatggtgctgcaggccgtgtccaaggtgctgaggaagagcaaggccaagcccaacgggaagaagccagctgctgaggagaggaaggcctacctggagcctgagcacaccaaggcccgcatcacagacttccagttcaaggagctggtggtgctgccccgggagattgacctgaatgagtggctggccagcaacaccaccaccttcttccaccacatcaacctgcagtacagcaccatcagcgagttctgcaccggggagacctgccagaccatggctgtgtgcaacacccagtactactggtatgatgagcggggcaagaaggtgaagtgcacagccccccagtatgtggactttgtgatgagctctgtgcagaagctggtgacagatgaagatgtgttccccaccaagtatggccgggagttccccagcagctttgagagcctggtgaggaagatctgccgccacctgttccacgtgctggcccacatctactgggcccacttcaaggagaccctggccctggagctgcacggccacctgaacaccctgtatgtgcacttcatcctgtttgcccgggagttcaacctgctggaccccaaggagacagccatcatggatgacctgacagaggtgctgtgcagcggggccggcggcgtgcacagcggcggcagcggagatggagctggcagcggcggccctggggcccagaaccacgtgaaggagaggtag

SEQ ID NO: 40095 - DNA, 654 bp, Artificial Sequence
  Description of Artificial Sequence: Synthetic coding sequence
atgagcaaccccttcctgaagcaggtgttcaacaaggacaagaccttccggcccaagaggaagtttgagcccggcacccagagatttgagctgcacaagaaggcccaggccagcctgaatgccggcctggacctgcggctggccgtgcagctgcccccaggagaggacctgaatgactgggtggccgtgcacgtggtggacttcttcaacagagtgaacctgatctacggcaccatcagtgatggctgcacagagcagagctgccctgtgatgtctgggggccccaagtatgagtaccgctggcaggatgagcacaagttcaggaagcccacagccctgagcgccccccgctacatggacctgctgatggactggattgaggcccagatcaacaatgaagatctcttccccaccaacgtgggcacccccttccccaagaacttcctgcagacagtgaggaagatcctgagccgcctcttccgggtgtttgtgcacgtgtacatccaccactttgaccgcatcgcccagatgggcagcgaggcccacgtgaacacctgctacaagcacttctactactttgtgaaggagtttggcctgattgacaccaaggagctggagcccctgaaggagatgacagccaggatgtgccactag

SEQ ID NO: 40096 - DNA, 651 bp, Artificial Sequence
  Description of Artificial Sequence: Synthetic coding sequence
atgagcatcgccctgaagcaggtgttcaacaaggacaagaccttccggcccaagaggaagtttgagcccggcacccagagatttgagctgcacaagagggcccaggccagcctgaacagcggcgtggacctgaaggctgctgtgcagctgcccagcggggaggaccagaatgactgggtggccgtgcacgtggtggacttcttcaaccgcatcaacctgatctacggcaccatctgtgagttctgcacagagaggacctgccctgtgatgtctgggggccccaagtatgagtaccgctggcaggatgacctgaagtacaagaagcccacagccctgcctgccccccagtacatgaacctgctgatggactggattgaggtgcagatcaacaatgaggagatcttccccacctgtgtgggcgtgcccttccccaagaacttcctgcagatctgcaagaagatcctgtgccgcctcttccgggtgtttgtgcacgtgtacatccaccactttgacagagtcatcgtgatgggcgctgaggcccacgtgaacacctgctacaagcacttctactactttgtgacagagatgaacctgattgacaggaaggagctggagcccctgaaggagatgaccagcaggatgtgccactag

SEQ ID NO: 40097 - DNA, 807 bp, Artificial Sequence
  Description of Artificial Sequence: Synthetic coding sequence
atgaagagaagaaacctgtttgccctggagactggagtgcccccctggggcctgctgtgggtgcgcagccggcgggtgggcatggatgagatgaccttccacatctggtacccccaggtgcgggcccctggccagcagccccaggcccagctggccatggccctgtgcctgaagcaggtgtttgccaaggacaagaccttccggcccaggaagagatttgagcccggcacccagagatttgagctgtacaagaaggcccaggccagcctgaagagcggcctggacctgcggtctgtggtgcggctgcccccaggagagaacattgatgactggattgctgtgcacgtggtggacttcttcaaccgcatcaacctgatctacggcaccatggccgagcgctgcagcgagaccagctgccctgtgatggccggcggccccaggtatgagtaccgctggcaggatgagcggcagtacagaagacctgccaagctgagcgccccccgctacatggccctgctgatggactggattgagggcctcatcaatgatgaggaggtgttccccaccagggtgggcgtgcccttccccaagaacttccagcaggtgtgcaccaagatcctgaccaggctcttccgggtgtttgtgcacgtgtacatccaccactttgacagcatcctgtccatgggcgctgaggcccacgtgaacacctgctacaagcacttctactacttcatccgggagttcagcctggtggaccagcgggagctggagcccctgcgggagatgacagagcgcatctgccactag

SEQ ID NO: 40098 - DNA, 651 bp, Artificial Sequence
  Description of Artificial Sequence: Synthetic coding sequence
atggccctgtgcctgaagcaggtgtttgccaaggacaagaccttccggcccaggaagagatttgagcccggcacccagagatttgagctgtacaagaaggcccaggccagcctgaagagcggcctggacctgcggtctgtggtgcggctgcccccaggagagaacattgatgactggattgctgtgcacgtggtggacttcttcaaccgcatcaacctgatctacggcaccatggccgagcgctgcagcgagaccagctgccctgtgatggccggcggccccaggtatgagtaccgctggcaggatgagcggcagtacagaagacctgccaagctgagcgccccccgctacatggccctgctgatggactggattgagggcctcatcaatgatgaggaggtgttccccaccagggtgggcgtgcccttccccaagaacttccagcaggtgtgcaccaagatcctgaccaggctcttccgggtgtttgtgcacgtgtacatccaccactttgacagcatcctgtccatgggcgctgaggcccacgtgaacacctgctacaagcacttctactacttcatccgggagttcagcctggtggaccagcgggagctggagcccctgcgggagatgacagagcgcatctgccactag

SEQ ID NO: 40099 - DNA, 720 bp, Artificial Sequence
  Description of Artificial Sequence: Synthetic coding sequence
atgcccctgagcctggccggctacccccaggtgcgggcccctggccagcagccccaggcccagctggccatggccctgtgcctgaagcaggtgtttgccaaggacaagaccttccggcccaggaagagatttgagcccggcacccagagatttgagctgtacaagaaggcccaggccagcctgaagagcggcctggacctgcggtctgtggtgcggctgcccccaggagaaaatattgatgactggattgctgtgcacgtggtggacttcttcaaccgcatcaacctgatctacggcaccatggccgagcgctgcagcgagaccagctgccctgtgatggccggcggccccaggtatgagtaccgctggcaggatgagcggcagtacagaagacctgccaagctgagcgccccccgctacatggccctgctgatggactggattgagggcctcatcaatgatgaggaggtgttccccaccagggtgggcgtgcccttccccaagaacttccagcaggtgtgcaccaagatcctgaccaggctcttccgggtgtttgtgcacgtgtacatccaccactttgacagcatcctgtccatgggcgctgaggcccacgtgaacacctgctacaagcacttctactacttcatccgggagttcagcctggtggaccagcgggagctggagcccctgcgggagatgacagagcgcatctgccactag

SEQ ID NO: 40100 - DNA, 1959 bp, Artificial Sequence
  Description of Artificial Sequence: Synthetic coding sequence
atgcaccctgggggcggccccagcagagctgagcggctggagctgggcctgggccgggagaggcctgccaaggccatcttcctgcaccggcggcctggagagggcggcggccgggagcgctgcctgcgctgtggccacgtgtgtgtgcggcggggccctggcccccgggaggccgtgcccagcggccggcccaggccagacaccctgaccccaccctgggtgcggcagagagctgtgacaggcaccttctgtgcctcctggacccccctgaggaacagaagagcccagaggatggccacagacatgcagaggaagaggagcagtgaatgtctggatggcaccctgacccccagtgatggccagagcatggagcgggcagagagccccaccccaggcatggcccagggcatggagcctggagctggccaggagggcgccatgtttgtgcacgcccggagctatgaggacctgacagaaagtgaagatggagctgccagcggggacagccacaaggagggcacccggggccccccacccctgcccacagacatgaggcagatcagccaggacttcagcgagctgagcacccagctgactggagtggcccgggacctgcaggaggagatgctgcccggcagcagcgaggactggctggagcccccaggagctgtgggccgcccagccacagagcccccccgggagggcaccacagaaggagatgaggaggatgccacagaggcctggaggctgcaccagaagcacgtgtttgtgctgtctgaggccggcaagcctgtgtacagccgctatggcagcgaggaggccctgagcagcaccatgggcgtgatggtggccctggtgtccttcctggaggccgacaagaatgccatccgcagcatccatgctgatggctacaaggtggtgtttgtgcggcgcagccccctggtgctggtggccgtggcccggacccggcagagcgcccaggagctggcccaggagctgctgtacatctactaccagatcctgagcctgctgactggagcccagctgagccacatcttccagcagaagcagaactatgacctgcggcggctgctgagcggcagcgagcgcatcacagacaacctgctgcagctgatggcccgggaccccagcttcctgatgggcgccgcccgctgcctgcccctggccgctgctgtgcgggacacagtgtctgccagcctgcagcaggcccgggcccggagcctggtgttcagcatcctgctggccaggaaccagctggtggccctggtgcggaggaaggaccagttcctgcaccccatcgacctgcacctgctcttcaacctgatcagcagcagcagcagcttccgggagggggaggcctggacccctgtgtgcctgcccaagttcaatgctgctggcttcttccacgcccacatctcctacctggagccagacacagacctgtgcctgctgctggtgtccacagaccgggaggacttctttgctgtgtctgactgcagaagacgcttccaggagcggctgaggaagagaggagcccacctggccctgcgggaggccctgcggaccccctactacagcgtggcccaggtgggcatcccagacctgcggcacttcctgtacaagagcaagagcagcggcctcttcaccagccctgagattgaggccccctacaccagcgaggaggagcaggagcggctgctgggcctgtaccagtacctgcacagccgggcccacaatgccagccggcccctgaagaccatctactacacaggccccaatgaaaacctgctggcctgggtgactggagcctttgagctgtacatgtgctacagccccctgggcaccaaggccagcgctgtgtctgccatccacaagctgatgcgctggatcaggaaggaggaggacaggctcttcatcctgacccccctgacctactag

SEQ ID NO: 40101 - DNA, 1473 bp, Artificial Sequence
  Description of Artificial Sequence: Synthetic coding sequence
atgcaccctgggggcggccccagcagagctgagcggctggagctgggcctgggccgggagaggcctgccaaggccatcttcctgcaccggcggcctggagagggcggcggccgggagcgctgcctgcgctgtggccacgtgtgtgtgcggcggggccctggcccccgggaggccgtgcccagcggccggcccaggccagacaccctgaccccaccctgggtgcggcagagagctgtgacaggcaccttctgtgcctcctggacccccctgaggaacagaagagcccagaggatggccacagacatgcagaggaagaggagcagtgaatgtctggatggcaccctgacccccagtgatggccagagcatggagcgggcagagagccccaccccaggcatggcccagggcatggagccagatggctacaaggtggtgtttgtgcggcgcagccccctggtgctggtggccgtggcccggacccggcagagcgcccaggagctggcccaggagctgctgtacatctactaccagatcctgagcctgctgactggagcccagctgagccacatcttccagcagaagcagaactatgacctgcggcggctgctgagcggcagcgagcgcatcacagacaacctgctgcagctgatggcccgggaccccagcttcctgatgggcgccgcccgctgcctgcccctggccgctgctgtgcgggacacagtgtctgccagcctgcagcaggcccgggcccggagcctggtgttcagcatcctgctggccaggaaccagctggtggccctggtgcggaggaaggaccagttcctgcaccccatcgacctgcacctgctcttcaacctgatcagcagcagcagcagcttccgggagggggaggcctggacccctgtgtgcctgcccaagttcaatgctgctggcttcttccacgcccacatctcctacctggagccagacacagacctgtgcctgctgctggtgtccacagaccgggaggacttctttgctgtgtctgactgcagaagacgcttccaggagcggctgaggaagagaggagcccacctggccctgcgggaggccctgcggaccccctactacagcgtggcccaggtgggcatcccagacctgcggcacttcctgtacaagagcaagagcagcggcctcttcaccagccctgagattgaggccccctacaccagcgaggaggagcaggagcggctgctgggcctgtaccagtacctgcacagccgggcccacaatgccagccggcccctgaagaccatctactacacaggccccaatgaaaacctgctggcctgggtgactggagcctttgagctgtacatgtgctacagccccctgggcaccaaggccagcgctgtgtctgccatccacaagctgatgcgctggatcaggaaggaggaggacaggctcttcatcctgacccccctgacctactag

SEQ ID NO: 40102 - DNA, 2043 bp, Artificial Sequence
  Description of Artificial Sequence: Synthetic coding sequence
atgggctgcggcaccaaggagcccaagatcacccagctgtgcctggccgccatccagaggctgatgagccatgaggtggtgtctgaaacagctgctggcaacatcatcaacatgctgtggcagctgatggagaacagcctggaggagctgaagctgctgcagacagtgctggtgctgctgaccaccaacacagtggtgcatgatgaggccctgagcaaggccatcgtgctgtgcttccggctgcacttcaccaaggacaacatcaccaacaacacagctgctgccaccgtgcggcaggtggtgacagtggtgtttgagaggatggtggctgaagatgagcggcaccgggacatcatcgagcagcctgtgctggtgcagggcaacagcaacagaagatctgtgtccaccctgaagccctgtgccaaggatgcctacatgctgttccaggacctgtgccagctggtgaatgctgatgccccctactggctggtgggcatgacagagatgaccaggaccttcggcctggagctgctggagagcgtgctgaatgacttcccccaggtgttcctgcagcaccaggagttctccttcctgctgaaggagcgggtgtgccccctggtgatcaagctgttcagccccaacatcaagttccggcagggcagcagcaccagcagcagccctgcccctgtggagaagccctacttccccatctgcatgaggctgctgcgggtggtgtctgtgctgatcaagcagttctacagcctgctggtgacagaatgtgagatcttcctgagcctgctggtgaagttcctggatgctgacaagccccagtggctgcgggctgtggccgtggagagcatccaccgcttctgtgtgcagccccagctgctgcgctccttctgccagagctatgacatgaagcagcacagcaccaaggtgttccgggacatcgtgaatgccctgggcagcttcatccagagcctcttcctggtgccccccaccggcaacccagccaccagcaaccaggccggcaacaacaacctgggcggctctgtgtctgccccagccaacagcggcatggtgggcattggaggcggcgtgaccctgctgcctgcctttgagtaccggggcacctggatccccatcctgaccatcaccgtgcagggcagcgccaaggccacctacctggagatgctggacaaggtggagccccccaccatccctgagggctacgccatgtctgtggccttccactgcctgctggacctggtgcggggcatcacctccatgattgaaggagagctgggggagctggagacagagtgccagaccaccacagaggagggcagcagccccacccagagcacagagcagcaggacctgcagagcaccagtgaccagatggacaaggagatcgtgtccagagctgtgtgggaggagatggtgaatgcctgctggtgtggcctgctggccgccctgagcctgctgctggatgccagcacagatgaggccgccacagagaacatcctgaaggccgagctgaccatggccgccctgtgtggccgcctgggcctggtgaccagcagagatgccttcatcacagccatctgcaagggcagcctgcccccccactacgccctgactgtgctgaacaccaccacagctgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgaggaccctgctgaacctggcccactgccacggggctgtgctgggcacctcctggcagctggtgctggccaccctgcagcacctggtgtggatcctgggcctgaagcccagcagcggcggggccctgaagccaggccgggctgtggagggccccagcacagtgcccttcaaggacttcatgcagcccccagccagccgggtgcagaatggagagagctag

SEQ ID NO: 40103 - DNA, 5031 bp, Artificial Sequence
  Description of Artificial Sequence: Synthetic coding sequence
atgagcggcaccagcagccctgaggccgtgaagaagctgctggagaacatgcagagcgacctgcgggccctgagcctggagtgcaagaagaagtttcctcctgtgaaggaggccgctgagagcggcatcatcaaggtgaagaccatcgccgccaggaacacagagatcctggccgccctgaaggagaacagcagcgaggtggtgcagcccttcctgatgggctgcggcaccaaggagcccaagatcacccagctgtgcctggccgccatccagaggctgatgagccatgaggtggtgtctgaaacagctgctggcaacatcatcaacatgctgtggcagctgatggagaacagcctggaggagctgaagctgctgcagacagtgctggtgctgctgaccaccaacacagtggtgcatgatgaggccctgagcaaggccatcgtgctgtgcttccggctgcacttcaccaaggacaacatcaccaacaacacagctgctgccaccgtgcggcaggtggtgacagtggtgtttgagaggatggtggctgaagatgagcggcaccgggacatcatcgagcagcctgtgctggtgcagggcaacagcaacagaagatctgtgtccaccctgaagccctgtgccaaggatgcctacatgctgttccaggacctgtgccagctggtgaatgctgatgccccctactggctggtgggcatgacagagatgaccaggaccttcggcctggagctgctggagagcgtgctgaatgacttcccccaggtgttcctgcagcaccaggagttctccttcctgctgaaggagcgggtgtgccccctggtgatcaagctgttcagccccaacatcaagttccggcagggcagcagcaccagcagcagccctgcccctgtggagaagccctacttccccatctgcatgaggctgctgcgggtggtgtctgtgctgatcaagcagttctacagcctgctggtgacagaatgtgagatcttcctgagcctgctggtgaagttcctggatgctgacaagccccagtggctgcgggctgtggccgtggagagcatccaccgcttctgtgtgcagccccagctgctgcgctccttctgccagagctatgacatgaagcagcacagcaccaaggtgttccgggacatcgtgaatgccctgggcagcttcatccagagcctcttcctggtgccccccaccggcaacccagccaccagcaaccaggccggcaacaacaacctgggcggctctgtgtctgccccagccaacagcggcatggtgggcattggaggcggcgtgaccctgctgcctgcctttgagtaccggggcacctggatccccatcctgaccatcaccgtgcagggcagcgccaaggccacctacctggagatgctggacaaggtggagccccccaccatccctgagggctacgccatgtctgtggccttccactgcctgctggacctggtgcggggcatcacctccatgattgaaggagagctgggggagctggagacagagtgccagaccaccacagaggagggcagcagccccacccagagcacagagcagcaggacctgcagagcaccagtgaccagatggacaaggagatcgtgtccagagctgtgtgggaggagatggtgaatgcctgctggtgtggcctgctggccgccctgagcctgctgctggatgccagcacagatgaggccgccacagagaacatcctgaaggccgagctgaccatggccgccctgtgtggccgcctgggcctggtgaccagcagagatgccttcatcacagccatctgcaagggcagcctgcccccccactacgccctgactgtgctgaacaccaccacagctgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgaggaccctgctgaacctggcccactgccacggggctgtgctgggcacctcctggcagctggtgctggccaccctgcagcacctggtgtggatcctgggcctgaagcccagcagcggcggggccctgaagccaggccgggctgtggagggccccagcacagtgctgaccacagctgtgatgacagacctgcccgtcatcagcaacatcctgagccggctgtttgagagcagccagtacctggatgatgtgtccctgcaccacctgatcaatgccctgtgcagcctgagcctggaggccatggacatggcctacggcaacaacaaggagcccagcctgtttgctgtggccaagctgctggagaccggcctggtgaacatgcacagaattgagatcctgtggaggcccctgaccggccacctgctggagaaggtgtgccagcaccccaacagcaggatgagggagtggggcgctgaggccctgaccagcctcatcaaggccggcctgaccttcaaccacgacccccccctgagccagaaccagaggctgcagctgctgctgctgaaccccctgaaggagatgagcaacatcaaccacccagacatccggctgaagcagctggagtgtgtgctgcagatcctgcagagccagggcgacagcctgggccctggctggcccctggtgctgggcgtgatgggcgccatcagaaatgaccagggcgagagcctcatcagaacagccttccagtgcctgcagctggtggtgacagacttcctgcccaccatgccctgcacctgcctgcagatcgtggtggatgtggccggcagctttggcctgcacaaccaggagctgaacatcagcctgaccagcatcggcctgctgtggaacatcagtgactacttcttccagagaggagagaccatcgagaaggagctgaacaaggaggaggccgcccagcagaagcaggccgaggagaagggcgtggtgctgaaccggcccttccacccagcccccccatttgactgcctgtggctgtgcctgtatgccaagctgggggagctgtgtgtggaccccaggcctgctgtgaggaagtctgctggccagaccctcttcagcaccatcggggcccacggcaccctgctgcagcacagcacctggcacacagtcatctggaaggtgctcttccacctgctggacagagtgcgggagagcagcaccacagctgacaaggagaagattgagagcggcggcggcaacatcctgatccaccacagccgggacacagctgagaagcagtgggccgagacctgggtgctgaccctggccggcgtggcccgcatcttcaacacccggcgctacctgctgcagcccctgggggacttcagccgggcctgggatgtgctgctggaccacatccagagcgctgccctgagcaagaacaatgaggtgtccctggccgccctgaagagcttccaggagatcctgcagatcgtgtcccctgtgcgggacagcgacaagccagagaccccacctgtggtgaatgtgcctgtgcctgtgctgattggccccatcagcggcatgagccggccctttgtgaggacagacagcatcggggagaagctgggccgctacagcagcagcgagccccccatcgtgacagatgagctggaggacctgaacctgtggtgggccgcctggaacacctggtacagaattggcagcgagagcaccaagccacccatcacctttgacaagctgaccttcatccccagccagcccttcctgacagccctgatccagatcttccctgccctgtaccagcacatcaagacaggcttcaacatggatgacctgcagaagctgggcgtcatcctgcacagcgccatctctgtgcccatcagcagtgatgccagccccttcatcctgcccagctacacagaagctgtgctgaccagcctgcaggaggccgtgctgacagccctggatgtgctgcagaaggccatctgtgtgggccctgagaacatgcagatcatgtacccagccatctttgaccagctgctggcctttgtggagttcagctgcaagccaccccagtatggccagctggagaccaagcacatcgccaatgccaagtacaaccagatccagctgtttgccccagctgagtgggtggccctgaactacgtgccctttgctgagaggagcctggaggtggtggtggacctgtaccagaagacagcctgccacaaggctgtggtgaatgagaaggtgctgcagaacatcatcaagaccctgcgggtgcccctgagcctgaagtacagctgccccagcgagagcacctggaagctggccgtgagcagcctgctgcgggtgctgagcatcggcctgcctgtggcccggcagcacgccagcagcggcaagtttgacagcatgtggccagagctggccaacacctttgaggacttcctgttcaccaagagcatccccccagacaacctgagcatccaggagttccagagaaatgaaaatattgatgtggaggtggtgcagctgatcagcaatgagatcctgccctatgccaacttcatccccaaggagtttgtgggccagatcatgaccatgctgaacaagggcagcatccacagccagagcagcagcttcacagaagctgagattgacatccggctgcgggaggagttcagcaagatgtgctttgagaccctgctgcagttctccttcagcaacaaggtgaccaccccccaggagggctacatcagcaggatggccctgtctgtgctgctgaagaggagccaggatgtgctgcaccgctacattgaagatgagcggctgagcggcaagtgccccctgccccggcagcaggtgacagagatcatctttgtgctgaaggctgtgtccaccctgattgacagcctgaagaagacccagccagaaaatgcctgcatcagcctgtttggcatccccccctacttctag

SEQ ID NO: 40104 - DNA, 5154 bp, Artificial Sequence
  Description of Artificial Sequence: Synthetic coding sequence
atgagcggcaccagcagccctgaggccgtgaagaagctgctggagaacatgcagagcgacctgcgggccctgagcctggagtgcaagaagaagtttcctcctgtgaaggaggccgctgagagcggcatcatcaaggtgaagaccatcgccgccaggaacacagagatcctggccgccctgaaggagaacagcagcgaggtggtgcagcccttcctgatgggctgcggcaccaaggagcccaagatcacccagctgtgcctggccgccatccagaggctgatgagccatgaggtggtgtctgaaacagctgctggcaacatcatcaacatgctgtggcagctgatggagaacagcctggaggagctgaagctgctgcagacagtgctggtgctgctgaccaccaacacagtggtgcatgatgaggccctgagcaaggccatcgtgctgtgcttccggctgcacttcaccaaggacaacatcaccaacaacacagctgctgccaccgtgcggcaggtggtgacagtggtgtttgagaggatggtggctgaagatgagcggcaccgggacatcatcgagcagcctgtgctggtgcagggcaacagcaacagaagatctgtgtccaccctgaagccctgtgccaaggatgcctacatgctgttccaggacctgtgccagctggtgaatgctgatgccccctactggctggtgggcatgacagagatgaccaggaccttcggcctggagctgctggagagcgtgctgaatgacttcccccaggtgttcctgcagcaccaggagttctccttcctgctgaaggagcgggtgtgccccctggtgatcaagctgttcagccccaacatcaagttccggcagggcagcagcaccagcagcagccctgcccctgtggagaagccctacttccccatctgcatgaggctgctgcgggtggtgtctgtgctgatcaagcagttctacagcctgctggtgacagaatgtgagatcttcctgagcctgctggtgaagttcctggatgctgacaagccccagtggctgcgggctgtggccgtggagagcatccaccgcttctgtgtgcagccccagctgctgcgctccttctgccagagctatgacatgaagcagcacagcaccaaggtgttccgggacatcgtgaatgccctgggcagcttcatccagagcctcttcctggtgccccccaccggcaacccagccaccagcaaccaggccggcaacaacaacctgggcggctctgtgtctgccccagccaacagcggcatggtgggcattggaggcggcgtgaccctgctgcctgcctttgagtaccggggcacctggatccccatcctgaccatcaccgtgcagggcagcgccaaggccacctacctggagatgctggacaaggtggagccccccaccatccctgagggctacgccatgtctgtggccttccactgcctgctggacctggtgcggggcatcacctccatgattgaaggagagctgggggagctggagacagagtgccagaccaccacagaggagggcagcagccccacccagagcacagagcagcaggacctgcagagcaccagtgaccagatggacaaggagatcgtgtccagagctgtgtgggaggagatggtgaatgcctgctggtgtggcctgctggccgccctgagcctgctgctggatgccagcacagatgaggccgccacagagaacatcctgaaggccgagctgaccatggccgccctgtgtggccgcctgggcctggtgaccagcagagatgccttcatcacagccatctgcaagggcagcctgcccccccactacgccctgactgtgctgaacaccaccacagctgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgaggaccctgctgaacctggcccactgccacggggctgtgctgggcacctcctggcagctggtgctggccaccctgcagcacctggtgtggatcctgggcctgaagcccagcagcggcggggccctgaagccaggccgggctgtggagggccccagcacagtgctgaccacagctgtgatgacagacctgcccgtcatcagcaacatcctgagccggctgtttgagagcagccagtacctggatgatgtgtccctgcaccacctgatcaatgccctgtgcagcctgagcctggaggccatggacatggcctacggcaacaacaaggagcccagcctgtttgctgtggccaagctgctggagaccggcctggtgaacatgcacagaattgagatcctgtggaggcccctgaccggccacctgctggaggtgtgccagcaccccaacagcaggatgagggagtggggcgctgaggccctgaccagcctcatcaaggccggcctgaccttcaaccacgacccccccctgagccagaaccagaggctgcagctgctgctgctgaaccccctgaaggagatgagcaacatcaaccacccagacatccggctgaagcagctggagtgtgtgctgcagatcctgcagagccagggcgacagcctgggccctggctggcccctggtgctgggcgtgatgggcgccatcagaaatgaccagggcgagagcctcatcagaacagccttccagtgcctgcagctggtggtgacagacttcctgcccaccatgccctgcacctgcctgcagatcgtggtggatgtggccggcagctttggcctgcacaaccaggagctgaacatcagcctgaccagcatcggcctgctgtggaacatcagtgactacttcttccagagaggagagaccatcgagaaggagctgaacaaggaggaggccgcccagcagaagcaggccgaggagaagggcgtggtgctgaaccggcccttccacccagcccccccatttgactgcctgtggctgtgcctgtatgccaagctgggggagctgtgtgtggaccccaggcctgctgtgaggaagtctgctggccagaccctcttcagcaccatcggggcccacggcaccctgctgcagcacagcacctggcacacagtcatctggaaggtgctcttccacctgctggacagagtgcgggagagcagcaccacagctgacaaggagaagattgaaagtggcggcggcaacatcctgatccaccacagccgggacacagctgagaagcagtgggccgagacctgggtgctgaccctggccggcgtggcccgcatcttcaacacccggcgctacctgctgcagcccctgggggacttcagccgggcctgggatgtgctgctggaccacatccagagcgctgccctgagcaagaacaatgaggtgtccctggccgccctgaagagcttccaggagatcctgcagatcgtgtcccctgtgcgggacagcgacaagccagagaccccacctgtggtgaatgtgcctgtgcctgtgctgattggccccatcagcggcatgagccggccctttgtgaggacagacagcattggagagaagctgggccgctacagcagcagcgagccccccatcgtgacagatgagctggaggacctgaacctgtggtgggccgcctggaacacctggtaccgcatcggcagcgagagcaccaagccacccatcacctttgacaagctgaccttcatccccagccagcccttcctgacagccctgatccagatcttccctgccctgtaccagcacatcaagacaggcttcaacatggatgacctgcagaagctgggcgtcatcctgcacagcgccatctctgtgcccatcagcagtgatgccagccccttcatcctgcccagctacacagaggccgtgctgaccagcctgcaggaggccgtgctgacagccctggatgtgctgcagaaggccatctgtgtgggccctgagaacatgcagatcatgtacccagccatctttgaccagctgctggcctttgtggagttcagctgcaagccaccccagtatggccagctggagaccaagcacatcgccaatgccaagtacaaccagatccagctgtttgccccagctgagtgggtggccctgaactacgtgccctttgctgagaggagcctggaggtggtggtggacctgtaccagaagacagcctgccacaaggctgtggtgaatgagaaggtgctgcagaacatcatcaagaccctgcgggtgcccctgagcctgaagtacagctgccccagcgagagcacctggaagctggccgtgagcagcctgctgcgggtgctgagcatcggcctgcctgtggcccggcagcacgccagcagcggcaagtttgacagcatgtggccagagctggccaacacctttgaggacttcctgttcaccaagagcatccccccagacaacctgagcatccaggagttccagagaaatgaaaatattgatgtggaggtggtgcagctgatcagcaatgagatcctgccctatgccaacttcatccccaaggagtttgtgggccagatcatgaccatgctgaacaagggcagcatccacagccagagcagcagcttcacagaggccgagattgacatccggctgcgggaggagttcagcaagatgtgctttgagaccctgctgcagttctccttcagcaacaaggtgaccaccccccaggagggctacatcagcaggatggccctgtctgtgctgctgaagaggagccaggatgtgctgcaccgctacattgaagatgagcggctgtctggaaaatgtcccctgccccggcagcaggtgacagagatcatctttgtgctgaaggctgtgtccaccctgattgacagcctgaagaagacccagccagaaaatgtggatggcaacacctgggcccaggtgattgccctgtaccccaccctggtggagtgcatcacctgcagcagcagcgaggtgtgcagcgccctgaaggaggccctggtgcccttcaaggacttcatgcagcccccagccagccgggtgcagaatggagagagctag

SEQ ID NO: 40105 - DNA, 5028 bp, Artificial Sequence
  Description of Artificial Sequence: Synthetic coding sequence
atgagcggcaccagcagccctgaggccgtgaagaagctgctggagaacatgcagagcgacctgcgggccctgagcctggagtgcaagaagaagtttcctcctgtgaaggaggccgctgagagcggcatcatcaaggtgaagaccatcgccgccaggaacacagagatcctggccgccctgaaggagaacagcagcgaggtggtgcagcccttcctgatgggctgcggcaccaaggagcccaagatcacccagctgtgcctggccgccatccagaggctgatgagccatgaggtggtgtctgaaacagctgctggcaacatcatcaacatgctgtggcagctgatggagaacagcctggaggagctgaagctgctgcagacagtgctggtgctgctgaccaccaacacagtggtgcatgatgaggccctgagcaaggccatcgtgctgtgcttccggctgcacttcaccaaggacaacatcaccaacaacacagctgctgccaccgtgcggcaggtggtgacagtggtgtttgagaggatggtggctgaagatgagcggcaccgggacatcatcgagcagcctgtgctggtgcagggcaacagcaacagaagatctgtgtccaccctgaagccctgtgccaaggatgcctacatgctgttccaggacctgtgccagctggtgaatgctgatgccccctactggctggtgggcatgacagagatgaccaggaccttcggcctggagctgctggagagcgtgctgaatgacttcccccaggtgttcctgcagcaccaggagttctccttcctgctgaaggagcgggtgtgccccctggtgatcaagctgttcagccccaacatcaagttccggcagggcagcagcaccagcagcagccctgcccctgtggagaagccctacttccccatctgcatgaggctgctgcgggtggtgtctgtgctgatcaagcagttctacagcctgctggtgacagaatgtgagatcttcctgagcctgctggtgaagttcctggatgctgacaagccccagtggctgcgggctgtggccgtggagagcatccaccgcttctgtgtgcagccccagctgctgcgctccttctgccagagctatgacatgaagcagcacagcaccaaggtgttccgggacatcgtgaatgccctgggcagcttcatccagagcctcttcctggtgccccccaccggcaacccagccaccagcaaccaggccggcaacaacaacctgggcggctctgtgtctgccccagccaacagcggcatggtgggcattggaggcggcgtgaccctgctgcctgcctttgagtaccggggcacctggatccccatcctgaccatcaccgtgcagggcagcgccaaggccacctacctggagatgctggacaaggtggagccccccaccatccctgagggctacgccatgtctgtggccttccactgcctgctggacctggtgcggggcatcacctccatgattgaaggagagctgggggagctggagacagagtgccagaccaccacagaggagggcagcagccccacccagagcacagagcagcaggacctgcagagcaccagtgaccagatggacaaggagatcgtgtccagagctgtgtgggaggagatggtgaatgcctgctggtgtggcctgctggccgccctgagcctgctgctggatgccagcacagatgaggccgccacagagaacatcctgaaggccgagctgaccatggccgccctgtgtggccgcctgggcctggtgaccagcagagatgccttcatcacagccatctgcaagggcagcctgcccccccactacgccctgactgtgctgaacaccaccacagctgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgaggaccctgctgaacctggcccactgccacggggctgtgctgggcacctcctggcagctggtgctggccaccctgcagcacctggtgtggatcctgggcctgaagcccagcagcggcggggccctgaagccaggccgggctgtggagggccccagcacagtgctgaccacagctgtgatgacagacctgcccgtcatcagcaacatcctgagccggctgtttgagagcagccagtacctggatgatgtgtccctgcaccacctgatcaatgccctgtgcagcctgagcctggaggccatggacatggcctacggcaacaacaaggagcccagcctgtttgctgtggccaagctgctggagaccggcctggtgaacatgcacagaattgagatcctgtggaggcccctgaccggccacctgctggaggtgtgccagcaccccaacagcaggatgagggagtggggcgctgaggccctgaccagcctcatcaaggccggcctgaccttcaaccacgacccccccctgagccagaaccagaggctgcagctgctgctgctgaaccccctgaaggagatgagcaacatcaaccacccagacatccggctgaagcagctggagtgtgtgctgcagatcctgcagagccagggcgacagcctgggccctggctggcccctggtgctgggcgtgatgggcgccatcagaaatgaccagggcgagagcctcatcagaacagccttccagtgcctgcagctggtggtgacagacttcctgcccaccatgccctgcacctgcctgcagatcgtggtggatgtggccggcagctttggcctgcacaaccaggagctgaacatcagcctgaccagcatcggcctgctgtggaacatcagtgactacttcttccagagaggagagaccatcgagaaggagctgaacaaggaggaggccgcccagcagaagcaggccgaggagaagggcgtggtgctgaaccggcccttccacccagcccccccatttgactgcctgtggctgtgcctgtatgccaagctgggggagctgtgtgtggaccccaggcctgctgtgaggaagtctgctggccagaccctcttcagcaccatcggggcccacggcaccctgctgcagcacagcacctggcacacagtcatctggaaggtgctcttccacctgctggacagagtgcgggagagcagcaccacagctgacaaggagaagattgaaagtggcggcggcaacatcctgatccaccacagccgggacacagctgagaagcagtgggccgagacctgggtgctgaccctggccggcgtggcccgcatcttcaacacccggcgctacctgctgcagcccctgggggacttcagccgggcctgggatgtgctgctggaccacatccagagcgctgccctgagcaagaacaatgaggtgtccctggccgccctgaagagcttccaggagatcctgcagatcgtgtcccctgtgcgggacagcgacaagccagagaccccacctgtggtgaatgtgcctgtgcctgtgctgattggccccatcagcggcatgagccggccctttgtgaggacagacagcattggagagaagctgggccgctacagcagcagcgagccccccatcgtgacagatgagctggaggacctgaacctgtggtgggccgcctggaacacctggtaccgcatcggcagcgagagcaccaagccacccatcacctttgacaagctgaccttcatccccagccagcccttcctgacagccctgatccagatcttccctgccctgtaccagcacatcaagacaggcttcaacatggatgacctgcagaagctgggcgtcatcctgcacagcgccatctctgtgcccatcagcagtgatgccagccccttcatcctgcccagctacacagaggccgtgctgaccagcctgcaggaggccgtgctgacagccctggatgtgctgcagaaggccatctgtgtgggccctgagaacatgcagatcatgtacccagccatctttgaccagctgctggcctttgtggagttcagctgcaagccaccccagtatggccagctggagaccaagcacatcgccaatgccaagtacaaccagatccagctgtttgccccagctgagtgggtggccctgaactacgtgccctttgctgagaggagcctggaggtggtggtggacctgtaccagaagacagcctgccacaaggctgtggtgaatgagaaggtgctgcagaacatcatcaagaccctgcgggtgcccctgagcctgaagtacagctgccccagcgagagcacctggaagctggccgtgagcagcctgctgcgggtgctgagcatcggcctgcctgtggcccggcagcacgccagcagcggcaagtttgacagcatgtggccagagctggccaacacctttgaggacttcctgttcaccaagagcatccccccagacaacctgagcatccaggagttccagagaaatgaaaatattgatgtggaggtggtgcagctgatcagcaatgagatcctgccctatgccaacttcatccccaaggagtttgtgggccagatcatgaccatgctgaacaagggcagcatccacagccagagcagcagcttcacagaggccgagattgacatccggctgcgggaggagttcagcaagatgtgctttgagaccctgctgcagttctccttcagcaacaaggtgaccaccccccaggagggctacatcagcaggatggccctgtctgtgctgctgaagaggagccaggatgtgctgcaccgctacattgaagatgagcggctgtctggaaaatgtcccctgccccggcagcaggtgacagagatcatctttgtgctgaaggctgtgtccaccctgattgacagcctgaagaagacccagccagaaaatgcctgcatcagcctgtttggcatccccccctacttctag

SEQ ID NO: 40106 - DNA, 2703 bp, Artificial Sequence
  Description of Artificial Sequence: Synthetic coding sequence
atgctgctgtacagaggagccccagctggccctggggcccctggctgcggcctggcccggcctgggggcggcccccaggccttcggcatccggctgagcaccatgagcccccgctacctgcagagcaacagcagcagccacacccggcccttcagcgccatcgccgagctgctggacaatgctgtggaccctgatgtgtctgccaggacagtgttcattgatgtggaggaggtgaagaacaagagctgcctgaccttcacagatgatggctgcggcatgaccccccacaagctgcacaggatgctgagctttggcttcacagacaaggtgatcaagaagagccagtgccccatcggcgtgtttggaaatggcttcaagagcggctccatgaggctgggcaaggatgccctggtgttcaccaagaatggaggcaccctgactgtgggcctgctgagccagacctacctggagtgtgtgcaggcccaggccgtgattgtgcccatcgtgcccttcaaccagcagaacaagaagatgatcatcacagaggacagcctgcccagcctggaggccatcctgaactacagcatcttcaaccgggagaatgacctgctggcccagtttgatgccatccctgggaagaagggcaccagggtgctgatctggaacatcagaagaaacaagaatggcaagtctgagctggactttgacacagaccagtatgacatcctggtgtctgactttgacacagaggagaagatgactggaggagtgaccagcgagctgcctgagacagagtacagcctgcgggccttctgtggcatcctgtacatgaagcccaggatgaagatcttcctgcggcagaagaaggtgaccacccagatgattgccaagagcctggccaacgtggagtatgacacctacaagcccaccttcaccaacaagcaggtgcgcatcaccttcggcttcagctgcaagaacagcaaccagtttggcatcatgatgtaccacaacaacagactcatcaagagctttgagaaggtgggctgccaggtgaagcccaccagaggagagggcgtgggcgtcatcggcgtgattgagtgcaacttcctgaagccagcctacaacaagcaggactttgagtacaccaaggagtaccgcctgaccatcaatgccctggcccagaagctgaatgcctactggaaggagaagaccagccaggacaactttgagaccagcacagtggcccggcccatccccaaggtgcctgaccagacctgggtgcagtgtgatgaatgtctgaagtggaggaagctgcccgggaagattgaccccagcatgctgcctgcccgctggttctgctactacaacagccaccccaagtaccgccgctgcagcgtgcctgaggagcaggagctgacagatgaggacctgtgcctgagcaaggccaagaagcaggagcagacagtggaggagaagaagaagatgcccatggagaatgaaaaccaccaggtgttcagcaacccccccaagatcctgactgtgcaggagatggccggcctgaacaacaagaccatcggctatgagggcatccacagccccagcgtgctgcccagcggcggggaggagagccgcagccccagcctgcagctgaagcccctggacagctctgtgctgcagttcagcagcaagtacaagtggatcctgggggaggagcctgtggagaagagaagaaggctgcagaatgagatgaccacccccagcctggactacagcatgcctgccccctacagaagagtggaggcccctgtggcctacccagaaggagagaacagccatgacaagagcagcagcgagaggagcaccccaccctacctgtttcctgagtacccagaggccagcaagaacacaggccagaaccgggaggtgtccatcctgtacccaggggccaaggaccagaggcagggcagcctgctgcctgaggagctggaggaccagatgccccggctggtggccgaggagagcaacagaggcagcaccaccatcaacaaggaggaggtgaacaagggcccctttgtggccgtggtgggcgtggccaagggcgtgcgggacagcggggcccccatccagctgatccccttcaaccgggaggagctggccgagaggaggaaggctgtggagagctggaaccctgtgccctacagcgtggccagcgctgccatcccagctgctgccatcggggagaaggcccggggctatgaggagagcgagggccacaacacccccaagctgaagaaccagcgggagctggaggagctgaagaggaccacagagaagctggagcgggtgctggccgagaggaacctcttccagcagaaggtggaggagctggagcaggagaggaaccactggcagagcgagttcaagaaggtgcagcacgagctggtgatctacagcacccaggaggccgagggcctgtactggagcaagaagcacatgggctaccggcaggccgagttccagatcctgaaggccgagctggagaggaccaaggaggagaagcaggagctgaaggagaagctgaaggagacagagacccacctggagatgctgcagaaggcccagggctttgggaaggcctatgctgccacctacccccggcagctgagcccctacttctgcccccccagcctgggcgccagctag

SEQ ID NO: 40107 - DNA, 2814 bp, Artificial Sequence
  Description of Artificial Sequence: Synthetic coding sequence
atgctgctgtacagaggagccccagctggccctggggcccctggctgcggcctggcccggcctgggggcggcccccaggccttcggcatccggctgagcaccatgagcccccgctacctgcagagcaacagcagcagccacacccggcccttcagcgccatcgccgagctgctggacaatgctgtggaccctgatgtgtctgccaggacagtgttcattgatgtggaggaggtgaagaacaagagctgcctgaccttcacagatgatggctgcggcatgaccccccacaagctgcacaggatgctgagctttggcttcacagacaaggtgatcaagaagagccagtgccccatcggcgtgtttggaaatggcttcaagagcggctccatgaggctgggcaaggatgccctggtgttcaccaagaatggaggcaccctgactgtgggcctgctgagccagacctacctggagtgtgtgcaggcccaggccgtgattgtgcccatcgtgcccttcaaccagcagaacaagaagatgatcatcacagaggacagcctgcccagcctggaggccatcctgaactacagcatcttcaaccgggagaatgacctgctggcccagtttgatgccatccctgggaagaagggcaccagggtgctgatctggaacatcagaagaaacaagaatggcaagtctgagctggactttgacacagaccagtatgacatcctggtgtctgactttgacacagaggagaagatgactggaggagtgaccagcgagctgcctgagacagagtacagcctgcgggccttctgtggcatcctgtacatgaagcccaggatgaagatcttcctgcggcagaagaaggtgaccacccagatgattgccaagagcctggccaacgtggagtatgacacctacaagcccaccttcaccaacaagcaggtgcgcatcaccttcggcttcagctgcaagaacagcaaccagtttggcatcatgatgtaccacaacaacagactcatcaagagctttgagaaggtgggctgccaggtgaagcccaccagaggagagggcgtgggcgtcatcggcgtgattgagtgcaacttcctgaagccagcctacaacaagcaggactttgagtacaccaaggagtaccgcctgaccatcaatgccctggcccagaagctgaatgcctactggaaggagaagaccagccaggacaactttgagaccagcacagtggcccggcccatccccaaggtgcctgaccagacctgggtgcagtgtgatgaatgtctgaagtggaggaagctgcccgggaagattgaccccagcatgctgcctgcccgctggttctgctactacaacagccaccccaagtaccgccgctgcagcgtgcctgaggagcaggagctgacagatgaggacctgtgcctgagcaaggccaagaagcaggagcagacagtggaggagaagaagaagatgcccatggagaatgaaaaccaccaggtgttcagcaacccccccaagatcctgactgtgcaggagatggccggcctgaacaacaagaccatcggctatgagggcatccacagccccagcgtgctgcccagcggcggggaggagagccgcagccccagcctgcagctgaagcccctggacagctctgtgctgcagttcagcagcaagtacaagtggatcctgggggaggagcctgtggagaagagaagaaggctgcagaatgagatgaccacccccagcctggactacagcatgcctgccccctacagaagagtggaggcccctgtggcctacccagaaggagagaacagccatgacaagagcagcagcgagaggagcaccccaccctacctgtttcctgagtacccagaggccagcaagaacacaggccagaaccgggaggtgtccatcctgtacccaggggccaaggaccagaggcagggcagcctgctgcctgaggagctggaggaccagatgccccggctggtggccgaggagagcaacagaggcagcaccaccatcaacaaggaggaggtgaacaagggcccctttgtggccgtggtgggcgtggccaagggcgtgcgggacagcggggcccccatccagctgatccccttcaaccgggaggagctggccgagaggaggaaggctgtggagagctggaaccctgtgccctacagcgtggccagcgctgccatcccagctgctgccatcggggagaaggcccggggctatgaggagagcgagggccacaacacccccaagctgaagaaccagcgggagctggaggagctgaagaggaccacagagaagctggagcgggtgctggccgagaggaacctcttccagcagaaggtggaggagctggagcaggagaggaaccactggcagagcgagttcaagaaggtgcagcacgagctggtgatctacagcacccaggaggccgagggcctgtactggagcaagaagcacatgggctaccggcaggccgagttccagatcctgaaggccgagctggagaggaccaaggaggagaagcaggagctgaaggagaagctgaaggagacagagacccacctggagatgctgcagaaggcccaggtgtcctaccgcaccccagaaggagatgacctggagcgggccctggccaagctgacccggctgcgcatccacgtgtcctacctgctgacctctgtgctgccccacctggagctgcgggagatcggctatgattctgagcaggtggatggcatcctgtacacagtgctggaggccaaccacatcctggactag

SEQ ID NO: 40108 - DNA, 1947 bp, Artificial Sequence
  Description of Artificial Sequence: Synthetic coding sequence
atgactggaggagtgaccagcgagctgcctgagacagagtacagcctgcgggccttctgtggcatcctgtacatgaagcccaggatgaagatcttcctgcggcagaagaaggtgaccacccagatgattgccaagagcctggccaacgtggagtatgacacctacaagcccaccttcaccaacaagcaggtgcgcatcaccttcggcttcagctgcaagaacagcaaccagtttggcatcatgatgtaccacaacaacagactcatcaagagctttgagaaggtgggctgccaggtgaagcccaccagaggagagggcgtgggcgtcatcggcgtgattgagtgcaacttcctgaagccagcctacaacaagcaggactttgagtacaccaaggagtaccgcctgaccatcaatgccctggcccagaagctgaatgcctactggaaggagaagaccagccaggacaactttgagaccagcacagtggcccggcccatccccaaggtgcctgaccagacctgggtgcagtgtgatgaatgtctgaagtggaggaagctgcccgggaagattgaccccagcatgctgcctgcccgctggttctgctactacaacagccaccccaagtaccgccgctgcagcgtgcctgaggagcaggagctgacagatgaggacctgtgcctgagcaaggccaagaagcaggagcagacagtggaggagaagaagaagatgcccatggagaatgaaaaccaccaggtgttcagcaacccccccaagatcctgactgtgcaggagatggccggcctgaacaacaagaccatcggctatgagggcatccacagccccagcgtgctgcccagcggcggggaggagagccgcagccccagcctgcagctgaagcccctggacagctctgtgctgcagttcagcagcaagtacaagtggatcctgggggaggagcctgtggagaagagaagaaggctgcagaatgagatgaccacccccagcctggactacagcatgcctgccccctacagaagagtggaggcccctgtggcctacccagaaggagagaacagccatgacaagagcagcagcgagaggagcaccccaccctacctgtttcctgagtacccagaggccagcaagaacacaggccagaaccgggaggtgtccatcctgtacccaggggccaaggaccagaggcagggcagcctgctgcctgaggagctggaggaccagatgccccggctggtggccgaggagagcaacagaggcagcaccaccatcaacaaggaggaggtgaacaagggcccctttgtggccgtggtgggcgtggccaagggcgtgcgggacagcggggcccccatccagctgatccccttcaaccgggaggagctggccgagaggaggaaggctgtggagagctggaaccctgtgccctacagcgtggccagcgctgccatcccagctgctgccatcggggagaaggcccggggctatgaggagagcgagggccacaacacccccaagctgaagaaccagcgggagctggaggagctgaagaggaccacagagaagctggagcgggtgctggccgagaggaacctcttccagcagaaggtggaggagctggagcaggagaggaaccactggcagagcgagttcaagaaggtgcagcacgagctggtgatctacagcacccaggaggccgagggcctgtactggagcaagaagcacatgggctaccggcaggccgagttccagatcctgaaggccgagctggagaggaccaaggaggagaagcaggagctgaaggagaagctgaaggagacagagacccacctggagatgctgcagaaggcccagggctttgggaaggcctatgctgccacctacccccggcagctgagcccctacttctgcccccccagcctgggcgccagctag

SEQ ID NO: 40109 - DNA, 384 bp, Artificial Sequence
  Description of Artificial Sequence: Synthetic coding sequence
atgaggcccctggacattgatgaggtggaggcccctgaggaggtggaggtgctggagcctgaggaggactttgagcagttcctgctgcccgtcatcaatgagatgagagaagatattgccagcctcatccgggagcacggccgggcctacctgcggaccaggagcaagctgtgggagatggacaacatgctgatccagatcaagacccaggtggaggccagcgaggagagcgccctgaaccacgtgcagcaccccagcggggaggctgatgagcgggtgtctgagctgtgtgagaaggccgaggagaaggccaaggagatcgccaagatggccgagatgctggtggagctggtgtggagaattgaaagaagtgagagcagctag

SEQ ID NO: 40110 - DNA, 471 bp, Artificial Sequence
  Description of Artificial Sequence: Synthetic coding sequence
atggctgctgctggggagggcacccccagcagccggggcccccggcgggaccccccccggcggcccccaagaaatggacatggcaagctgctcttcaaggatggcagctactatgagggcgcctttgtggatggagagatcaccggggagggccgccgccactgggcctggagcggggacaccttcagcggccagtttgtgctgggggagccccagggctacggcgtgatggagtacaaggccggcggctgctatgaaggagaggtgagccacggcatgagggagggccacggcttcctggtggacagagatggccaggtgtaccagggcagcttccatgacaacaagagacatggccctggccagatgctgttccagaatggagacaagtatgatggagactgggtgcgggaccggcggcagggccatggagtgctgcgctgtgctgatggcagcacctacaagctgtag

SEQ ID NO: 40111 - DNA, 1053 bp, Artificial Sequence
  Description of Artificial Sequence: Synthetic coding sequence
atggctgctgctggggagggcacccccagcagccggggcccccggcgggaccccccccggcggcccccaagaaatggctatggagtgtatgtgtaccccaacagcttcttccgctatgaaggagagtggaaggccggcaggaagcacggccacggcaagctgctcttcaaggatggcagctactatgagggcgcctttgtggatggagagatcaccggggagggccgccgccactgggcctggagcggggacaccttcagcggccagtttgtgctgggggagccccagggctacggcgtgatggagtacaaggccggcggctgctatgaaggagaggtgagccacggcatgagggagggccacggcttcctggtggacagagatggccaggtgtaccagggcagcttccatgacaacaagagacatggccctggccagatgctgttccagaatggagacaagtatgatggagactgggtgcgggaccggcggcagggccatggagtgctgcgctgtgctgatggcagcacctacaagggccagtggcacagtgatgtgttcagcggcctgggctccatggcccactgcagcggcgtgacctactacggcctgtggatcaatggccaccctgctgagcaggccaccagaattgtcatcctgggccctgaggtgatggaggtggcccagggcagccccttctctgtgaatgtgcagctgctgcaggaccatggagagatcgccaagtctgagagcggccgggtgctgcagatctctgctggggtgcgctacgtgcagctgagcgcctacagcgaggtgaacttcttcaaggtggaccgggacaaccaggagaccctcatccagacccccttcggctttgagtgcatcccctaccctgtgagcagccctgctgctggggtgcccggccccagggctgccaagggcggcgctgaggctgatgtgcccctgcccaggggggacctggagctgcacctgggcgccctgcacggccaggaggacaccccaggcggcctgctgggcagcagcctcttctag

SEQ ID NO: 40112 - DNA, 1494 bp, Artificial Sequence
  Description of Artificial Sequence: Synthetic coding sequence
atggctgctgctggggagggcacccccagcagccggggcccccggcgggaccccccccggcggcccccaagaaatggctatggagtgtatgtgtaccccaacagcttcttccgctatgaaggagagtggaaggccggcaggaagcacggccacggcaagctgctcttcaaggatggcagctactatgagggcgcctttgtggatggagagatcaccggggagggccgccgccactgggcctggagcggggacaccttcagcggccagtttgtgctgggggagccccagggctacggcgtgatggagtacaaggccggcggctgctatgaaggagaggtgagccacggcatgagggagggccacggcttcctggtggacagagatggccaggtgtaccagggcagcttccatgacaacaagagacatggccctggccagatgctgttccagaatggagacaagtatgatggagactgggtgcgggaccggcggcagggccatggagtgctgcgctgtgctgatggcagcacctacaagggccagtggcacagtgatgtgttcagcggcctgggctccatggcccactgcagcggcgtgacctactacggcctgtggatcaatggccaccctgctgagcaggccaccagaattgtcatcctgggccctgaggtgatggaggtggcccagggcagccccttctctgtgaatgtgcagctgctgcaggaccatggagagatcgccaagtctgagagcggccgggtgctgcagatctctgctggggtgcgctacgtgcagctgagcgcctacagcgaggtgaacttcttcaaggtggaccgggacaaccaggagaccctcatccagacccccttcggctttgagtgcatcccctaccctgtgagcagccctgctgctggggtgcccggccccagggctgccaagggcggcgctgaggctgatgtgcccctgcccaggggggacctggagctgcacctgggcgccctgcacggccaggaggacaccccaggcggcctgctggcccggggccacgccccccactgccctggggcctgccagagggtggagcagggctgtgccgagttcacagatgtgctgctgggccccccacctcctggctaccaccccttcctgttcctggacagcctgcacaagaaggccggcggccgcagccggggcggcctgcacccccggggcaccccacccacagcccaggagcccccaggcggcagcaggcctgagggccgggccacagaggagcaggccgctgctgcccacctgggggagtatgtgctgatgatcagagatgtgaccaccccacccttcctgggccggcggctgcccccagccttcaagcacctgcgggtggtggccaagagagctggccagccccctcatgtgctggaggagggccctgaggccagcagctcctggcaggccgcccacagctgcaccccagagcccccagcccccaggtag

SEQ ID NO: 40113 - DNA, 456 bp, Artificial Sequence
  Description of Artificial Sequence: Synthetic coding sequence
acagccaccacccggctgcccctgctgcgggtggacagcgtgcgggtgagccccagaaatggagacaagtatgatggagactgggtgcgggaccggcggcagggccacggcgtgctgcgctgtgctgatggcagcacctacaagggccagtggcacagtgatgtgttttctggcctgggctccatggcccactgcagcggcgtgacctactacggcctgtggatcaatggccaccctgctgagcaggccacccgcatcgtcatcctgggccctgaggtgatggaggtggcccagggcagccccttctctgtgaatgtgcagctgctgcaggaccacggggagatcgccaagaatggagtgtccctgctgctgagccggctggagtgcagcggggccatgtctgccctgaggaacctgcggctgcccaggagcagtgacagcgccctggccagctag

SEQ ID NO: 40114 - DNA, 558 bp, Artificial Sequence
  Description of Artificial Sequence: Synthetic coding sequence
gtcaccggcagctgctacctgaagatggccgtcatcaccaagggccgcctgtggacagagaggagccgggagaaggctgctggcactggacctggccaggagacccccagcctggacagcctcttctgggagagcctgaaggccacagcctcctggagcaccaagccagcagatgtgatgaagggccgcagccccacagcctgtgggaaggacaccggcttctggtggacaggcatggacaagtgcacccgggcccccagcatgaccacccggggcacagccctgggccgctgcagcttcagaacagtgaccagcaccacagccactggaagtggcactggagtgcgggacaccggctgctgtgccgcccccacagccccacccaccagcagtgacccccccatctacagcagaagaaacagccgccgccaccggctgctgcccaggcaccacgagctgcgggtgggggaggcccctcctggggacctcttcagcctgagcacagctggggtcttcagcgccaacagagtgtcctgcctggccgccagcatcccctag

SEQ ID NO: 40115 - DNA, 240 bp, Artificial Sequence
  Description of Artificial Sequence: Synthetic coding sequence
atgaatggcttcggccgcctggagcacttctctggagctgtgtatgagggccagttcaaggacaacatgtttcatggcctgggcacctacaccttccccaacggggccaagtacacaggcaacttcaatgaaaatagagtggagggggagggggagtacacagacatccagggcctggagtggagcggcaacttccacttcaccgctgccccagacctgaagctgaagctgcacatgtag

SEQ ID NO: 40116 - DNA, 240 bp, Artificial Sequence; identical to SEQ ID NO: 40115
  Description of Artificial Sequence: Synthetic coding sequence

SEQ ID NO: 40117 - DNA, 240 bp, Artificial Sequence; identical to SEQ ID NO: 40115
  Description of Artificial Sequence: Synthetic coding sequence

SEQ ID NO: 40118 - DNA, 723 bp, Artificial Sequence
  Description of Artificial Sequence: Synthetic coding sequence
atgcctgtgtccaaatgtcccaagaagtctgagagcctgtggaagggctgggacaggaaggcccagagaaatggcctgcggagccaggtgtatgctgtgaatggagactactacgtgggggagtggaaggacaacgtgaagcacggcaagggcacccaggtgtggaagaagaagggggccatctatgaaggagactggaagtttgggaagagagatggctacggcaccctgagcctgcctgaccagcagacaggcaagtgccggcgggtgtacagcggctggtggaagggggacaagaagagcggctacggcatccagttcttcggccccaaggagtactatgaaggagactggtgtggcagccagaggagcggctggggccgcatgtactacagcaatggagacatctatgagggccagtgggagaatgacaagcccaatggagagggcatgctgcggctgaagaatggaaacagatatgagggctgctgggagcggggcatgaagaatggagctggccgcttcttccacctggaccacggccagctgtttgagggcttctgggtggacaacatggccaagtgtggcaccatgattgactttggaagagatgaggcccctgagcccacccagttccccatccctgaggtgaagatcctggaccctgatggagtgctggccgaggccctggccatgttcaggaagacagaggagggggactag

SEQ ID NO: 40119 - DNA, 441 bp, Artificial Sequence
  Description of Artificial Sequence: Synthetic coding sequence
atgaccctgaccaagggcagcttcacctacagcagcggggaggagtacagaggagagtggaaggagggccgccgccacggcttcggccagctgatgtttgctgatggcggcacctacctgggccactttgaaaatggcctcttcaatggatttggagtgctgaccttcagtgatggcagccgctatgaaggagaatttgcccagggcaagttcaacggggtgggcgtcttcatccgctatgacaacatgacctttgaaggagagttcaagaatggccgggtggatggcttcggcctgctgaccttcccagatggcagccacggcatccccagaaatgaaggcctgtttgagaacaacaagctgctgcggcgggagaagtgcagcgccatcgtgcagagggcccagagcgccagcaagagcgccaggaacctgacagcctag

SEQ ID NO: 40120 - DNA, 615 bp, Artificial Sequence
  Description of Artificial Sequence: Synthetic coding sequence
atggcctggagccgggccggccccatgaggtctggagtggcccctggctgcctgggcaacagccagtgggccgccggcatcgtgcccagcgctgtggcccaggatggaggagtgaagtggggcaaccgctggtggcgctggaggcgggcccgctggcagcccggggcccaccagaggaagagcccccggcgctggaacccagccagcagaagagatggccaccctgagaggcctgcccctggccgccgccacggcttcggccagctgatgtttgctgatggcggcacctacctgggccactttgaaaatggcctcttcaatggatttggagtgctgaccttcagtgatggcagccgctatgaaggagaatttgcccagggcaagttcaacggggtgggcgtcttcatccgctatgacaacatgacctttgaaggagagttcaagaatggccgggtggatggcttcggcctgctgaccttcccagatggcagccacggcatccccagaaatgaaggcctgtttgagaacaacaagctgctgcggcgggagaagtgcagcgccatcgtgcagagggcccagagcgccagcaagagcgccaggaacctgacagcctag

SEQ ID NO: 40121 - DNA, 441 bp, Artificial Sequence; identical to SEQ ID NO: 40119
  Description of Artificial Sequence: Synthetic coding sequence

SEQ ID NO: 40122 - DNA, 486 bp, Artificial Sequence
  Description of Artificial Sequence: Synthetic coding sequence
atggagtacacaggcagcaagtacatcggggagtatgtggatggccgcatggagggcaaggccaagtacatcctgcccacagagaccatctacgtgggggagatgaaggatggcatgtttcatggagagggcaccctgtacttccccagcggcagccagtatgatgccatctgggagaatggcctggccatcaagggcacctacaccttcagtgatggcctgcactatgatgagaagaactggcactactgtgatggctatgaccggcgcttctacacagagatcctgaatggcctgaagccagctggcatggcccagctgaccaacatggacccccccaggaagatccccaagggctactatgactgtggagatggcttctacaaccctgtgaccagggtggtgaaggactacagaaaccgcttcctgagaaatgctgatgatgatgaacatgagtggatcaccaggacctgcaggaagggctag

SEQ ID NO: 40123 - DNA, 333 bp, Artificial Sequence
  Description of Artificial Sequence: Synthetic coding sequence
atggagggcaaggccaagtacatcctgcccacagagaccatctacgtgggggagatgaaggatggcatgtttcatggagagggcaccctgtacttccccagcggcagccagtatgatgccatctgggagaatggcctggccatcaagggcacctacaccttcagtgatggcctgcactatgatgagaagaactggcactactgtgatggctatgaccggcgcttctacacagagatcctgaatggcctgaagccagctggcatggcccagctgaccaacatggacccccccaggaagatccccaagggctactatgactgtggagatggatag

SEQ ID NO: 40124 - DNA, 528 bp, Artificial Sequence
  Description of Artificial Sequence: Synthetic coding sequence
atggagtacacaggcagcaagtacatcggggagtatgtggatggccgcatggagggcaaggccaagtacatcctgcccacagagaccatctacgtgggggagatgaaggatggcatgtttcatggagagggcaccctgtacttccccagcggcagccagtatgatgccatctgggagaatggcctggccatcaagggcacctacaccttcagtgatggcctgcactatgatgagaagaactggcactactgtgatggctatgaccggcgcttctacacagagatcctgaatggcctgaagccagctggcatggcccagctgaccaacatggacccccccaggaagatccccaagggctactatgactgtggagatggcttctacaaccctgtgaccagggtggtgaaggactacagaaaccgcttcctgagaaatgccggccgcttcctgcccaccctgcagcacgtgttcagcagccccacctatgaatatgtgcacctgtatgtgcagatgtatgcccacacctag

SEQ ID NO: 40125 - DNA, 1416 bp, Artificial Sequence
  Description of Artificial Sequence: Synthetic coding sequence
atggccgcccctgagcccctgagccctgctgggggcgctggggaggaggcccctgaggaggatgaagatgaagctgaggccgaggaccctgagcggcccaatgctggggccggcggcggccgcagcggcggcggcggcagctctgtgtctgggggcggcggcggcggcggggccggggccggcggctgcggcggccctgggggcgccctgacccggcgggctgtgaccctgcgggtgctgctgaaggatgccctgctggagcccggggccggcgtgctgagcatctactacctgggcaagaagttcctgggggacctgcagccagatggccgcatcatgtggcaggagaccggccagaccttcaacagccccagcgcctgggccacccactgcaagaagctggtgaacccagccaagaagagcggctgcggctgggcctctgtgaagtacaagggccagaagctggacaagtacaaggccacctggctgcggctgcaccagctgcacaccccagccacagctgctgatgagagccctgccagcgagggggaggaggaggagctgctgatggaggaggaggaggaggatgtgctggccggcgtgtctgctgaggacaagagccggcggcccctgggcaagagccccagcgagcccgcccaccctgaggccaccacccctgggaagagggtggacagcaagatccgggtgcctgtgcgctactgcatgctgggcagccgggacctggccaggaacccccacaccctggtggaggtgaccagctttgctgccatcaacaagttccagcccttcaacgtggccgtgagcagcaatgtgctcttcctgctggacttccacagccacctgaccaggtctgaggtggtgggctacctgggcggccgctgggatgtgaacagccagatgctgactgtgctgcgggccttcccctgccgcagccggctgggagatgctgagacagctgctgccatcgaggaggagatctaccagagcctcttcctgcggggcctgagcctggtgggctggtaccacagccacccccacagccctgccctgcccagcctgcaggacattgatgcccagatggactaccagctgcggctgcagggcagcagcaatggcttccagccctgcctggccctgctgtgcagcccctactacagcggcaaccctggccctgagagcaagatcagccccttctgggtgatgcctcctcctgagatgctgctggtggagttctacaagggcagcccagacctggtgcggctgcaggagccctggagccaggagcacacctacctggacaagctgaagatcagcctggccagcaggacccccaaggaccagagcctgtgccacgtgctggagcaggtgtgtggggtgctgaagcagggcagctag

SEQ ID NO: 40126 - DNA, 1356 bp, Artificial Sequence
  Description of Artificial Sequence: Synthetic coding sequence
atggccgcccctgagcccctgagccctgctgggggcgctggggaggaggcccctgaggaggatgaagatgaagctgaggccgaggaccctgagcggcccaatgctggggccggcggcggccgcagcggcggcggcggcagctctgtgtctgggggcggcggcggcggcggggccggggccggcggctgcggcggccctgggggcgccctgacccggcgggctgtgaccctgcgggtgctgctgaaggatgccctgctggagcccggggccggcgtgctgagcatctactacctgggcaagaagttcctgggggacctgcagccagatggccgcatcatgtggcaggagaccggccagaccttcaacagccccagcgcctgggccacccactgcaagaagctggtgaacccagccaagaagagcggctgcggctgggcctctgtgaagtacaagggccagaagctggacaagtacaaggccacctggctgcggctgcaccagctgcacaccccagccacagctgctgatgagagccctgccagcgagggggaggaggaggagctgctgatggaggaggaggaggaggatgtgctggccggcgtgtctgctgaggacaagagccggcggcccctgggcaagagccccagcgagcccgcccaccctgaggccaccacccctgggaagagggtggacagcaagatccgggtgcctgtgcgctactgcatgctgggcagccgggacctggccaggaacccccacaccctggtggaggtgaccagctttgctgccatcaacaagttccagcccttcaacgtggccgtgagcagcaatgtgctcttcctgctgatctaccagagcctcttcctgcggggcctgagcctggtgggctggtaccacagccacccccacagccctgccctgcccagcctgcaggacattgatgcccagatggactaccagctgcggctgcagggcagcagcaatggcttccagccctgcctggccctgctgtgcagcccctactacagcggcaaccctggccctgagagcaagatcagccccttctgggtgatgcctcctcctgagcagaggcccagcgactatggcatccccatggatgtggagatggcctacgtgcaggacagcttcctgaccaatgacatcctgcacgagatgatgctgctggtggagttctacaagggcagcccagacctggtgcggctgcaggagccctggagccaggagcacacctacctggacaagctgaagatcagcctggccagcaggacccccaaggaccagagcctgtgccacgtgctggagcaggtgtgtggggtgctgaagcagggcagctag

SEQ ID NO: 40127 - DNA, 1035 bp, Artificial Sequence
  Description of Artificial Sequence: Synthetic coding sequence
tgagcctccatgctgcctgagcagctgtacttcctgcagagccccccagaggaggagcctgagtaccacccagatgccagcgcccaggagctgaatgtgcgggagagtgatgtgcgggtgtgtgatgagagcagctgcaagtatggaggagtgtgcaaggaggatggagatggcctgaagtgtgcctgccagttccagtgccacaccaactacatccctgtgtgtggcagcaatggagacacctaccagaatgaatgcttcctgcggcgggccgcctgcaagcaccagaaggagatcaccgtcatcgcccggggcccctgctacagcgacaatggaagtggcagcggggagggggaggaggagggcagcggggctgaggtgcacaggaagcacagcaaatgtggcccctgcaagtacaaggccgagtgtgatgaagatgctgaaaatgtgggctgtgtgtgcaacatcgactgcagcggctacagcttcaaccctgtgtgtgccagtgatggcagcagctacaacaacccctgctttgtgcgggaggccagctgcatcaagcaggagcagattgacatccgccacctgggccactgcacagacacagatgacaccagcctgctgggcaagaaggatgatggcctgcagtacagaccagatgtgaaggatgccagtgaccagagagaagatgtgtacatcggcaaccacatgccctgcccagagaacctgaatggctactgcatccatggaaaatgtgagttcatctacagcacccagaaggccagctgccgctgtgagagcggctacacaggccagcactgtgagaagacagacttcagcatcctgtatgtggtgcccagccggcagaagctgacccacgtgctgattgctgccatcatcggggctgtgcagatcgccatcatcgtggccatcgtgatgtgcatcaccaggaagtgccccaagaacaacagaggccggcggcagaagcagaacctgggccacttcaccagtgacaccagcagcaggatggtgtag

SEQ ID NO: 40128 - DNA, 573 bp, Artificial Sequence
  Description of Artificial Sequence: Synthetic coding sequence
ggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40129 - DNA, 1146 bp, Artificial Sequence
  Description of Artificial Sequence: Synthetic coding sequence
atggccgccttcggccggcaggtgctggactggcacaggctcatccccctgacctgggcctgcatggcccggcagaccccccacctgggggagcagaggaggaccacagccagcctgctgaggaagctgaccacagccagcaatggaggagtcatcgaggagctgagctgtgtgcgcagcaacaactacgtgcaggagcctgagtgcagaagaaacctggtgcagtgcctgctggagaagcagggcacccctgtggtgcagggcagcctggagctggagcgggtgatgagcagcctgctggacatgggcttcagcaatgcccacatcaatgagctgctgtctgtgcggcggggggccagcctgcagcagctgctggacatcatcagcgagttcatcctgctgggcctgaaccctgagcctgtgtgtgtggtgctgaagaagagcccccagctgctgaagctgcccatcatgcagatgaggaagaggagcagctacctgcagaagctgggcctgggggagggcaagctgaagagggtgctgtactgctgcccagagatcttcaccatgaggcagcaggacatcaatgacacagtgcggctgctgaaggagaagtgcctcttcaccgtgcagcaggtgaccaagatcctgcacagctgccccagcgtgctgcgggaggacctgggccagctggagtacaagttccagtatgcctacttcaggatgggcatcaagcacccagacatcgtgaagtctgagtacctgcagtacagcctgaccaagatcaagcagaggcacatctacctggagcggctgggccgctaccagaccccagacaagaagggccagacccagatccccaaccccctgctgaaggacatcctgcgggtgtctgaggccgagttcctggccaggacagcctgcacctctgtggaggagttccaggtgttcaagaagctgctggcccgggaggaggaggagagcgagagcagcaccagtgatgacaagagggccagcctggatgaagatgaagatgatgatgatgaagaagataatgatgaagatgacaatgatgaagatgatgatgatgaagatgatgatgaagcagaagataatgatgaagatgaagatgatgatgaggaggagtag

SEQ ID NO: 40130 - DNA, 75 bp, Artificial Sequence
  Description of Artificial Sequence: Synthetic coding sequence
atggccccccggggcttcagctgcctgctgctgagcaccagcgagattgacctgcctgtgaagagaagaacatag

SEQ ID NO: 40131 - DNA, 75 bp, Artificial Sequence
  Description of Artificial Sequence: Synthetic coding sequence
atgaccacccggggcttcagctgcctgctgctgctgatccgggagattgacctgagcgccaagaggcgcatctag

SEQ ID NO: 40132 - DNA, 75 bp, Artificial Sequence
  Description of Artificial Sequence: Synthetic coding sequence
atggccacccggcgcttcagctgcctgctgctgagcaccagcgagattgacctgtctgtgaagaggcgcatctag

SEQ ID NO: 40133 - DNA, 87 bp, Artificial Sequence
  Description of Artificial Sequence: Synthetic coding sequence
atggccacccagggcttcagctgcctgctgctgtctgtgtctgaaattgacctgtccatgaagaggcagtacaagcagatcagatag

SEQ ID NO: 40134 - DNA, 75 bp, Artificial Sequence
  Description of Artificial Sequence: Synthetic coding sequence
atggccaccccaggcttcagctgcctgctgctgagcaccagcgagattgacctgcccatgaagagaagagtgtag

SEQ ID NO: 40135 - DNA, 75 bp, Artificial Sequence
  Description of Artificial Sequence: Synthetic coding sequence
atgaccccccggggcttcagctgcctgctgctgcccaccagcgagacagacctgcctgtgaagagaagaacatag

SEQ ID NO: 40136 - DNA, 75 bp, Artificial Sequence
  Description of Artificial Sequence: Synthetic coding sequence
atggccactggaggcttcggctgcctgctgctgctgatccgggagattgacctgtctgtgaagaggcagatctag

SEQ ID NO: 40137 - DNA, 75 bp, Artificial Sequence
  Description of Artificial Sequence: Synthetic coding sequence
atggccccccggggcttcagctgcctgctgctgagcaccagcgagattgacctgcctgtgaagaggcgggcctag

SEQ ID NO: 40138 - DNA, 75 bp, Artificial Sequence
  Description of Artificial Sequence: Synthetic coding sequence
atggcccggcggggcttcagctgcctgctgctgagcaccacagccacagacctgcctgtgaagagaagaacatag

SEQ ID NO: 40139 - DNA, 3447 bp, Artificial Sequence
  Description of Artificial Sequence: Synthetic coding sequence
atgcccctcttcaagaacacctctgtgagcagcctgtacagcggctgccgcctgaccctgctgcggcctgagaaggatggagctgccaccagggtggatgctgtgtgcacccacaggccagaccccaagagccctggcctggaccgggagcggctgtactggaagctgagccagctgacccacggcatcacagagctgggcccctacaccctggacagacacagcctgtatgtgaatggcttcacccaccagagctccatgaccaccaccaggaccccagacaccagcaccatgcacctggccaccagcaggaccccagccagcctgagcggccccatgacagccagccccctgctggtgctcttcaccatcaacttcaccatcaccaacctgcgctatgaggagaacatgcaccaccctggcagcaggaagttcaacaccacagagcgggtgctgcagggcctgctgcggcctgtgttcaagaacacctctgtgggccccctgtacagcggctgccgcctgaccctgctgcggcccaagaaggatggagctgccaccaaggtggatgccatctgcacctacagaccagaccccaagagccctggcctggaccgggagcagctgtactgggagctgagccagctgacccacagcatcacagagctgggcccctacaccctggaccgggacagcctgtatgtgaatggcttcacccagaggagctctgtgcccaccaccagcatccctggcacccccaccgtggacctgggcaccagcggcacccctgtgtccaagccaggccccagcgctgccagccccctgctggtgctcttcaccctgaacttcaccatcaccaacctgcgctatgaggagaacatgcagcaccctggcagcaggaagttcaacaccacagagcgggtgctgcagggcctgctgcggagcctcttcaagagcacctctgtgggccccctgtacagcggctgccgcctgaccctgctgcggcctgagaaggatggaacagccaccggggtggatgccatctgcacccaccacccagaccccaagagcccccggctggaccgggagcagctgtactgggagctgagccagctgacccacaacatcacagagctgggcccctatgccctggacaatgacagcctgtttgtgaatggcttcacccacaggagctctgtgtccaccaccagcaccccaggcacccccaccgtgtacctgggcgccagcaagaccccagccagcatcttcggccccagcgctgccagccacctgctgatcctcttcaccctgaacttcaccatcaccaacctgcgctatgaggagaacatgtggccaggcagcaggaagttcaacaccacagagcgggtgctgcagggcctgctgcggcccctcttcaagaacacctctgtgggccccctgtacagcggctgccgcctgaccctgctgcggcctgagaaggatggagaggccactggagtggatgccatctgcacccacaggccagaccccaccggccctggcctggaccgggagcagctgtacctggagctgagccagctgacccacagcatcacagagctgggcccctacaccctggaccgggacagcctgtatgtgaatggcttcacccacaggagctctgtgcccaccaccagcactggagtggtgtctgaggagcccttcaccctgaacttcaccatcaacaacctgcgctacatggctgacatgggccagcccggcagcctgaagttcaacatcacagacaacgtgatgcagcacctgctgagccccctcttccagaggagcagcctgggcgcccgctacacaggctgcagggtcatcgccctgcggtctgtgaagaatggagctgagaccagggtggacctgctgtgcacctacctgcagcccctgagcggccctggcctgcccatcaagcaggtgttccacgagctgagccagcagacccacggcatcacccggctgggcccctacagcctggacaaggacagcctgtacctgaatggctacaatgaacctggcccagatgagccccccaccacccccaagccagccaccaccttcctgccccccctgtctgaggccaccacagccatgggctaccacctgaagaccctgaccctgaacttcaccatcagcaacctgcagtacagcccagacatgggcaaaggaagtgccaccttcaacagcacagaaggagtgctgcagcacctgctgcggcccctcttccagaagagctccatgggccccttctacctgggctgccagctgatcagcctgcggcctgagaaggatggagctgccactggagtggacaccacctgcacctaccacccagaccctgtgggccctggcctggacatccagcagctgtactgggagctgagccagctgacccacggcgtgacccagctgggcttctacgtgctggaccgggacagcctcttcatcaatggctacgccccccagaacctgagcatccggggggagtaccagatcaacttccacatcgtgaactggaacctgagcaacccagaccccaccagcagcgagtacatcaccctgctgcgggacatccaggacaaggtgaccaccctgtacaagggcagccagctgcatgacaccttccgcttctgcctggtgaccaacctgaccatggacagcgtgctggtgacagtgaaggccctcttcagcagcaacctggaccccagcctggtggagcaggtgttcctggacaagaccctgaatgccagcttccactggctgggcagcacctaccagctggtggacatccacgtgacagagatggagagctctgtgtaccagcccaccagcagcagcagcacccagcacttctacctgaacttcaccatcaccaacctgccctacagccaggacaaggcccagcccggcaccaccaactaccagaggaacaagaggaacattgaagatgccctgaaccagctgttcaggaacagcagcatcaagagctacttcagtgactgccaggtgtccaccttccgctctgtgcccaacagacaccacactggagtggacagcctgtgcaacttcagccccctggccaggagagtggacagagtggccatctatgaggagttcctgaggatgaccagaaatggcacccagctgcagaacttcaccctggacaggagctctgtgctggtggatggctacagccccaacagaaatgagcccctgaccggcaacagcgacctgcccttctgggccgtcatcctgattggcctggccggcctgctgggcgtcatcacctgcctgatctgtggggtgctggtgaccaccaggaggaggaagaaggagggggagtacaacgtgcagcagcagtgccccggctactaccagagccacctggacctggaggacctgcagtag

SEQ ID NO: 40140 - DNA, 750 bp, Artificial Sequence
  Description of Artificial Sequence: Synthetic coding sequence
atgaacagccagcagacccctgtgggcacccccaaggacaagagggtgagcaacacccccctgaggacagtggatggcagccccatgatgaaggccatgtacagcgtggagatcaccgtggagaaggacaaggtgactggagagaccagggtgctgagcagcaccaccctgctgccccggcagcccctgcccctgggcatcaaggtgtatgaagatgagaccaaggtggtgcatgctgtggatggaacagcagaaaatggcatccaccccctgagcagcagcgaggtggatgagctgatccacaaggcagatgaggtgaccctgtctgaggccggcagcacagctggagctgctgagaccagaggagctgtggagggcgccgcccggaccacccccagccggcgggagatcaccggggtgcaggcccagcccggggaggccaccagcggccccccaggcatccagcccggccaggagccccctgtgaccatgatcttcatgggctaccagaatgtggaggatgaggccgagaccaagaaggtgctgggcctgcaggacaccatcacagctgagctggtggtgattgaagatgctgctgagcccaaggagcccgccccacccaacggcagcgctgctgagacagaggccgccagccgggaggagaaccaggccggccctgaggccaccaccagtgacccccaggacctggacatgaagaagcaccgctgcaagtgctgcagcatcatgtag

SEQ ID NO: 40141 - DNA, 1344 bp, Artificial Sequence
  Description of Artificial Sequence: Synthetic coding sequence
acagctgctggccccctgctggtgcccttcaccctgaacttcaccatcaccaacctgcagtatgaggaggacatgcaccaccctggcagcaggaagttcaacaccacagagcgggtgctgcagggcctgctgggccccatgttcaagaacacctctgtgggcctgctgtacagcggctgccgcctgaccctgctgcggcctgagaagaatggagctgccaccggcatggatgccatctgcagccaccggctggaccccaagagccctggcctgaaccgggagcagctgtactgggagctgagccagctgacccacggcatcaaggagctgggcccctacaccctggacaggaacagcctgtatgtgaatggcttcacccacaggagctctgtggcccccaccagcaccccaggcaccagcacagtggacctgggcaccagcggcacccccagcagcctgcccagccccaccacagctgtgcccctgctggtgcccttcaccctgaacttcaccatcaccaacctgcagtatggagaggacatgaggcaccctggcagcaggaagttcaacaccacagagcgggtgctgcagggcctgctgggccccctcttcaagaacagctctgtgggccccctgtacagcggctgccgcctcatcagcctgcggtctgagaaggatggagctgccaccggggtggatgccatctgcacccaccacctgaacccccagagccctggcctggaccgggagcagctgtactggcagctgagccagatgaccaacggcatcaaggagctgggcccctacaccctggacaggaacagcctgtatgtgaatggcttcacccacaggagcagcggcctgaccaccagcaccaccggccccctgctggtgcccttcaccctgaacttcaccatcaccaacctgcagtatgaggagaacatgggccaccctggcagcaggaagttcaacatcacagagagcgtgctgcagggcctgctgaagcccctcttcaagagcacctctgtgggccccctgtacagcggctgccgcctgaccctgctgcggcctgagaaggatggagtggccaccagggtggatgccatctgcacccacaggccagaccccaagatccctggcctggaccggcagcagctgtactgggagctgagccagctgacccacagcatcacagagctgggcccctacaccctggaccgggacagcctgtatgtgaatggcttcacccagaggagctctgtgcccaccaccagcaccccaggcaccttcaccgtgcagcctgagaccagcgagacccccagcagcctgcccggccccacctag

SEQ ID NO: 40142 - DNA, 5322 bp, Artificial Sequence
  Description of Artificial Sequence: Synthetic coding sequence
atgaggcggggcaacatcagccctgccttctggttcctgtggctgctgctgtttggcctgctgggccccagcagcgagaacaccacagccttcaccaagggcagtgacaccaccacagccagcatcactggaagtgagaccaccatggccagcaccatggccagcaccagcgccctgaccaccggcagcaagatcaccacagacagcaccactggaagtgagaccaccagcgccagcaccatggccagcacagctgccttcaccactggaagtgagaccaacacagccagcaccacagattctggcaccaccatcgccagcaccaggaccttcaccactggaagtgacaccaccaccggcagcacagctggcagcgagaccatcgtggccagcaccaccgtgtctggcaccaccaccaccttcaccatcgccagcaccaccgtgcctgagaccaccatggccagcagcaccaccagcacagctggcagcgagaagaccatggccagcagcatcatcagcgagaccaccatggccagcaccactggaagtgaaacagccaccgtgtccaccactggaagtgagaccaccaccaccagcacagccagcagcgaggccaccaaggtgtccaccactggaagtgagaccaccacagccagcacagctggcagcgagaccaccaccaccagcacctccatggccggcagcgaggccaccaccaccagcacagctgacagcaaggtgatcacagccagctccatgagcagcgagaccaccgtggccccagctgctggcagcaacaccaccacagccagcaccactggaagtgagaccaccaccatcctgatcaaggccagcgagaccaccacagccagcacagctggcagcgagaccaccacccccagccccaccggcagccagaccaccatcgtgtccatcagcggcagcgagatcaccaccaccagcacagctggcagcgagaacaccaccgtgagcagcgctggcagcggcaccaccacagcctccatggccggcagcgagaccaccgtgtccacagctggcagcgagaccaccaccgtgtccatcaccggcacagagaccaccatggtgtctgccatgggcagcgagaccaccaccaacagcaccaccagcagcgagaccaccgtgaccagcacagctggcagcgagaccaccaccgtgtccacagtgggcagcgagaccaccacagcctacacagctgacagcgagaccacagctgccagcaccaccggcagcgagatgaccaccgtcttcaccgctggcagcgagaccatcacccccagcacagctggcagcgagaccaccaccgtgtccacagctggcagcgagaccaccaccgtgtccaccaccggcagcgagaccaccacagccagcacagcccacagcgagaccacagctgccagcaccatgggcagcgagaccaccaaggtgtccacagctggcagcgagaccaccgtgtccacagctggcagcgagaccacagctgccagcacagaagattctgagaccaacacagccttcacagaggacagcaagaccaccacagccagcaccactggatttgagaccacagctgccagcaccactggaagtgagcccaccatggccagcaccatgggcagcgagaccaccatggccagcaccatcggccctgagaccaccaaggtgtccacagccagcagcgaggtgaccaccgtgtttgctgctggcagcgagaccatccgggccagcacagtgggcagcgagaccaccaccgtgtccaccactggaagtgagaccaccacagccagcatcatgggcagcgagaccagcacagacagcaccactggaagtgagaccaccacagccagcacagagggcagcgagaccaccacagccagcacagagggcagcgaggccaccaccgtgtccaccactggaagtgagaccaccaccgtgtccatcacagattctgagaccaccaccacctgcacagagggcagcgagatgacagctgtgtccaccaccgtgtttgagaccaccacagccagcacagagggcagcgagatcaccatcgccagcaccagtgacagcgagaccaccacagccagcacagagggcagcgagaccaccaccgtgaccacagctggcagcgagaccaagacagcctacaccactggaagtgagaccaccacagccagcaacacaggcctggagaccaccaccgtcttcaccatcggcagtgacaccaccacagccagcacagagggcagcgagaccacagctgtgtctgccactggaagtgagatgaccaccgtgtccacagagggcagcgagaacaccaccgtgtccaccactggaagtgagaccaccaccgtgtccaccaccggcctggagaccaccaccaccagcacagagggcagcgagatgaccaccgtgtccaccactggagctgagaccaccacagacagcacagagggcagcggcaccacagctgccagcacagctggcagcgagaccaccaccgtgtccacagctgacagcgagaacaccacagccagcacagctgacagcgagaccaccagcgccagcaccactggaagtgagaccaccacagccagcaccaccagcagcgagaccaccacagccagcacagagggcagcgagaccaccaccgtgtccaccacagattctgagaccaccatggtgtccaccactggaagtgagaggaccatcaccagcacagagggcagcgagaccaccaccgtgtctgccactggaagtgagaccaccgtgtccacagagggcagcggcaccaccaccgtgtccatcaccggcagcgagaccaccaaggtgtccaccaccggcagcgagaccaccaccaccagcacagagggcagcgagatcaccacagccagcatcaccggcagcgagaccaccacagccagcacagagggcagcgagaccaccacagccagcacagagggcagcgagaccaccagcgccagcaccaccggcagcgagaccaccacagccagcaccaccagcagcgagaccaccatggccagcatcatgggcagcgagaccaccatggccagcaccatcggcagcgagaccaccaaggtgtccacagccagcagcaagatgaccaccgtcttcacagagaacagcgagaccaccatcgccagcaccacagccagcgagaccaccaccgtgtccacagctggcagcgagaccatcccagccagcacagctggcagcgagaccaccaccaccaccagcacagagggcagcgagaccaccacagccagcacagagggcagcgagaccaccacagccagcacagagagcagcgagaccaccacagccaccaccatcggcagcgagaccaccacagccagcacagagggcagcgagaccaccaccaccagcacagagggcagcgagaccaccacagccagcacagagggcagcgagatcaccaccgtgtccaccactggaagtgagaccaccacagccagcacagagggcagcgagaccaccacagccagcacagagggcagcgagctgaccaccgtgtccaccactggaagtgagaccatcaccgtgtctgctgagggcagcgagaccaccaccgtgaccaccatgggcagcgagaccaccacagccagcacagctggcagcgagaccaccaccgtgtccacagctggcagcgagaccaccacagccagcattgagggcagcgagaccaccaccgtgagcagcactggaagtgagaccaccaccgtgtccaccactggaacagagaccaccatcaccagcacagagggcagcgagaccaccaccgtgaccacagctggcagcgagaccacagctgtgtacaccactggaagtgagaccaccaccaccagcacagagggcagcgagaccaccaccgtgtccaccactggaagtgagaccaccacagccagcacagctgacctggagaccaccaccgtgtccaccagcggcagcggcaccaccacagccagcacagctggcagcgagaccaccaccgtgtacatcaccggcagcaagaccaccacagccagcacagagggcagcgaggccaccaccgtgtccaccaccagcagcgagaccaccacagccagcaccactggaagtgagatgaccaccgtcttcaccaccgtgtctgagaccaccaccgtgtccaccatcggcagcgaggccaccaccagcagcgctgctggcagcgaggccaccaccaccagcacagagggcagcgagaccaccacagccagcacagctggcagcgagaccaccacagccagcacagctggcagcgagaccaccacagccagcaccagcggcagcgagaccaacacagcctgcaccactggaagtgagaccagcacccccagcagcgctggcagcgagaccaacacagccttcatcatcggcagcgagagcaccatcgccagcacagccagcctggagcccacagccaccagcctgactggaagtgagaccaccaccgtgtccatcacagccagcggggccacagctgccagcaccaccgtgagcagcaccacctttgtgctgaccaaggccacagatgtgtccatccagcccatcaccaacacccccatgagcggcaccaggaccaccggcacccggctgacagccagcagctctgtgaccatggcccctggcatggacttcaccgccagcgctgccagccacacagtgcccggcatcgtgctgaacaccagcggcctgggcaccagcaccatgggcgccagcagcaccaccagcgcccacggcgtgaggaccaccaccggcagcacccgggagcccaccagcagcaccttccaggagaccggccctgtgtccatgggcaccaacacagtgtccatgagccacacccccaccaacgtcatcaagcccagcggctacctgcagccctgggccatcatcctgatcagcctggccgctgtggtggccgctgtgggcctgtctgtgggcctgtccttctgcctgaggaacctcttcttccccctgcgctactgcggcatctactacccccacggccacagccacagcctgggcctggacctgaacctgggcctgggcagcggcaccttccacagcctgggcaatgccctggtgcatggaggagagctggagatgggccatggaggcacccacggcttcggctatggagtgggccacggcctgagccacatccatggagatggctatggagtgaaccacggcggccactacggccatggaggcggccactag

SEQ ID NO: 40143 - DNA, 1701 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgagagcagcacccccagcagcggggccggcacagccaccaacagcgagagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgacagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 40144 - DNA, 1701 bp, Artificial Sequence; identical to SEQ ID NO: 40143
  Description of Artificial Sequence: Synthetic coding sequence

SEQ ID NO: 40145 - DNA, 1701 bp, Artificial Sequence; identical to SEQ ID NO: 40143
  Description of Artificial Sequence: Synthetic coding sequence

SEQ ID NO: 40146 - DNA, 1251 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 40147 - DNA, 1251 bp, Artificial Sequence; identical to SEQ ID NO: 40146
  Description of Artificial Sequence: Synthetic coding sequence

SEQ ID NO: 40148 - DNA, 1251 bp, Artificial Sequence; identical to SEQ ID NO: 40146
  Description of Artificial Sequence: Synthetic coding sequence

SEQ ID NO: 40149 - DNA, 471 bp, Artificial Sequence
  Description of Artificial Sequence: Synthetic coding sequence
acagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40150 - DNA, 1206 bp, Artificial Sequence
  Description of Artificial Sequence: Synthetic coding sequence
atgtggcctgtgctgctgtttgtgttcctgagccagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40151 - DNA, 1491 bp, Artificial Sequence
  Description of Artificial Sequence: Synthetic coding sequence
actgtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40152 - DNA, 2187 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40153 - DNA, 585 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagatag

SEQ ID NO: 40154 - DNA, 1002 bp, Artificial Sequence
  Description of Artificial Sequence: Synthetic coding sequence
aagatcctcttcctgagcagcatcatcccctttgactgcctgctgactgtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtgtacctgagcccccaggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggctag

SEQ ID NO: 40155 - DNA, 471 bp, Artificial Sequence; identical to SEQ ID NO: 40149
  Description of Artificial Sequence: Synthetic coding sequence

SEQ ID NO: 40156 - DNA, 2184 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40157 - DNA, 1527 bp, Artificial Sequence
  Description of Artificial Sequence: Synthetic coding sequence
atgtggcctgtgctgctgtttgtgttcctgagccagacagtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgaaggagtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40158 - DNA, 408 bp, Artificial Sequence
  Description of Artificial Sequence: Synthetic coding sequence
ggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40159 - DNA, 1494 bp, Artificial Sequence
  Description of Artificial Sequence: Synthetic coding sequence
actgtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtgtgagggcgtggccaaggccagccacgccagccacacagctgcccaggccggcctgcctgacaagctggtggcccggggcaaggaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40160 - DNA, 585 bp, Artificial Sequence; identical to SEQ ID NO: 40153
  Description of Artificial Sequence: Synthetic coding sequence

SEQ ID NO: 40161 - DNA, 1404 bp, Artificial Sequence
  Description of Artificial Sequence: Synthetic coding sequence
actgtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40162 - DNA, 198 bp, Artificial Sequence
  Description of Artificial Sequence: Synthetic coding sequence
acagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40163 - DNA, 348 bp, Artificial Sequence
  Description of Artificial Sequence: Synthetic coding sequence
attgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatggtgcggcccagcacctctgtgaggtag

SEQ ID NO: 40164 - DNA, 1491 bp, Artificial Sequence; identical to SEQ ID NO: 40151
  Description of Artificial Sequence: Synthetic coding sequence

SEQ ID NO: 40165 - DNA, 477 bp, Artificial Sequence
  Description of Artificial Sequence: Synthetic coding sequence
catgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagaaacccccagcagatgcccctgtag

SEQ ID NO: 40166 - DNA, 477 bp, Artificial Sequence
  Description of Artificial Sequence: Synthetic coding sequence
actgtgtacagcgccctgggcctgagagatgcctgccgcagcctgccccagagcatccagctgttccgggacatcgcccaggagttcagtgatgacctgcaccacatcgccagcctcatcggcaaggtgtacctgagcccccaggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggctag

SEQ ID NO: 40167 - DNA, 2238 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccccacctggggacctgcgcttcacccccatccccctgctgatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgcggctgtggttcacccggcccacccatgacctgggggagctgagcagccggctggatgtgatccagttcttcctgctgccccagaacctggacatggcccagatgctgcaccggctgctgggccacatcaagaatgtgcccctcatcctgaagaggatgaagctgagccacaccaaggtgtctgactggcaggtgctgtacaagacagtgtacagcgccctgggcctgagagatgcctgccgcagcctgccccagagcatccagctgttccgggacatcgcccaggagttcagtgatgacctgcaccacatcgccagcctgattggcaaggtggtggactttgagggcagcctggctgaaaatcgcttcaccgtgctgcccaacatcgaccctgagattgatgagaagaagaggcggctgatgggcctgcccagcttcctgacagaggtggccaggaaggagctggagaacctggacagccgcatccccagctgcagcgtcatctacatccccctcatcggcttcctgctgagcatcccccggctgcccagcatggtggaggccagtgactttgagatcaatggcctggacttcatgttcctgtctgaggagaagctgcactacagaagtgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagatcggggctgtggatgccatcttcacccgcatccacagctgtgagagcatcagcctgggcctgagcaccttcatgattgacctgaaccagcaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgtag

SEQ ID NO: 40168 - DNA, 2184 bp, Artificial Sequence; identical to SEQ ID NO: 40156
  Description of Artificial Sequence: Synthetic coding sequence

SEQ ID NO: 40169 - DNA, 1401 bp, Artificial Sequence
  Description of Artificial Sequence: Synthetic coding sequence
actgtgtacagcgccctgggcctgagagatgcctgccgcagcctgccccagagcatccagctgttccgggacatcgcccaggagttcagtgatgacctgcaccacatcgccagcctcatcggcaaggtggtggactttgagggcagcctggccgagaaccgcttcaccgtgctgcccaacattgatcctgagattgatgagaagaagaggcggctgatgggcctgcccagcttcctgacagaggtggccaggaaggagctggagaacctggacagccgcatccccagctgcagcgtcatctacatccccctgattggcttcctgctgagcatcccccggctgcccagcatggtggaggccagtgactttgagatcaatggcctggacttcatgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctgaccatggagacctgtgaagatggaaatgacctggtgttcttctaccaggtgtctgacctgatccgcagcggcaagcccatcaagcctgtgaaggacctgctgaagaagaaccagatggagaactgccagaccctggtggacaagttcatgaagctggacctggaggaccccaacctggacctgaatgtgttcatgagccaggaggtgctgcctgctgccaccagcatcctgtag

SEQ ID NO: 40170 - DNA, 765 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctaccgcctggagtgcaatggagccatcagcgcccagtgcaacctgtgcctgctgggcagcagtgacagccctgccagcgccagctag

SEQ ID NO: 40171 - DNA, 792 bp, Artificial Sequence
  Description of Artificial Sequence: Synthetic coding sequence
cactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctggactggccccgggtgtctggccaggagggcggggactag

SEQ ID NO: 40172 - DNA, 480 bp, Artificial Sequence
  Description of Artificial Sequence: Synthetic coding sequence
atgcagaacaatgagatcatcaagccagccaagtacttcagcgagctggagaagagcatcctgctggccctggtggagaagtacaagtatgtgctggagtgcaagaagagtgatgcccggaccatcgccctgaagcagaggacctggcaggccctggcccacgagtacaacagccagcccagcgtgtccctgcgggacttcaagcagctgaagaagtgctgggagaacatcaaggcccggaccaagaagatcatggcccatgaaagaagagagaaggtgaagaggtctgtgagccccctgctgagcacccacgtgctgggcaaggagaagatcgcctccatgctgcctgagcagctgtacttcctgcagagccccccagaggaggagcctgagtaccacccagatgccagcgcccaggtgttcttccaggagaggaagaggagcctggagctgagcatcatcctgagcggcacctggtag

SEQ ID NO: 40173 - DNA, 924 bp, Artificial Sequence
  Description of Artificial Sequence: Synthetic coding sequence
atgggcagcaccatggagcccccaggaggagcctacctgcacctgggcgctgtgaccagccctgtgggcacagcccgggtgctgcagctggccttcggctgcaccaccttcagcctggtggcccaccggggcggctttgctggggtgcagggcaccttctgcatggccgcctggggcttctgctttgctgtgtctgccctggtggtggcctgtgagttcacccggctgcacggctgcctgcggctgtcctggggcaacttcaccgctgcctttgccatgctggccaccctgctgtgtgccacagctgctgtgctgtaccccctgtactttgcccggcgggagtgcagccctgagcccgccggctgtgccgcccgggacttccggctggccgcctctgtgtttgctggcctgctcttcctggcctatgctgtggaggtggccctgacccgggcccggcccggccaggtgagcagctacatggccaccgtgtctggcctgctgaagatcgtgcaggcctttgtggcctgcatcatctttggagccctggtgcatgacagccgctatggccgctacgtggccacccagtggtgtgtggccgtgtacagcctgtgcttcctggccaccgtggccgtggtggccctgtctgtgatgggccacactggaggcctgggctgcccctttgaccggctggtggtggtgtacaccttcctggccgtgctgctgtacctgtctgctgctgtgatctggcctgtgttctgctttgaccccaagtacggggagcccaagaggcctcccaactgtgcccggggcagctgcccctgggacagccagctggtggtggccatcttcacctacgtgaacctgctgctgtatgtggtggacctggcctacagccagaggatccgctttgtgcccagcctgtag

SEQ ID NO: 40174 - DNA, 924 bp, Artificial Sequence; identical to SEQ ID NO: 40173
  Description of Artificial Sequence: Synthetic coding sequence

SEQ ID NO: 40175 - DNA, 759 bp, Artificial Sequence
  Description of Artificial Sequence: Synthetic coding sequence
atgtggagggcccctgaggccgccctgcggcctgaggtgtccctggagcggcggggccctgagatgaagccagctgtggatgagatgtttcctgagggcgccggcccctacgtggacctggatgaggtggcccgggcccggcgggagagccccagcgctgggggcagcacaggcctgctgatggacctggccgccaatgagaaggctgtgcacgccgacttcttcaatgactttgaggacctgtttgatgatgatgacatccacagcagcggcctgcccaggaccagccagcagagctccatggtgcctgccctgcagaggggccagagcgagcacggcgtgcggggcaaggctgctgagaggcctgtggtgtctgaggagcgctgtgagctgaatggccgggaggtggccgccctggaccgggccttcggcagcacaggccacggccagggcgctgaggccctgatgttcacccgctgccgggagcaccccctgtgtggcaccaacaaggccaccagcgagggcaagatgggcaccggccgcctgaggaacagcctgaggaagaaccagagcaagtggctgggcagctacctggaggtgctgcggaccaccaggagcagaagagaggtgtctgaggacagcaccatctctgtgtccacccactggaggggcaagtgcttcaagagtgatgagacccccagcgtggccggcggggaggagggcaagaagaccacccagccctgcattgatgtgaggtag

SEQ ID NO: 40176 - DNA, 237 bp, Artificial Sequence
  Description of Artificial Sequence: Synthetic coding sequence
atgtggagggcccctgaggccgccctgcggcctgaggtgtccctggagcggcggggccctgagatgaagccagctgtggatgagatgtttcctgagggcgccggcccctacgtggacctggatgaagctgggggcagcacaggcctgctgatggacctggccgccaatgagaaggctgtgcacgccgacttcttcaatgactttgaggacctgtttgatgatgatgacatccagtag

SEQ ID NO: 40177 - DNA, 3645 bp, Artificial Sequence
  Description of Artificial Sequence: Synthetic coding sequence
atgaccctgccccacagcctgggcggggccggggaccccaggcctccccaggccatggaggtgcaccggctggagcaccggcaggaggaggagcagaaggaggagcggcagcacagcctgaggatgggcagctctgtgagaagaaggaccttccgcagcagcgaggaggagcacgagttctctgctgctgactatgccctggccgccgccctggccctgacagccagcagcgagctgtcctgggaggcccagctgcggcggcagaccagcgctgtggagctggaggagcggggccagaagagggtgggctttggaaatgactgggagaggacagaaattgccttcctgcagacccaccggctgctgcggcagaggcgggactggaagaccctgcggaggagaacagaggagaaggtgcaggaggccaaggagctgcgggagctgtgctacggccggggcccctggttctggatccccctgcggagccatgctgtgtgggagcacaccaccgtgctgctgacctgcaccgtgcaggccagccccccaccccaggtgacctggtacaagaatgacaccagaattgaccccaggctcttccgggccggcaagtaccgcatcaccaacaactacggcctgctgagcctggagatccgccgctgtgccattgaagattctgccacctacacagtgcgggtgaagaatgcccacggccaggccagcagctttgccaaggtgctggtgaggacctacctgggcaaggatgctggctttgattctgagatcttcaagaggagcaccttcggccccagcgtggagttcacctctgtgctgaagcctgtgtttgcccgggagaaggagcccttcagcctgagctgcctcttctctgaagatgtgctggatgctgagagcatccagtggttcagagatggcagcctgctgcggagcagcagaagaaggaagatcctgtacacagaccggcaggccagcctgaaggtgtcctgcacctacaaggaggatgagggcctgtacatggtgcgggtgcccagccccttcggcccccgggagcagagcacctacgtgctggtgagagatgctgaggccgagaaccctggggcccctggcagccccctgaatgtgcgctgcctggatgtgaacagagactgcctgatcctgacctgggcccccccaagtgacacccggggcaaccccatcacagcctacaccatcgagcgctgccagggcgagagcggggagtggatcgcctgccacgaggcccctgggggcacctgccgctgccccatccagggcctggtggagggccagagctaccgcttccgggtgcgggccatcagccgggtgggcagctctgtgcccagcaaggccagcgagctggtggtgatgggagaccatgatgctgcccggaggaagacagagatcccctttgacctgggcaacaagatcaccatcagcacagatgcctttgaagatactgtgaccatccccagcccccccaccaacgtgcacgccagcgagatccgggaggcctacgtggtgctggcctgggaggagcccagcccccgggaccgggcccccctgacctacagcctggagaagtctgtgattggcagcggcacctgggaggccatcagcagcgagagccctgtgcgcagccccaggtttgctgtgctggacctggagaagaagaagagctatgtgttccgggtgcgggccatgaaccagtatggcctgagtgaccccagcgagcccagcgagcccatcgccctgcggggccccccagccaccctgcccccaccagcccaggtgcaggccttccgggacacccagacctctgtgtccctgacctgggaccctgtgaaggaccctgagctgctgggctactacatctacagcaggaaggtgggcaccagcgagtggcagacagtgaacaacaagcccatccagggcacccgcttcaccgtgcccggcctgaggacaggcaaggagtatgagttctgtgtgcgctctgtgtctgaggccggcgtgggggagagcagcgctgccacagagcccatccgggtgaagcaggccctggccaccccatctgccccctacggctttgccctgctgaactgtgggaagaatgagatggtgattggctggaagccacccaagagaagaggaggcggcaagatcctgggctacttcctggaccagcatgattctgaggagctggactggcatgctgtgaaccagcagcccatccccaccagggtgtgcaaggtgtctgacctgcacgagggccacttctatgagttccgggcccgggccgccaactgggccggcgtgggggagctgagcgcccccagcagcctgtttgagtgcaaggagtggaccatgccccagcccggccccccctatgatgtgcgggccagcgaggtgcgggccaccagcctggtgctgcagtgggagccccccctgtacatgggcgccggccctgtgacaggctaccacgtgtccttccaggaggagggcagcgagcagtggaagcctgtgaccccaggccccatcagcggcacccacctgcgggtgtctgacctgcagcccgggaagagctatgtgttccaggtgcaggccatgaacagcgctggcctgggccagcccagcatgcccacagatcctgtgctgctggaggacaagccaggggcccatgaaattgaggtgggcgtggatgaggagggcttcatctacctggcctttgaggcccctgaggccccagacagcagcgagttccagtggagcaaggactacaagggccccctggacccccagagggtgaagattgaggacaaggtgaacaagagcaaggtgatcctgaaggagcccggcctggaggacctgggcacctacagcgtcatcgtgacagatgctgatgaggacatcagcgccagccacaccctgacagaggaggagctggagaagctgaagaagctgagccatgagatccggaaccctgtgatcaagctgatcagcggctggaacatcgacatcctggagcggggggaggtgcggctgtggctggaggtggagaagctgagccctgctgctgagctgcacctgatcttcaacaacaaggagatcttcagcagccccaacaggaagatcaactttgaccgggagaagggcctggtggaggtgatcatccagaacctgtctgaagaagataaaggcagctacacagcccagctgcaggacggcaaggccaagaaccagatcaccctgaccctggtggatgatgactttgacaagctgctgaggaaggcagatgccaagagaagagactggaagaggaagcagggcccctactttgagcggcccctgcagtggaaggtgacagaggactgccaggtgcagctgacctgcaaggcctctgtgaccaacaccaagaaggagacccgcttccagtggttcttccagagagctgagatgccagatggccagtatgaccctgagactggaacaggcctgctgtgcatcgaggaggcctctgtggccccagccagcggcctgaccttctcctttggctgcaagccaggccgggccaagagcagcggcctgggcgtgcgggccggcccccggctgggctag

SEQ ID NO: 40178 - DNA, 4323 bp, Artificial Sequence
  Description of Artificial Sequence: Synthetic coding sequence
atgaccctgccccacagcctgggcggggccggggaccccaggcctccccaggccatggaggtgcaccggctggagcaccggcaggaggaggagcagaaggaggagcggcagcacagcctgaggatgggcagctctgtgagaagaaggaccttccgcagcagcagcgaggaggagcacgagttctctgctgctgactatgccctggccgccgccctggccctgacagccagcagcgagctgtcctgggaggcccagctgcggcggcagaccagcgctgtggagctggaggagcggggccagaagagggtgggctttggaaatgactgggagaggacagagatcgccttcctgcagacccaccggctgctgcggcagaggcgggactggaagaccctgcggcggaggacagaggagaaggtgcaggaggccaaggagctgcgggagctgtgctacggccggggcccctggttctggatccccctgcggagccatgctgtgtgggagcacaccaccgtgctgctgacctgcaccgtgcaggccagccccccaccccaggtgacctggtacaagaatgacaccagaattgaccccaggctcttccgggccggcaagtaccgcatcaccaacaactacggcctgctgagcctggagatcagaagatgtgccatcgaggacagcgccacctacacagtgcgggtgaagaatgcccacggccaggccagcagctttgccaaggtgctggtgaggacctacctgggcaaggatgctggctttgacagcgagatcttcaagaggagcaccttcggccccagcgtggagttcacctctgtgctgaagcctgtgtttgcccgggagaaggagcccttcagcctgagctgcctcttctctgaagatgtgctggatgctgagagcatccagtggttcagagatggcagcctgctgcggagcagcagaagaaggaagatcctgtacacagaccggcaggccagcctgaaggtgtcctgcacctacaaggaggatgagggcctgtacatggtgcgggtgcccagccccttcggcccccgggagcagagcacctacgtgctggtgagagatgctgaggctgaaaatcctggggcccctggcagccccctgaatgtgcgctgcctggatgtgaacagagactgcctgatcctgacctgggccccacccagcgacacccggggcaaccccatcacagcctacaccatcgagcgctgccagggcgagagcggggagtggatcgcctgccacgaggcccctgggggcacctgccgctgccccatccagggcctggtggagggccagagctaccgcttccgggtgcgggccatcagccgggtgggcagctctgtgcccagcaaggccagcgagctggtggtgatgggagaccatgatgctgcccggaggaagacagagatcccctttgacctgggcaacaagatcaccatcagcacagatgcctttgaggacacagtgaccatccccagcccccccaccaacgtgcacgccagcgagatccgggaggcctacgtggtgctggcctgggaggagcccagcccccgggaccgggcccccctgacctacagcctggagaagagcgtcatcggcagcggcacctgggaggccatcagcagcgagagccctgtgcgcagccccaggtttgctgtgctggacctggagaagaagaagagctatgtgttccgggtgcgggccatgaaccagtatggcctgagtgaccccagcgagcccagcgagcccatcgccctgcggggccccccagccaccctgcccccaccagcccaggtgcaggccttccgggacacccagacctctgtgtccctgacctgggaccctgtgaaggaccctgagctgctgggctactacatctacagcaggaaggtgggcaccagcgagtggcagacagtgaacaacaagcccatccagggcacccgcttcaccgtgcccggcctgaggacaggcaaggagtatgagttctgtgtgcgctctgtgtctgaggccggcgtgggggagagcagcgctgccacagagcccatccgggtgaagcaggccctggccacccccagcgccccctacggctttgccctgctgaactgtgggaagaatgagatggtgattggctggaagccacccaagaggcggggcggcggcaagatcctgggctacttcctggaccagcacgacagcgaggagctggactggcatgctgtgaaccagcagcccatccccaccagggtgtgcaaggtgtctgacctgcacgagggccacttctatgagttccgggcccgggccgccaactgggccggcgtgggggagctgagcgcccccagcagcctgtttgagtgcaaggagtggaccatgccccagcccggccccccctatgatgtgcgggccagcgaggtgcgggccaccagcctggtgctgcagtgggagccccccctgtacatgggcgccggccctgtgacaggctaccacgtgtccttccaggaggagggcagcgagcagtggaagcctgtgaccccaggccccatcagcggcacccacctgcgggtgtctgacctgcagcccgggaagagctatgtgttccaggtgcaggccatgaacagcgctggcctgggccagcccagcatgcccacagatcctgtgctgctggaggacaagccaggggcccacgagattgaggtgggcgtggatgaggagggcttcatctacctggcctttgaggcccctgaggccccagacagcagcgagttccagtggagcaaggactacaagggccccctggacccccagagggtgaagattgaggacaaggtgaacaagagcaaggtgatcctgaaggagcccggcctggaggacctgggcacctacagcgtgattgtgacagatgctgatgaggacatcagcgccagccacaccctgacagaggaggagctggagaagctgaagaagctgagccatgagatcagaaatcctgtgatcaagctgatcagcggctggaacatcgacatcctggagcggggggaggtgcggctgtggctggaggtggagaagctgagccctgctgctgagctgcacctgatcttcaacaacaaggagatcttcagcagccccaacaggaagatcaactttgaccgggagaagggcctggtggaggtgatcatccagaacctgtctgaggaggacaagggcagctacacagcccagctgcaggacggcaaggccaagaaccagatcaccctgaccctggtggatgatgactttgacaagctgctgaggaaggcagatgccaagaggcgggactggaagaggaagcagggcaccggcccctactttgagcggcccctgcagtggaaggtgacagaggactgccaggtgcagctgacctgcaaggtgaccaacaccaagaaggagacccgcttccagtggttcttccagagagctgagatgccagatggccagtatgaccctgagaccggcaccggcctgctgtgcatcgaggagctgagcaagaaggacaagggcatctaccgggccatggtgtctgatgacagaggagaagatgacaccatcctggacctgactggagatgccctggatgccatcttcacagagctgggccgcatcggggccctgagcgccacccccctgaagatccagggcacagaggagggcatccgcatcttcagcaaggtgaagtactacaacgtggagtacatgaagaccacctggttccacaaggacaagaggctggagagcggggaccgcatcagaacaggcaccaccctggatgagatctggctgcacatcctggaccccaaggacagcgacaagggcaagtacaccctggagattgctgctgggaaggaggtgcggcagctgagcacagacctgagcggccaggcctttgaagatgccatggccgagcaccagaggctgaagaccctggccatcatcgagaagaacagagccaaggtggtgcggggcctgcctgatgtggccaccatcatggaggacaagaccctgtgcctgacctgcatcgtgtctggggaccccaccccagagatctcctggctgaagaatgaccagcctgtgaccttcctggaccgctacaggatggaggtgcggggcacagaggtgaccatcaccatcgagaaggtgaacagtgaagattctggccgctatggagtgtttgtgaagaacaagtatggcagcgagaccggccaggtgaccatcagcgtcttcaagcatggagatgagcccaaggagctgaagtccatgtag

SEQ ID NO: 40179 - DNA, 993 bp, Artificial Sequence
  Description of Artificial Sequence: Synthetic coding sequence
atggacatcagcaagaagaacagagtgcggcagggcagccggggccggggcaagaccatcagcaagaacagcgagagccggggccagcagaggaggcacatggtgaccaacaccaagaaggagacccgcttccagtggttcttccagagagctgagatgccagatggccagtatgaccctgagaccggcaccggcctgctgtgcatcgaggagctgagcaagaaggacaagggcatctaccgggccatggtgtctgatgacagaggagaagatgacaccatcctggacctgactggagatgccctggatgccatcttcacagagctgggccgcatcggggccctgagcgccacccccctgaagatccagggcacagaggagggcatccgcatcttcagcaaggtgaagtactacaacgtggagtacatgaagaccacctggttccacaaggacaagaggctggagagcggggaccgcatcagaacaggcaccaccctggatgagatctggctgcacatcctggaccccaaggacagcgacaagggcaagtacaccctggagattgctgctgggaaggaggtgcggcagctgagcacagacctgagcggccaggcctttgaagatgccatggccgagcaccagaggctgaagaccctggccatcatcgagaagaacagagccaaggtggtgcggggcctgcctgatgtggccaccatcatggaggacaagaccctgtgcctgacctgcatcgtgtctggggaccccaccccagagatctcctggctgaagaatgaccagcctgtgaccttcctggaccgctacaggatggaggtgcggggcacagaggtgaccatcaccatcgagaaggtgaacagtgaagattctggccgctatggagtgtttgtgaagaacaagtatggcagcgagaccggccaggtgaccatcagcgtcttcaagcatggagatgagcccaaggagctgaagtccatgtag

SEQ ID NO: 40180 - DNA, 4314 bp, Artificial Sequence
  Description of Artificial Sequence: Synthetic coding sequence
atgaccctgccccacagcctgggcggggccggggaccccaggcctccccaggccatggaggtgcaccggctggagcaccggcaggaggaggagcagaaggaggagcggcagcacagcctgaggatgggcagctctgtgagaagaaggaccttccgcagcagcgaggaggagcacgagttctctgctgctgactatgccctggccgccgccctggccctgacagccagcagcgagctgtcctgggaggcccagctgcggcggcagaccagcgctgtggagctggaggagcggggccagaagagggtgggctttggaaatgactgggagaggacagaaattgccttcctgcagacccaccggctgctgcggcagaggcgggactggaagaccctgcggaggagaacagaggagaaggtgcaggaggccaaggagctgcgggagctgtgctacggccggggcccctggttctggatccccctgcggagccatgctgtgtgggagcacaccaccgtgctgctgacctgcaccgtgcaggccagccccccaccccaggtgacctggtacaagaatgacaccagaattgaccccaggctcttccgggccggcaagtaccgcatcaccaacaactacggcctgctgagcctggagatccgccgctgtgccattgaagattctgccacctacacagtgcgggtgaagaatgcccacggccaggccagcagctttgccaaggtgctggtgaggacctacctgggcaaggatgctggctttgattctgagatcttcaagaggagcaccttcggccccagcgtggagttcacctctgtgctgaagcctgtgtttgcccgggagaaggagcccttcagcctgagctgcctcttctctgaagatgtgctggatgctgagagcatccagtggttcagagatggcagcctgctgcggagcagcagaagaaggaagatcctgtacacagaccggcaggccagcctgaaggtgtcctgcacctacaaggaggatgagggcctgtacatggtgcgggtgcccagccccttcggcccccgggagcagagcacctacgtgctggtgagagatgctgaggccgagaaccctggggcccctggcagccccctgaatgtgcgctgcctggatgtgaacagagactgcctgatcctgacctgggcccccccaagtgacacccggggcaaccccatcacagcctacaccatcgagcgctgccagggcgagagcggggagtggatcgcctgccacgaggcccctgggggcacctgccgctgccccatccagggcctggtggagggccagagctaccgcttccgggtgcgggccatcagccgggtgggcagctctgtgcccagcaaggccagcgagctggtggtgatgggagaccatgatgctgcccggaggaagacagagatcccctttgacctgggcaacaagatcaccatcagcacagatgcctttgaagatactgtgaccatccccagcccccccaccaacgtgcacgccagcgagatccgggaggcctacgtggtgctggcctgggaggagcccagcccccgggaccgggcccccctgacctacagcctggagaagtctgtgattggcagcggcacctgggaggccatcagcagcgagagccctgtgcgcagccccaggtttgctgtgctggacctggagaagaagaagagctatgtgttccgggtgcgggccatgaaccagtatggcctgagtgaccccagcgagcccagcgagcccatcgccctgcggggccccccagccaccctgcccccaccagcccaggtgcaggccttccgggacacccagacctctgtgtccctgacctgggaccctgtgaaggaccctgagctgctgggctactacatctacagcaggaaggtgggcaccagcgagtggcagacagtgaacaacaagcccatccagggcacccgcttcaccgtgcccggcctgaggacaggcaaggagtatgagttctgtgtgcgctctgtgtctgaggccggcgtgggggagagcagcgctgccacagagcccatccgggtgaagcaggccctggccaccccatctgccccctacggctttgccctgctgaactgtgggaagaatgagatggtgattggctggaagccacccaagagaagaggaggcggcaagatcctgggctacttcctggaccagcatgattctgaggagctggactggcatgctgtgaaccagcagcccatccccaccagggtgtgcaaggtgtctgacctgcacgagggccacttctatgagttccgggcccgggccgccaactgggccggcgtgggggagctgagcgcccccagcagcctgtttgagtgcaaggagtggaccatgccccagcccggccccccctatgatgtgcgggccagcgaggtgcgggccaccagcctggtgctgcagtgggagccccccctgtacatgggcgccggccctgtgacaggctaccacgtgtccttccaggaggagggcagcgagcagtggaagcctgtgaccccaggccccatcagcggcacccacctgcgggtgtctgacctgcagcccgggaagagctatgtgttccaggtgcaggccatgaacagcgctggcctgggccagcccagcatgcccacagatcctgtgctgctggaggacaagccaggggcccatgaaattgaggtgggcgtggatgaggagggcttcatctacctggcctttgaggcccctgaggccccagacagcagcgagttccagtggagcaaggactacaagggccccctggacccccagagggtgaagattgaggacaaggtgaacaagagcaaggtgatcctgaaggagcccggcctggaggacctgggcacctacagcgtcatcgtgacagatgctgatgaggacatcagcgccagccacaccctgacagaggaggagctggagaagctgaagaagctgagccatgagatccggaaccctgtgatcaagctgatcagcggctggaacatcgacatcctggagcggggggaggtgcggctgtggctggaggtggagaagctgagccctgctgctgagctgcacctgatcttcaacaacaaggagatcttcagcagccccaacaggaagatcaactttgaccgggagaagggcctggtggaggtgatcatccagaacctgtctgaagaagataaaggcagctacacagcccagctgcaggacggcaaggccaagaaccagatcaccctgaccctggtggatgatgactttgacaagctgctgaggaaggcagatgccaagagaagagactggaagaggaagcagggcccctactttgagcggcccctgcagtggaaggtgacagaggactgccaggtgcagctgacctgcaaggtgaccaacaccaagaaggagacccgcttccagtggttcttccagagagctgagatgccagatggccagtatgaccctgagactggaacaggcctgctgtgcatcgaggagctgagcaagaaggacaagggcatctaccgggccatggtgtctgatgacagaggagaagatgacaccatcctggacctgactggagatgccctggatgccatcttcacagagctgggcagaattggagccctgagcgccacccccctgaagatccagggcacagaggagggcatccgcatcttcagcaaggtgaagtactacaacgtggagtacatgaagaccacctggttccacaaggacaagaggctggagagcggggaccgcatcagaacaggcaccaccctggatgagatctggctgcacatcctggaccccaaggacagcgacaagggcaagtacaccctggagattgctgctgggaaggaggtgcggcagctgagcacagacctgagcggccaggcctttgaagatgccatggccgagcaccagaggctgaagaccctggccatcatcgagaagaacagagccaaggtggtgcggggcctgcctgatgtggccaccatcatggaggacaagaccctgtgcctgacctgcatcgtgtctggggaccccaccccagagatctcctggctgaagaatgaccagcctgtgaccttcctggaccgctacaggatggaggtgcggggcacagaggtgaccatcaccatcgagaaggtgaacagcgaggacagcggccgctatggagtgtttgtgaagaacaagtatggcagcgagaccggccaggtgaccatctctgtgttcaagcatggagatgagcccaaggagctgaagtccatgtag

SEQ ID NO: 40181 - DNA, 996 bp, Artificial Sequence
  Description of Artificial Sequence: Synthetic coding sequence
atggacatcagcaagaagaacagagtgcggcagggcagccggggccggggcaagaccatcagcaagaacagcgagagccggggccagcagaggaggcacatggtgaccaacaccaagaaggagacccgcttccagtggttcttccagagagctgagatgccagatggccagtatgaccctgagaccggcaccggcctgctgtgcatcgaggaggccagcctgagcaagaaggacaagggcatctaccgggccatggtgtctgatgacagaggagaagatgacaccatcctggacctgactggagatgccctggatgccatcttcacagagctgggccgcatcggggccctgagcgccacccccctgaagatccagggcacagaggagggcatccgcatcttcagcaaggtgaagtactacaacgtggagtacatgaagaccacctggttccacaaggacaagaggctggagagcggggaccgcatcagaacaggcaccaccctggatgagatctggctgcacatcctggaccccaaggacagcgacaagggcaagtacaccctggagattgctgctgggaaggaggtgcggcagctgagcacagacctgagcggccaggcctttgaagatgccatggccgagcaccagaggctgaagttcctgtacatcagccagtaccgggccaaggtggtgcggggcctgcctgatgtggccaccatcatggaggacaagaccctgtgcctgacctgcatcgtgtctggggaccccaccccagagatctcctggctgaagaatgaccagcctgtgaccttcctggaccgctacaggatggaggtgcggggcacagaggtgaccatcaccatcgagaaggtgaacagcgaggacagcggccgctatggagtgtttgtgaagaacaagtatggcagcgagaccggccaggtgaccatctctgtgttcaagcatggagatgagcccaaggagctgaagtccatgtag

SEQ ID NO: 40182 - DNA, 1065 bp, Artificial Sequence
  Description of Artificial Sequence: Synthetic coding sequence
atggaggccgccacagcccctgaggtggccgccggcagcaagctgaaggtgaaggaggccagccctgcagatgctgagcccccccaggccagccctggccagggcgccggcagccccaccccccagctgctgccccccatcgaggagcaccccaagatctggctgccccgggccctgcggcagacctacatcaggaaggtgggggacacagtgaacctgctgatccccttccagggcaagcccaagccccaggccatctggacccatgatggctgtgccctggacaccaggagagtgtctgtgagaaatggagagcaggacagcatcctcttcatccgggaggcccagagagctgacagcggccgctaccagctgcgggtgcagctgggcggcctggaggccacagccaccatcgacatcctggtgattgagcggcccggccccccccagagcatcaagctggtggatgtgtggggcttcagcgccaccctggagtggaccccaccccaggacaccggcaacacagccctgctgggctacacagtgcagaaggctgacaccaagagcggcctgtggttcaccgtgctggagcactaccacaggaccagctgcatcgtgtctgacctgatcatcggcaacagctatgccttccgggtgtttgctgagaaccagtgtggcctgtctgaaacagcccccatcaccacagacctggcccacatccagaaggccgccaccgtgtacaagaccaagggctttgcccagagggacttcagcgaggcccccaagttcacccagcccctggccgactgcaccaccgtgacaggctacaacacccagctgttctgctgcgtgcgggccagcccccggcccaagatcatctggctgaagaacaagatggacatccagggcaaccccaagtaccgggccctgacccacctgggcatctgcagcctggagatcaggaagccaggcccctttgatggcggcatctacacctgcaaggctgtgaaccccctgggggaggcctctgtggactgccgggtggatgtgaaggtgcccaactag

SEQ ID NO: 40183 - DNA, 1464 bp, Artificial Sequence
  Description of Artificial Sequence: Synthetic coding sequence
atgcaggagtttgcccggcgctacttccgccgcagccaggccctgctgggccagacagatggaggagctgctgggaaggacacagacagcctggtgcagtacaccaaggcccccatccaggagagcctgctgagcctgagtgatgatgtgtccaagctggccgtggccagcttcctggccctgatgaggttcatgggagaccagagcaagccccggggcaaggatgagatggacctgctgtatgagctgctgaagctgtgccagcaggagaagctgagagatgagatctactgccaggtgatcaagcaggtgacaggccaccccaggcctgagcactgcacccggggctggagcttcctgagcctgctgaccggcttcttcccccccagcacccggctgatgccctacctgaccaagttcctgcaggacagcggccccagccaggagctggcccggagcagccaggagcacctgcagaggacagtgaagtatggaggaagaagaaggatgcctcctcctggagagatgaaggccttcctgaagggccaggccatccggctgctgctgatccacctgcctggaggagtggactaccgcaccaacatccagaccttcaccgtggccgctgaggtgcaggaggagctgtgccggcagatgggcatcacagagccccaggaggtgcaggagtttgccctcttcctgatcaaggagaagagccagctggtgcggcccctgcagcctgctgagtacctgaacagcgtggtggtggaccaggatgtgtccctgcacagccggcggctgcactgggagacccccctgcactttgacaacagcacctacatcagcacccactacagccaggtgctgtgggactacctgcagggcaagctgcctgtgtctgccaaggcagatgcccagctggcccggctggccgccctgcagcacctgagcaaggccaacagaaacaccccatctggccaggacctgctggcctacgtgcccaagcagctgcagaggcaggtgaacacagccagcatcaagaacctgatgggccaggagctgcggcggctggagggccacagcccccaggaggcccagatctccttcatcgaggccatgagccagctgcccctgtttggctacacagtgtatggagtgctgcgggtgtccatgcaggccctgagcggccccaccctgctgggcctgaaccggcagcacctgatcctgatggaccccagcagccagagcctgtactgcagaattgccctgaagagcctgcagaggctgcacctgctgagccccctggaggagaagggccccccaggcctggaggtgaactacggcagcgctgacaacccccagaccatctggtttgagctgccccaggcccaggagctgctgtacaccaccgtcttcctgattgacagcagcgccagctgcacagagtggcccagcatcaactag

SEQ ID NO: 40184 - DNA, 1998 bp, Artificial Sequence
  Description of Artificial Sequence: Synthetic coding sequence
atggacaggcctgctgctgctgctgctgctggctgtgagggcggcggcggccccaaccctggccctgctgggggccggcggccccccagggctgctgggggcgccacagctggcagccggcagcccagcgtggagaccctggacagccccaccggcagccacgtggagtggtgcaagcagctgattgctgccaccatcagcagccagatcagcggctctgtgaccagtgaaaatgtgtcccgggactacaaggccctgagagatggcaacaagctggcccagatggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagaccaagggcggcggctatgagagcgagagcgcctacccaaatgctgagctggtgttcctggagatccacaacatccacgtgatgagggagagcctgaggaagctgaaggagatcgtgtaccccagcattgatgaggcccgctggctgagcaatgtggatggcacccactggctggagtacatccgcatgctgctggccggggctgtgagaattgctgacaagattgaaagtggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccatggaaatgacaaccacgcagatgctgacaggagccccatcttcctgcagtttgtggactgtgtgtggcagatgacccggcagttccccagcgcctttgagttcaatgagctgttcctgatcaccatcctggaccacctgtacagctgcctgtttggcaccttcctgtgcaactgtgagcagcagcgcttcaaggaggatgtgtacaccaagaccatcagcctgtggagctacatcaacagccagctggatgagttcagcaaccccttctttgtgaactatgaaaatcatgtgctgtaccctgtggccagcctgagccacctggagctgtgggtgaactactacgtgcgctggaaccccaggatgaggccccagatgcccatccaccagaacctgaaggagctgctggccgtgcgggcagagctgcagaagagggtggagggcctgcagcgggaggtggccaccagggctgtgagcagcagcagcgagcggggcagcagccccagccacagcgccacctctgtgcacacctctgtgtag

SEQ ID NO: 40185 - DNA, 819 bp, Artificial Sequence
  Description of Artificial Sequence: Synthetic coding sequence
atgatcagcacctgcctgcctgagtacatcgtggtgcccagcagcctggccgaccaggacctgaagatcttcagccacagctttgtgggccgcaggatgcccctgtggtgctggagccacagcaatggcagcgccctggtgaggatggccctgatcaaggatgtgctgcagcagaggaagattgaccagaggatctgcaatgccatcaccaagagccacccccagaggagtgatgtgtacaagagtgacctggacaagaccctgcccaacatccaggaggtgcaggccgcctttgtgaagctgaagcagctgtgtgtgaatgagccctttgaggagacagaggagaagtggctgagcagcctggagaacacccgctggctggagtatgtgcgggccttcctgaagcacagcgctgagctggtgtacatgctggagagcaagcacctgtctgtggtgctgcaggaggaggagggccgggacctgagctgctgcgtggccagcctggtgcaggtgatgctggacccctacttccgcaccatcaccggcttccagagcctcatccagaaggagtgggtgatggccggctaccagttcctggaccgctgcaaccacctgaagaggtctgagaaggagagccccctcttcctgctcttcctggatgccacctggcagctgctggagcagtacccagctgcctttgagttcagcgagacctacctggccgtgctgtatgacagcacccgcatcagcctgtttggcaccttcctgttcaacagcccccaccagagggtgaagcagagcacagtgtggctgctgtag

SEQ ID NO: 40186 - DNA, 1371 bp, Artificial Sequence
  Description of Artificial Sequence: Synthetic coding sequence
atgcccctgcagaagttccactacagaaacctgctgctgggggagcatgatgtgcccctgacctgcatcgagcagatcgtgacagtgaatgaccacaagaggaagcagaaggtgctgggccccaaccagaagctgaagttcaaccccacagagctgatcatctactgcaaggacttcagaattgtgcgcttccgctttgatgaaagtggccctgagagcgccaagaaggtgtgcctggccatcgcccactacagccagcccacagacctgcagctgctgtttgcctttgaatatgtgggcaagaagtaccacaacagcgccaacaagatcaatggcatccccagcggagatggcggcggcggcggcggcggcggcaatggagctgggggcggcagcagccagaagacccccctgtttgagacctacagcgactgggaccgggagatcaagaggactggagccagcggctggagggtgtgcagcatcaatgaaggctacatgatcagcacctgcctgcctgagtacatcgtggtgcccagcagcctggccgaccaggacctgaagatcttcagccacagctttgtgggccgcaggatgcccctgtggtgctggagccacagcaatggcagcgccctggtgaggatggccctgatcaaggatgtgctgcagcagaggaagattgaccagaggatctgcaatgccatcaccaagagccacccccagaggagtgatgtgtacaagagtgacctggacaagaccctgcccaacatccaggaggtgcaggccgcctttgtgaagctgaagcagctgtgtgtgaatgagccctttgaggagacagaggagaagtggctgagcagcctggagaacacccgctggctggagtatgtgcgggccttcctgaagcacagcgctgagctggtgtacatgctggagagcaagcacctgtctgtggtgctgcaggaggaggagggccgggacctgagctgctgcgtggccagcctggtgcaggtgatgctggacccctacttccgcaccatcaccggcttccagagcctcatccagaaggagtgggtgatggccggctaccagttcctggaccgctgcaaccacctgaagaggtctgagaaggagagccccctcttcctgctcttcctggatgccacctggcagctgctggagcagtacccagctgcctttgagttcagcgagacctacctggccgtgctgtatgacagcacccgcatcagcctgtttggcaccttcctgttcaacagcccccaccagagggtgaagcagagcacagacaagaagctgtacaagaccaggctcttctccttcaccagcctgaagttcctggtgaccatccactag

SEQ ID NO: 40187 - DNA, 657 bp, Artificial Sequence
  Description of Artificial Sequence: Synthetic coding sequence
atgttcagcctgaagccacccaagcccaccttccgcagctacctgctgcccccaccccagacagatgacaagatcaacagcgagcccaagatcaagaagctggagcctgtgctgctgcccggggagatcgtggtgaatgaggtgaactttgtgaggaaatgtattgccacagacaccagccagtatgacctgtggggcaagctgatctgcagcaacttcaagatctccttcatcacagatgaccccatgcccctgcagaagttccactacagaaacctgctgctgggggagcatgatgtgcccctgacctgcatcgagcagatcgtgacagtgaatgaccacaagaggaagcagaaggtgctgggccccaaccagaagctgaagttcaaccccacagagctgatcatctactgcaaggacttcagaattgtgcgcttccgctttgatgaaagtggccctgagagcgccaagaagcagaccaagctgatggagttcccccaggagatggaggaggaggaggaggaggaggtgatggagctggtggtggccgccgccaggaagctgcacagcctgaagctgacccgcatcggcacagagaagagccggggccaggtgctgcctggaggagaatttgtgctgctgaccagggtgacctag

SEQ ID NO: 40188 - DNA, 2334 bp, Artificial Sequence
  Description of Artificial Sequence: Synthetic coding sequence
atgttcagcctgaagccacccaagcccaccttccgcagctacctgctgcccccaccccagacagatgacaagatcaacagcgagcccaagatcaagaagctggagcctgtgctgctgcccggggagatcgtggtgaatgaggtgaactttgtgaggaaatgtattgccacagacaccagccagtatgacctgtggggcaagctgatctgcagcaacttcaagatctccttcatcacagatgaccccatgcccctgcagaagttccactacagaaacctgctgctgggggagcatgatgtgcccctgacctgcatcgagcagatcgtgacagtgaatgaccacaagaggaagcagaaggtgctgggccccaaccagaagctgaagttcaaccccacagagctgatcatctactgcaaggacttcagaattgtgcgcttccgctttgatgaaagtggccctgagagcgccaagaaggtgtgcctggccatcgcccactacagccagcccacagacctgcagctgctgtttgcctttgaatatgtgggcaagaagtaccacaacagcgccaacaagatcaatggcatccccagcggagatggcggcggcggcggcggcggcggcaatggagctgggggcggcagcagccagaagacccccctgtttgagacctacagcgactgggaccgggagatcaagaggactggagccagcggctggagggtgtgcagcatcaatgaaggctacatgatcagcacctgcctgcctgagtacatcgtggtgcccagcagcctggccgaccaggacctgaagatcttcagccacagctttgtgggccgcaggatgcccctgtggtgctggagccacagcaatggcagcgccctggtgaggatggccctgatcaaggatgtgctgcagcagaggaagattgaccagaggatctgcaatgccatcaccaagagccacccccagaggagtgatgtgtacaagagtgacctggacaagaccctgcccaacatccaggaggtgcaggccgcctttgtgaagctgaagcagctgtgtgtgaatgagccctttgaggagacagaggagaagtggctgagcagcctggagaacacccgctggctggagtatgtgcgggccttcctgaagcacagcgctgagctggtgtacatgctggagagcaagcacctgtctgtggtgctgcaggaggaggagggccgggacctgagctgctgcgtggccagcctggtgcaggtgatgctggacccctacttccgcaccatcaccggcttccagagcctcatccagaaggagtgggtgatggccggctaccagttcctggaccgctgcaaccacctgaagaggtctgagaaggagagccccctcttcctgctcttcctggatgccacctggcagctgctggagcagtacccagctgcctttgagttcagcgagacctacctggccgtgctgtatgacagcacccgcatcagcctgtttggcaccttcctgttcaacagcccccaccagagggtgaagcagagcacagaatttgccatcagcaagaacatccagctgggagatgagaagggcctgaagttccccagcgtgtgggactggagcctgcagttcaccgccaaggacaggaccctcttccacaaccccttctacatcggcaagagcaccccctgcatccagaatggatctgtgaagagcttcaagaggaccaagaagagctacagcagcaccctgcggggcatgcccagcgccctgaagaatggcatcatcagtgaccaggagctgctgcccaggaggaacagcctcatcctgaagcccaagccagaccctgcccagcagacagacagccagaacagcgacacagagcagtacttccgggagtggttcagcaagccagccaacctgcacggcgtcatcctgccccgggtgtctggcacccacatcaagctgtggaagctgtgctacttccgctgggtgcctgaggcccagatcagcctgggcggcagcatcacagccttccacaagctgagcctgctggctgatgaggtggatgtgctgagcaggatgctgcggcagcagaggagcggccccctggaggcctgctacggggagctgggccagagcaggatgtacttcaatgccagcggcccccaccacacagacaccagcggcaccccagagttcctgagcagcagcttccccttcagccctgtgggcaacctgtgcagaagaagcatcctgggcacccccctgagcaagttcctgagcggggccaagatctggctgagcacagagaccctggccaatgaagattag

SEQ ID NO: 40189 - DNA, 819 bp, Artificial Sequence
  Description of Artificial Sequence: Synthetic coding sequence
atgtggtggggcggccggggccagagcttcaacatcgccccccagaaggaggagcctgagatgggctctgtgcaggagaacaggatgcctgagcccaggagccggcagcccagcagctgcctggccagccgctgcctgcctggagagcagatcctggcctgggcccctggggtgaggaagggcctggagcctgagctgagcggcaccctcatctgcaccaacttccgggtgaccttccagccctgtggctggcagtggaaccaggacacccccctgaacagtgaatatgactttgccctggtgaacatcggccgcctggaggccgtgtctggcctgagccgggtgcagctgctgcggcccggcagcctgcacaagttcatccctgaggagatcctgatccacggccgggacttccggctgctgcgggtgggctttgaagctgggggcctggagccccaggccttccaggtgaccatggccatcgtgcaggcccgggcccagagcaaccaggcccagcagtacagcggcatcaccctgagcaaggccggccagggcagcggcagcaggaagccacccatccccctgatggagacagctgaggactgggagacagagaggaagaagcaggccgcccggggctggagggtgtccacagtgaatgaaagatttgatgtggccacccggctgcgctgcttcagcagcagcctgattgtgtctggcagcagcagcagcagcttccagctgatcctgaacagcctgtccttctccttcctgctcttcatgacagtgtctggcttcctgacccccctgcccagctag

SEQ ID NO: 40190 - DNA, 1923 bp, Artificial Sequence
  Description of Artificial Sequence: Synthetic coding sequence
atgccaccccgggtgaccttccagccctgtggctggcagtggaaccaggacacccccctgaacagtgaatatgactttgccctggtgaacatcggccgcctggaggccgtgtctggcctgagccgggtgcagctgctgcggcccggcagcctgcacaagttcatccctgaggagatcctgatccacggccgggacttccggctgctgcgggtgggctttgaagctgggggcctggagccccaggccttccaggtgaccatggccatcgtgcaggcccgggcccagagcaaccaggcccagcagtacagcggcatcaccctgagcaaggccggccagggcagcggcagcaggaagccacccatccccctgatggagacagctgaggactgggagacagagaggaagaagcaggccgcccggggctggagggtgtccacagtgaatgaaagatttgatgtggccaccagcctgccccgctacttctgggtgcccaaccgcatcctggacagcgaggtgagaagagccttcggccacttccaccagggccggggcccccggctgtcctggcaccaccctgggggcagtgacctgctgcgctgtggcggcttctacacagccagtgaccccaacaaggaggacatccgggctgtggagctgatgctgcaggccggccacagtgatgtggtgctggtggacaccatggatgagctgcccagcctggctgatgtgcagctggcccacctgcggctgcgggccctgtgcctgcctgacagctctgtggccgaggacaagtggctgagcgccctggagggcacccgctggctggactatgtgcgggcctgcctgaggaaggccagtgacatctctgtgctggtgaccagccgggtgcgcagcgtcatcctgcaggagcggggggaccgggacctgaatggcctgctgagcagcctggtgcagctgctgagcgcccctgaggcccggaccctgtttggcttccagagcctggtgcagcgggagtgggtggccgccggccaccccttcctgacccggctgggcggcactggagccagcgaggaggcccctgtgttcctgctcttcctggactgtgtgtggcagctgctgcagcagtttcctgctgactttgagttcagcgagttcttcctgctggccctgcatgattctgtgcgggtgcctgacaccctgaccttcctgaggaacaccccctgggagcggggcaagcagagcggccagctgaacagctacacccaggtgtacaccccaggctacagccagcccccagctggcaacagcttcaacctgcagctgtctgtgtgggactgggacctgcgctacagcaatgcccagatcctgcagttccagaaccctggctatgaccctgagcactgcccagacagctggctgccccggccccagcccagcttcatggtgcccggcccccccagctctgtgtggctgttcagcagaggagccctgacccccctgaaccagctgtgcccctggagggacagccccagcctgctggccgtgagcagccgctggctgcccaggcctgccatcagcagcgagagcctggccgaccaggagtggggcctgcccagccactggggcgcctgccccctgcccccaggcctgctgctgcccggctacctgggcccccagatccggctgtggaggcgctgctacctgcggggccggcctgaggtgcagatgggcctgagcgcccccaccatcagcggcctgcaggatgagctgagccacctgcaggagctgctgaggaagtggaccccccgcatcagccctgaggaccacagcaagaagagggacccccacaccatcctgaaccccacagaaattgctggcatcctgaagggccagagccaccccttctggatcacccgctgctag

SEQ ID NO: 40191 - DNA, 765 bp, Artificial Sequence
  Description of Artificial Sequence: Synthetic coding sequence
atggccatcgtgcaggcccgggcccagagcaaccaggcccagcagtacagcggcatcaccctgagcaaggccggccagggcagcggcagcaggaagccacccatccccctgatggagacagctgaggactgggagacagagaggaagaagcaggccgcccggggctggagggtgtccacagtgaatgaaagatttgatgtggccaccagcctgccccgctacttctgggtgcccaaccgcatcctggacagcgaggtgagaagagccttcggccacttccaccagggccggggcccccggctgtcctggcaccaccctgggggcagtgacctgctgcgctgtggcggcttctacacagccagtgaccccaacaaggaggacatccgggctgtggagctgatgctgcaggccggccacagtgatgtggtgctggtggacaccatggatgagctgcccagcctggctgatgtgcagctggcccacctgcggctgcgggccctgtgcctgcctgacagctctgtggccgaggacaagtggctgagcgccctggagggcacccgctggctggactatgtgcgggcctgcctgaggaaggccagtgacatctctgtgctggtgaccagccgggtgcgcagcgtcatcctgcaggccgccttcagccccaggagccccaacacagtgtggctgcccatcaccagcacagcccgggtgggcggctcctggaccagcctgcctgattctgcctggggcaactggggccagtag

SEQ ID NO: 40192 - DNA, 1065 bp, Artificial Sequence
  Description of Artificial Sequence: Synthetic coding sequence
atgcctgagcccaggagccggcagcccagcagctgcctggccagccgctgcctgcctggagagcagatcctggcctgggcccctggggtgaggaagggcctggagcctgagctgagcggcaccctcatctgcaccaacttccgggtgaccttccagccctgtggctggcagtggaaccaggacacccccctgaacagtgaatatgactttgccctggtgaacatcggccgcctggaggccgtgtctggcctgagccgggtgcagctgctgcggcccggcagcctgcacaagttcatccctgaggagatcctgatccacggccgggacttccggctgctgcgggtgggctttgaagctgggggcctggagccccaggccttccaggtgaccatggccatcgtgcaggcccgggcccagagcaaccaggcccagcagtacagcggcatcaccctgagcaaggccggccagggcagcggcagcaggaagccacccatccccctgatggagacagctgaggactgggagacagagaggaagaagcaggccgcccggggctggagggtgtccacagtgaatgaaagatttgatgtggccaccagcctgccccgctacttctgggtgcccaaccgcatcctggacagcgaggtgagaagagccttcggccacttccaccagggccggggcccccggctgtcctggcaccaccctgggggcagtgacctgctgcgctgtggcggcttctacacagccagtgaccccaacaaggaggacatccgggctgtggagctgatgctgcaggccggccacagtgatgtggtgctggtggacaccatggatgagctgcccagcctggctgatgtgcagctggcccacctgcggctgcgggccctgtgcctgcctgacagctctgtggccgaggacaagtggctgagcgccctggagggcacccgctggctggactatgtgcgggcctgcctgaggaaggccagtgacatctctgtgctggtgaccagccgggtgcgcagcgtcatcctgcagggcagcggcgtgagccccctgccctag

SEQ ID NO: 40193 - DNA, 2130 bp, Artificial Sequence
  Description of Artificial Sequence: Synthetic coding sequence
atgtggtggggcggccggggccagagcttcaacatcgccccccagaaggaggagcctgagatgggctctgtgcaggagaacaggatgcctgagcccaggagccggcagcccagcagctgcctggccagccgctgcctgcctggagagcagatcctggcctgggcccctggggtgaggaagggcctggagcctgagctgagcggcaccctcatctgcaccaacttccgggtgaccttccagccctgtggctggcagtggaaccaggacacccccctgaacagtgaatatgactttgccctggtgaacatcggccgcctggaggccgtgtctggcctgagccgggtgcagctgctgcggcccggcagcctgcacaagttcatccctgaggagatcctgatccacggccgggacttccggctgctgcgggtgggctttgaagctgggggcctggagccccaggccttccaggtgaccatggccatcgtgcaggcccgggcccagagcaaccaggcccagcagtacagcggcatcaccctgagcaaggccggccagggcagcggcagcaggaagccacccatccccctgatggagacagctgaggactgggagacagagaggaagaagcaggccgcccggggctggagggtgtccacagtgaatgaaagatttgatgtggccaccagcctgccccgctacttctgggtgcccaaccgcatcctggacagcgaggtgagaagagccttcggccacttccaccagggccggggcccccggctgtcctggcaccaccctgggggcagtgacctgctgcgctgtggcggcttctacacagccagtgaccccaacaaggaggacatccgggctgtggagctgatgctgcaggccggccacagtgatgtggtgctggtggacaccatggatgagctgcccagcctggctgatgtgcagctggcccacctgcggctgcgggccctgtgcctgcctgacagctctgtggccgaggacaagtggctgagcgccctggagggcacccgctggctggactatgtgcgggcctgcctgaggaaggccagtgacatctctgtgctggtgaccagccgggtgcgcagcgtcatcctgcaggagcggggggaccgggacctgaatggcctgctgagcagcctggtgcagctgctgagcgcccctgaggcccggaccctgtttggcttccagagcctggtgcagcgggagtgggtggccgccggccaccccttcctgacccggctgggcggcactggagccagcgaggaggcccctgtgttcctgctcttcctggactgtgtgtggcagctgctgcagcagtttcctgctgactttgagttcagcgagttcttcctgctggccctgcatgattctgtgcgggtgcctgacaccctgaccttcctgaggaacaccccctgggagcggggcaagcagagcggccagctgaacagctacacccaggtgtacaccccaggctacagccagcccccagctggcaacagcttcaacctgcagctgtctgtgtgggactgggacctgcgctacagcaatgcccagatcctgcagttccagaaccctggctatgaccctgagcactgcccagacagctggctgccccggccccagcccagcttcatggtgcccggcccccccagctctgtgtggctgttcagcagaggagccctgacccccctgaaccagctgtgcccctggagggacagccccagcctgctggccgtgagcagccgctggctgcccaggcctgccatcagcagcgagagcctggccgaccaggagtggggcctgcccagccactggggcgcctgccccctgcccccaggcctgctgctgcccggctacctgggcccccagatccggctgtggaggcgctgctacctgcggggccggcctgaggtgcagatgggcctgagcgcccccaccatcagcggcctgcaggatgagctgagccacctgcaggagctgctgaggaagtggaccccccgcatcagccctgaggaccacagcaagaagagggacccccacaccatcctgaaccccacagaaattgctggcatcctgaagggccgggcagagggggacctgggctag

SEQ ID NO: 40194 - DNA, 663 bp, Artificial Sequence
  Description of Artificial Sequence: Synthetic coding sequence
atgaacatcagaaatgcccggcctgaggacctgatgaacatgcagcactgcaacctgctgtgcctgcctgagaactaccagatgaagtactacttctaccacggcctgtcctggccccagctgagctacatcgccgaggatgaaaatggcaagatcgtgggctacgtgctggccaagatggaggaggaccctgatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagaggatcagcgaggtggagcccaagtactatgcagatggagaagatgcctatgccatgaagagggacctgacccagatggctgatgagctgcggcggcacctggagctgaaggagaagggcagacatgtggtgctgggcgccatcgagaacaaggtggagagcaagggcaacagcccccccagcagtggagaggcctgccgggaggagaagggcctggccgctgaggacagcggcggggacagcaaggacctgtctgaggtgtctgagaccacagagagcacagatgtgaaggacagcagcgaggccagtgacagcgccagctag

SEQ ID NO: 40195 - DNA, 708 bp, Artificial Sequence
  Description of Artificial Sequence: Synthetic coding sequence
atgaacatcagaaatgcccggcctgaggacctgatgaacatgcagcactgcaacctgctgtgcctgcctgagaactaccagatgaagtactacttctaccacggcctgtcctggccccagctgagctacatcgccgaggatgaaaatggcaagatcgtgggctacgtgctggccaagatggaggaggaccctgatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagagcaacagagctgccctgcacctgtacagcaacaccctgaacttccagatcagcgaggtggagcccaagtactatgcagatggagaagatgcctatgccatgaagagggacctgacccagatggctgatgagctgcggcggcacctggagctgaaggagaagggccgccacgtggtgctgggcgccatcgagaacaaggtggagagcaaaggaaacagcccccccagcagcggggaggcctgccgggaggagaagggcctggccgcagaagattctggaggagacagcaaggacctgtctgaggtgtctgagaccacagagagcacagatgtgaaggacagcagcgaggccagtgacagcgccagctag

SEQ ID NO: 40196 - DNA, 714 bp, Artificial Sequence
  Description of Artificial Sequence: Synthetic coding sequence
atgggcaggaagagcagcaaggccaaggagaagaagcagaagaggctggaggagcgggccgccatggatgctgtgtgtgccaaggtggatgctgccaaccggctgggggaccccctggaggccttccctgtgttcaagaagtatgacagaaatggcctgaatgtgtccattgagtgcaagagggtgtctggcctggagcccgccaccgtggactgggcctttgacctgaccaagaccaacatgcagaccatgtatgagcagagcgagtggggctggaaggaccgggagaagcgggaggagatgacagatgaccgggcctggtacctgattgcctgggagaacagctctgtgcctgtggccttcagccacttccgctttgatgtggagtgtggagatgaggtgctgtactgctatgaggtgcagctggagagcaaggtgcggaggaagggcctgggcaagttcctgatccagatcctgcagctgatggccaacagcacccagatgaagaaggtgatgctgaccgtcttcaagcacaaccacggggcctaccagttcttccgggaggccctgcagtttgaaattgatgacagcagccccagcatgagcggctgctgcggggaggactgcagctatgagatcctgagcaggaggaccaagtttggagacagccaccacagccacgccggcggccactgcggcggctgctgccactag

SEQ ID NO: 40197 - DNA, 594 bp, Artificial Sequence
  Description of Artificial Sequence: Synthetic coding sequence
atgccctttgtgcccaagtggaccctgcccaccggcctgaatgtgtccattgagtgcaagagggtgtctggcctggagcccgccaccgtggactgggcctttgacctgaccaagaccaacatgcagaccatgtatgagcagagcgagtggggctggaaggaccgggagaagcgggaggagatgacagatgaccgggcctggtacctgattgcctgggagaacagctctgtgcctgtggccttcagccacttccgctttgatgtggagtgtggagatgaggtgctgtactgctatgaggtgcagctggagagcaaggtgcggaggaagggcctgggcaagttcctgatccagatcctgcagctgatggccaacagcacccagatgaagaaggtgatgctgaccgtcttcaagcacaaccacggggcctaccagttcttccgggaggccctgcagtttgaaattgatgacagcagccccagcatgagcggctgctgcggggaggactgcagctatgagatcctgagcaggaggaccaagtttggagacagccaccacagccacgccggcggccactgcggcggctgctgccactag

SEQ ID NO: 40198 - DNA, 645 bp, Artificial Sequence
  Description of Artificial Sequence: Synthetic coding sequence
atgtctgacctggaggatgatgagaccccccagctgagcgcccacgccctggccgccctgcaggagttctatgcagagcagaagcagcagatcgagcctggagaagatgacaagtacaacatcggcatcatcgaggagaactggcagctgagccagttctggtacagccaggagacagccctgcagctggcccaggaggccatcgctgctgtgggggagggcggcagaattgcctgtgtgtctgcccccagcgtgtaccagaagctgcgggagctgtgccgggagaacttcagcatctacatctttgaatatgacaagagatttgccatgtatggagaggagttcatcttctatgactacaacaaccccctggacctgcctgagagaattgctgcccacagctttgatattgtgattgctgaccccccctacctgtctgaggagtgcctgaggaagaccagcgagaccgtgaagtacctgacccggggcaagatcctgctgtgcacaggagccatcatggaggagcaggccgctgagctgctgggcgtgaagatgtgcacctttgtgcccaggcacaccaggaacctggccaatgagttccgctgctacgtgaactatgacagcggcctggactgtggcatctag

SEQ ID NO: 40199 - DNA, 645 bp, Artificial Sequence; identical to SEQ ID NO: 40198
  Description of Artificial Sequence: Synthetic coding sequence

SEQ ID NO: 40200 - DNA, 1110 bp, Artificial Sequence
  Description of Artificial Sequence: Synthetic coding sequence
atgaagctggaggccagctgtggcacagccaccagcgaggtgcccaagccagagaagaagacagccagagatgctgagcccagcagcgagacccggccccaggaggtggaggccgagcccaggagcggcagcggccctgaggccgaggccgagcccctggactttgtggtggccacagagcgggagtttgaggaggtgctggccatcagcggcggcatctacggcggcctggactacctgcccagccgctaccacagctggctgcgggaccctgacagaacagtggtgctggccaagagaaatggaggagtgattgccctggagagcgtgaatgtgattgatgctggggagaccgtgctggtggagggcctgcgggtggccccctgggagcggggcaaaggagtggccggcctgctgcagcgcttctgcagccagctggtgaagaggcagcaccctggggtgaaggtggcccggctgaccagagatgaccagctgggcccccgggagctgaagaagtaccgcctcatcaccaagcagggcatcctgctggtgcgcttcaatgccagcgccctgctggccggcctgggcgcccggctggccgccctgcggaccagcggcaccttcagccccctgcccacagaagctgtgtctgaggccggaggagatgtggcccggctgctgctgagccccagcgtgcagagagatgtgctgcccggcggcaccatcatccaggactggcagccctaccggcccagcgagagcaacctgcggctgctggccgccaagggcctggagtggagggtggacagccgggcccggccccgggtgctgaccctgtgcacccggcccttccccatcccccacggcggagatggcacctggagatacctgaacattgatgccttcggcagtgatggagcccaggtgcagagccagctgctgtggcacctgcagaggcaggccccccggctggtgggcctgaatgtgatgtgccagctgttcctggagccccagctgtggagccagctggccgacttctgccaggtgggcctgggcctggagctggtgaagggctacacagagcagtacctgctggaggccgacatctag

SEQ ID NO: 40201 - DNA, 471 bp, Artificial Sequence
  Description of Artificial Sequence: Synthetic coding sequence
atgaagctggaggccagctgtggcacagccaccagcgaggtgcccaagccagagaagaagacagccagagatgctgagcccagcagcgagacccggccccaggaggtggaggccgagcccaggagcggcagcggccctgaggccgaggccgagcccctggactttgtggtggccacagagcgggagtttgaggaggtgctggccatcagcggcggcatctacggcggcctggactacctgcccagccgctaccacagctggctgcgggaccctgacagaacagtggtgctggccaagagaaatggaggagtgattgccctggagagcgtgaatgtgattgatgctggggagaccgtgctggtggagggcctgcgggtggccccctgggagcggggcaaaggagtggccggcctgctgcagcgcttctgcagccagctggtgaagaggcagcaccctggggtgaaggtgtag

SEQ ID NO: 40202 - DNA, 1110 bp, Artificial Sequence; identical to SEQ ID NO: 40200
  Description of Artificial Sequence: Synthetic coding sequence

SEQ ID NO: 40203 - DNA, 861 bp, Artificial Sequence
  Description of Artificial Sequence: Synthetic coding sequence
atggagctgatcctgagcaccagccctgctgagctgaccctggaccctgcctgccagcccaagctgcccctggacagcacctgccagcctgagatgaccttcaaccctggccccacagagctgaccctggaccctgagcaccagcctgaggagaccccagcccccagcctggccgagctgaccctggagcctgtgcacagaagacctgagctgctggatgcctgtgccgacctgatcaatgaccagtggcccaggagcaggaccagccggctgcacagcctgggccagagcagtgatgccttccccctgtgcctgatgctgctgagcccccaccccaccctggaggccgcccctgtggtggtgggccacgcccggctgagccgggtgctgaaccagccccagagcctgctggtggagaccgtggtggtggcccgggccctgcggggccggggcttcggccggcggctgatggagggcctggaggtgtttgcccgggcccggggcttcaggaagctgcacctgaccacccatgaccaggtgcacttctacacccacctgggctaccagctgggggagcctgtgcagggcctggtgttcaccagccggcggctgcctgccaccctgctgaatgccttccccacagcccccagcccccggccccccaggaaggcccccaacctgacagcccaggccgccccccggggccccaagggcccccccctgcccccacctccacccctgcctgaatgtctgaccatcagcccccctgtgcccagcggcccccccagcaagagcctgctggagacccagtaccagaatgtgcggggccggcccatcttctggatggagaaggacatctag

SEQ ID NO: 40204 - DNA, 861 bp, Artificial Sequence; identical to SEQ ID NO: 40203
  Description of Artificial Sequence: Synthetic coding sequence

SEQ ID NO: 40205 - DNA, 624 bp, Artificial Sequence
  Description of Artificial Sequence: Synthetic coding sequence
atgaggctgaaccagaacaccctgctgctgggcaagaaggtggtgctggtgccctacaccagcgagcacgtgcccagccgctaccacgagtggatgaagtctgaggagctgcagaggctgacagccagcgagcccctgaccctggagcaggagtatgccatgcagtgctcctggcaggaggatgctgacaagtgcaccttcatcgtgctggatgctgagaagtggcaggcccagcccggggccacagaggagagctgcatggtgggagatgtgaacctcttcctgacagacctggaggacctgaccctgggggagattgaggtgatgattgctgagcccagctgccggggcaagggcctgggcacagaggccgtgctggccatgctgtcctatggagtgaccaccctgggcctgaccaagtttgaggccaagattggccagggcaatgagcccagcatccgcatgttccagaagctgcactttgagcaggtggccaccagcagcgtcttccaggaggtgaccctgcggctgactgtgtctgagagcgagcaccagtggctgctggagcagaccagccacgtggaggagaagccctacagagatggcagcgctgagccctgctag

SEQ ID NO: 40206 - DNA, 4290 bp, Artificial Sequence
  Description of Artificial Sequence: Synthetic coding sequence
atggacagccagttccacatggccggggaggccagccagagctggctgaaggccaaggagaagcagaggggcaccagctacatggtggccgtcatcgagtgggagattgaaagaagcctgctgagcagcgaggaccgggagcagggcgccaccgtcttcctgcgggagatccaggacctgcacaagcacatcctggaggactgtgccctgaggatggtggaccggctggctgatggctgcctggatgctgatgcccagaacctgctgagcagcctgaagagccacatcacagacatgcaccctggggtgctgaagacccaccggctgccctggagccgggacctggtgaaccccaagaacaagacccacgcctgctacctgaaggagctgggggagcagtttgtggtgcgggccaaccaccaggtgctgacccggctgcgggagctggacacagctggccaggagctggcctggctgtaccaggagatccgccaccacctgtggcagagcagcgaggtgatccagaccttctgtggccggcaggagctgctggcccggctgggccagcagctgcggcatgatgacagcaagcagcacacccccctggtgctgtttggacctcctggcatcggcaagacagccctgatgtgcaagctggccgagcagatgccccggctgctgggccacaagacagtgacagtgctgcggctgctgggcaccagccagatgagcagtgatgcccggggcctgctgaagagcatctgcttccaggtgtgcctggcctacggcctgcccctgcccccagcccaggtgctggatgcccacaccagggtggtgcagttcttccacaccctgctgcacacagtgtcctgcaggaactttgagagcctggtgctgctgctggatgccatggatgacctggacagcgtgagacatgcccggcgggtgccctggctgcccctgaactgccccccccgggtgcacctgatcctgagcgcctgcagcggggccctgggcgtgctggacaccctgcagagggtgctgctggaccctgaggcctactgggaggtgaagcccctgagcggcaaccagggccagcagatgatccagctgctgctggccgccgcccggaggaccctgagccctgtgcacacagacctgctgtgggccagcctgcctgaatgtggcaaccctggccgcctgcggctggcctttgaggaggccaggaagtgggccagcttcaccgtgcctgtgcccctggccaccacagctgaggaggccacccaccagctgtgcacccggctggagcagacccacggccagctgctggtggcccacgtgctgggctacatcgtgagcagccgccacggcctgtctgaggccgagctgaaggatgtgctgagcctggatgatgaggtgctgcaggatgtgtacagagactggaccccacccagcaaggagctgctgcgcttcccccccctgctgtgggtgcggctgcggcgggacctgggctactacctggcccggcggcctgtggatggcttcaccctgctggccatcgcccaccggcagctggtggaggtggtgcgggagcgctacctgagcggcagcgagcgggccaagagacatggagtgctggccgacttcttcagcggcacctggagccagggcaccaagaagctgatcaccctgcccctggtgggcaagcccctgaacctggacaggaaggtggccccccagcccctgtggttcagccacacagtggccaacctgaggaagctgaaggagctgccctaccacctgctgcacagcggccgcctggaggagctgaagcaggaggtgctgggctccatgtcctggatcagctgccggggcatcagcggcggcatcgaggacctgctggatgactttgacctgtgtgccccccacctggacagccctgaggtgggcctggtgcgggaggccctgcagctgtgcaggcctgctgtggagctgcggggcatggagaggagcctgctgtacacagagctgctggcccggctgcacttctttgccaccagccacccagccctggtgggccagctgtgccagcaggcccagagctggttccagctgtgtgcccaccctgtgctggtgcccctgggcggcttcctgcagcccccaggcggccccctgcgggccaccctgagcggctgccacaagggcatcacagccatggcctggggcgtggaggagaagctgctggtgattggcacccaggacggcatcatggctgtgtgggacatggaggagcagcacgtgatccacatgctgaccggccacactggagaggtgcgctgtgtgaagatctttgccaagggcaccctggccaacagcgccagcaaggactacaccctgcacctgtggaacctgctgagcggccaggagaagttcaccatctgggatggcggcagcaagaacccagctgagccccagatctggaacctgcacgtggatgaggcccacaaggtggtgtacagcgccagcggcagcaagatcaatgcctggaacctggagacagctgagcccgtcttccacatcctgggagatgccagtgacccctggatgtgcatggctgtgctggccagccaggccaccctgctgactgtgtccagagatggagtggtgtccctgtggagcagcgccaccgggaagctgcagggcaagcagcacatgagcagcatcaaggaggagacccccacctgtgctgtgtctgtgcagaagcagggcaagctggtgacaggcttcagcaatggcagcatcagcctggtgagcagcaagggggaccggctgctggagaagctgcctgatgctgtgcgcttcctggtggtgtctgaagatgagagcctgctggccgccggcttcggccgctctgtgcgcatcttcctggccgacagccggggcttccgccgcttcatggccatggacctggagcacgaggacatggtggagacagctgtgtttggaacagagaacaacctgatcatcaccggcagcctggatgccctgatccaggtgtggagcctgtctgagcagggcaccctgctggacatcctggagggcgtgggcgcccctgtgtccctgctggcccggggcggggccctggtggccagcgccagcccccagagcagcagcttcaaggtgtgggacctgagtgatgcccacaggagccgggtgcctgcccccttcctggacagaacaggcctgacagctgtgagccacaacggcagctatgtgtacttccccaagattggagacaagaacaaggtgaccatctgggacctggccgagggggaggagcaggacagcctggacaccagcagcgagatccgctgcctggaggtggccgagcagaggaagctgctcttcaccggcctggtgtctggagtggtgctggtgttccccctgaacagccggcaggacgtcatctgcatccccccacctgaggccaggaaggccatcaactgcatgagcctgagcaaatgtgaggaccggctggccatcgcctatgacaacatcgtgctggtgctggacatcaccagcggggacccctgccctgtgattgatggcccccgctacaccttctacacccagctgcctgagaccctgagctctgtggccatcctgacagactacagagtggtgtacagcatgaccaatggagacctcttcctgtatgaatgtgccaccagcaaggccttccccctggagacccacaggagccgggtggcctgtgtggaggtgagccacaaggagcagctggtggtgtctggctctgaagatgccctgctgtgcctgtgggacctgcaggccaggaagtggaagtttgagatgagctacaccagcagctactgccggggcgtgcagtgtgcctgcttcagcaaggatgacaagtatgtgtatgtgggcctgaaggacaggagcatcctggtgtggagcgtgctggatggcaccctgctgactgtgcagtttgtgcatgctgtggtgaaccgcatcatccccaccaccagcggcttcatcgcccccaccaggcatggctacctgatccgggagaacttccagtgcctgagcgccaaggccagcccccaggaccccctgaagaacttcaagaaggccatgtggatggtgaagagccggcagcgggaggagctggtggccgctgctggggccccccaggacctggagagcgagagcgcccagggcaatgagaccaagagcaacaagtgcagccaggtgtgcctgattgtgtag

SEQ ID NO: 40207 - DNA, 4299 bp, Artificial Sequence
  Description of Artificial Sequence: Synthetic coding sequence
atgcagaggggcaagccctgccgggccctgcccaccctgaagtgccagaccttctgccagagacatggcctgatgtttgaggtggtggacctgcgctggggcatccggaacatcgaggccacagaccacctgaccacagagctgtgcctggaggaggtggaccgctgctggaagaccagcatcggccctgcctttgtggccctgattggagaccagtatggcccctgcctgatccccagcagaattgatgagaaggagtgggaggtgctgcgggaccacctgacagcccggcccagcgacctggagctggtggcccgctacttccagagagatgaaaatgccttcccccccacctacgtgctgcaggcccctggcaccggggaggcctgtgagcctgaggaggccaccctgacctctgtgctgcggagcggggcccaggaggcccggcggctgggcctcatcacccaggagcagtggcagcactaccacaggtctgtgattgagtgggagattgaaagaagcctgctgagcagtgaagatcgggagcagggcgccaccgtcttcctgcgggagatccaggacctgcacaagcacatcctggaggactgtgccctgaggatggtggaccggctggctgatggctgcctggatgctgatgcccagaacctgctgagcagcctgaagagccacatcacagacatgcaccctggggtgctgaagacccaccggctgccctggagccgggacctggtgaaccccaagaacaagacccacgcctgctacctgaaggagctgggggagcagtttgtggtgcgggccaaccaccaggtgctgacccggctgcgggagctggacacagctggccaggagctggcctggctgtaccaggagatccgccaccacctgtggcagagcagcgaggtgatccagaccttctgtggccggcaggagctgctggcccggctgggccagcagctgcggcatgatgacagcaagcagcacacccccctggtgctgtttggccccccaggcatcggcaagacagccctgatgtgcaagctggccgagcagatgccccggctgctgggccacaagacagtgacagtgctgcggctgctgggcaccagccagatgagcagtgatgcccggggcctgctgaagagcatctgcttccaggtgtgcctggcctacggcctgcccctgcccccagcccaggtgctggatgcccacaccagggtggtgcagttcttccacaccctgctgcacacagtgtcctgcaggaactttgagagcctggtgctgctgctggatgccatggatgacctggacagcgtgagacatgccaggagagtgccctggctgcccctgaactgccccccccgggtgcacctgatcctgagcgcctgcagcggggccctgggcgtgctggacaccctgcagagggtgctgctggaccctgaggcctactgggaggtgaagcccctgagcggcaaccagggccagcagatgatccagctgctgctggccgccgcccggaggaccctgagccctgtgcacacagacctgctgtgggccagcctgcctgaatgtggcaaccctggccgcctgcggctggcctttgaggaggccaggaagtgggccagcttcaccgtgcctgtgcccctggccaccacagctgaggaggccacccaccagctgtgcacccggctggagcagacccacggccagctgctggtggcccacgtgctgggctacatcgtgagcagcagacatggcctgtctgaggccgagctgaaggatgtgctgagcctggatgatgaggtgctgcaggatgtgtacagagactggaccccacccagcaaggagctgctgcgcttcccccccctgctgtgggtgcggctgcggcgggacctgggctactacctggcccggcggcctgtggatggcttcaccctgctggccatcgcccaccggcagctggtggaggtggtgcgggagcgctacctgagcggcagcgagcgggccaagagacatggagtgctggccgacttcttcagcggcacctggagccagggcaccaagaagctgatcaccctgcccctggtgggcaagcccctgaacctggacaggaaggtggccccccagcccctgtggttcagccacacagtggccaacctgaggaagctgaaggagctgccctaccacctgctgcacagcggccgcctggaggagctgaagcaggaggtgctgggctccatgtcctggatcagctgccggggcatcagcggcggcatcgaggacctgctggatgactttgacctgtgtgccccccacctggacagccctgaggtgggcctggtgcgggaggccctgcagctgtgcaggcctgctgtggagctgcggggcatggagaggagcctgctgtacacagagctgctggcccggctgcacttctttgccaccagccacccagccctggtgggccagctgtgccagcaggcccagagctggttccagctgtgtgcccaccctgtgctggtgcccctgggcggcttcctgcagcccccaggcggccccctgcgggccaccctgagcggctgccacaagggcatcacagccatggcctggggcgtggaggagaagctgctggtgattggcacccaggacggcatcatggctgtgtgggacatggaggagcagcacgtgatccacatgctgaccggccacactggagaggtgcgctgtgtgaagatctttgccaagggcaccctggccaacagcgccagcaaggactacaccctgcacctgtggaacctgctgagcggccaggagaagttcaccatctgggatggcggcagcaagaacccagctgagccccagatctggaacctgcacgtggatgaggcccacaaggtggtgtacagcgccagcggcagcaagatcaatgcctggaacctggagacagctgagcctgtgttccacatcctgggagatgccagtgacccctggatgtgcatggctgtgctggccagccaggccaccctgctgactgtgtccagagatggagtggtgtccctgtggagcagcgccaccgggaagctgcagggcaagcagcacatgagcagcatcaaggaggagacccccacctgtgctgtgtctgtgcagaagcagggcaagctggtgacaggcttcagcaatggcagcatcagcctggtgagcagcaaaggagaccggctgctggagaagctgcctgatgctgtgcgcttcctggtggtgtctgaagatgagagcctgctggccgccggcttcggccgctctgtgcgcatcttcctggccgacagccggggcttccgccgcttcatggccatggacctggagcacgaggacatggtggagacagctgtgtttggaacagagaacaacctgatcatcaccggcagcctggatgccctgatccaggtgtggagcctgtctgagcagggcaccctgctggacatcctggagggcgtgggcgcccctgtgtccctgctggcccggggcggggccctggtggccagcgccagcccccagagcagcagcttcaaggtgtgggacctgagtgatgcccacaggagccgggtgcctgcccccttcctggacagaacaggcctgacagctgtgagccacaacggcagctatgtgtacttccccaagatcggggacaagaacaaggtgaccatctgggacctggccgagggggaggagcaggacagcctggacaccagcagcgagatccgctgcctggaggtggccgagcagaggaagctgctcttcaccggcctggtgtctggagtggtgctggtgttccccctgaacagccggcaggatgtgatctgcatccccccacctgaggccaggaaggccatcaactgcatgagcctgagcaaatgtgaagatcggctggccatcgcctatgacaacatcgtgctggtgctggacatcaccagcggggacccctgccctgtgattgatggcccccgctacaccttctacacccagctgcctgagaccctgagctctgtggccatcctgacagactacagagtggtgtacagcatgaccaacggggacctcttcctgtatgaatgtgccaccagcaaggccttccccctggagacccacaggagccgggtggcctgtgtggaggtgagccacaaggagcagctggtggtgtctggctctgaagatgccctgctgtgcctgtgggacctgcaggccaggaagtggaagtttgagatgagctacacagccccctgctag

SEQ ID NO: 40208 - DNA, 4290 bp, Artificial Sequence; identical to SEQ ID NO: 40206
  Description of Artificial Sequence: Synthetic coding sequence

SEQ ID NO: 40209 - DNA, 4077 bp, Artificial Sequence
  Description of Artificial Sequence: Synthetic coding sequence
atggtggaccggctggctgatggctgcctggatgctgatgcccagaacctgctgagcagcctgaagagccacatcacagacatgcaccctggggtgctgaagacccaccggctgccctggagccgggacctggtgaaccccaagaacaagacccacgcctgctacctgaaggagctgggggagcagtttgtggtgcgggccaaccaccaggtgctgacccggctgcgggagctggacacagctggccaggagctggcctggctgtaccaggagatccgccaccacctgtggcagagcagcgaggtgatccagaccttctgtggccggcaggagctgctggcccggctgggccagcagctgcggcatgatgacagcaagcagcacacccccctggtgctgtttggccccccaggcatcggcaagacagccctgatgtgcaagctggccgagcagatgccccggctgctgggccacaagacagtgacagtgctgcggctgctgggcaccagccagatgagcagtgatgcccggggcctgctgaagagcatctgcttccaggtgtgcctggcctacggcctgcccctgcccccagcccaggtgctggatgcccacaccagggtggtgcagttcttccacaccctgctgcacacagtgtcctgcaggaactttgagagcctggtgctgctgctggatgccatggatgacctggacagcgtgagacatgccaggagagtgccctggctgcccctgaactgccccccccgggtgcacctgatcctgagcgcctgcagcggggccctgggcgtgctggacaccctgcagagggtgctgctggaccctgaggcctactgggaggtgaagcccctgagcggcaaccagggccagcagatgatccagctgctgctggccgccgcccggaggaccctgagccctgtgcacacagacctgctgtgggccagcctgcctgaatgtggcaaccctggccgcctgcggctggcctttgaggaggccaggaagtgggccagcttcaccgtgcctgtgcccctggccaccacagctgaggaggccacccaccagctgtgcacccggctggagcagacccacggccagctgctggtggcccacgtgctgggctacatcgtgagcagcagacatggcctgtctgaggccgagctgaaggatgtgctgagcctggatgatgaggtgctgcaggatgtgtacagagactggaccccacccagcaaggagctgctgcgcttcccccccctgctgtgggtgcggctgcggcgggacctgggctactacctggcccggcggcctgtggatggcttcaccctgctggccatcgcccaccggcagctggtggaggtggtgcgggagcgctacctgagcggcagcgagcgggccaagagacatggagtgctggccgacttcttcagcggcacctggagccagggcaccaagaagctgatcaccctgcccctggtgggcaagcccctgaacctggacaggaaggtggccccccagcccctgtggttcagccacacagtggccaacctgaggaagctgaaggagctgccctaccacctgctgcacagcggccgcctggaggagctgaagcaggaggtgctgggctccatgtcctggatcagctgccggggcatcagcggcggcatcgaggacctgctggatgactttgacctgtgtgccccccacctggacagccctgaggtgggcctggtgcgggaggccctgcagctgtgcaggcctgctgtggagctgcggggcatggagaggagcctgctgtacacagagctgctggcccggctgcacttctttgccaccagccacccagccctggtgggccagctgtgccagcaggcccagagctggttccagctgtgtgcccaccctgtgctggtgcccctgggcggcttcctgcagcccccaggcggccccctgcgggccaccctgagcggctgccacaagggcatcacagccatggcctggggcgtggaggagaagctgctggtgattggcacccaggacggcatcatggctgtgtgggacatggaggagcagcacgtgatccacatgctgaccggccacactggagaggtgcgctgtgtgaagatctttgccaagggcaccctggccaacagcgccagcaaggactacaccctgcacctgtggaacctgctgagcggccaggagaagttcaccatctgggatggcggcagcaagaacccagctgagccccagatctggaacctgcacgtggatgaggcccacaaggtggtgtacagcgccagcggcagcaagatcaatgcctggaacctggagacagctgagcctgtgttccacatcctgggagatgccagtgacccctggatgtgcatggctgtgctggccagccaggccaccctgctgactgtgtccagagatggagtggtgtccctgtggagcagcgccaccgggaagctgcagggcaagcagcacatgagcagcatcaaggaggagacccccacctgtgctgtgtctgtgcagaagcagggcaagctggtgacaggcttcagcaatggcagcatcagcctggtgagcagcaaaggagaccggctgctggagaagctgcctgatgctgtgcgcttcctggtggtgtctgaagatgagagcctgctggccgccggcttcggccgctctgtgcgcatcttcctggccgacagccggggcttccgccgcttcatggccatggacctggagcacgaggacatggtggagacagctgtgtttggaacagagaacaacctgatcatcaccggcagcctggatgccctgatccaggtgtggagcctgtctgagcagggcaccctgctggacatcctggagggcgtgggcgcccctgtgtccctgctggcccggggcggggccctggtggccagcgccagcccccagagcagcagcttcaaggtgtgggacctgagtgatgcccacaggagccgggtgcctgcccccttcctggacagaacaggcctgacagctgtgagccacaacggcagctatgtgtacttccccaagatcggggacaagaacaaggtgaccatctgggacctggccgagggggaggagcaggacagcctggacaccagcagcgagatccgctgcctggaggtggccgagcagaggaagctgctcttcaccggcctggtgtctggagtggtgctggtgttccccctgaacagccggcaggatgtgatctgcatccccccacctgaggccaggaaggccatcaactgcatgagcctgagcaaatgtgaagatcggctggccatcgcctatgacaacatcgtgctggtgctggacatcaccagcggggacccctgccctgtgattgatggcccccgctacaccttctacacccagctgcctgagaccctgagctctgtggccatcctgacagactacagagtggtgtacagcatgaccaacggggacctcttcctgtatgaatgtgccaccagcaaggccttccccctggagacccacaggagccgggtggcctgtgtggaggtgagccacaaggagcagctggtggtgtctggctctgaagatgccctgctgtgcctgtgggacctgcaggccaggaagtggaagtttgagatgagctacaccagcagctactgccggggcgtgcagtgtgcctgcttcagcaaggatgacaagtatgtgtatgtgggcctgaaggacaggagcatcctggtgtggagcgtgctggatggcaccctgctgactgtgcagtttgtgcatgctgtggtgaaccgcatcatccccaccaccagcggcttcatcgcccccaccaggcatggctacctgatccgggagaacttccagtgcctgagcgccaaggccagcccccaggaccccctgaagaacttcaagaaggccatgtggatggtgaagagccggcagcgggaggagctggtggccgccgccggggccccccaggacctggagagcgagagcgcccagggcaatgagaccaagagcaacaagtgcagccaggtgtgcctgattgtgtag

SEQ ID NO: 40210 - DNA, 4299 bp, Artificial Sequence; identical to SEQ ID NO: 40207
  Description of Artificial Sequence: Synthetic coding sequence

SEQ ID NO: 40211 - DNA, 1182 bp, Artificial Sequence
  Description of Artificial Sequence: Synthetic coding sequence
atggatgaaaatgaaagcaaccagagcctgatgaccagcagccagtaccccaaggaggccgtgaggaagaggcagaacagcgccagaaattctggggccagtgacagcagccgcttcagcaggaagagcttcaagctggactaccgcctggaggaggatgtgaccaagagcaagaagggcaaggatggccgctttgtgaacccctggcccacctggaagaaccccagcatccccaacgtgctgcgctggctgatcatggagaaggaccacagctctgtgcccagcagcaaggaggagctggacaaggagctgcctgtgctgaagccctacttcatcaccaaccctgaggaggccggcgtgcgggaggccggcctgcgggtgacctggctgggccacgccaccgtgatggtggagatggatgagctgatcttcctgacagaccccatcttcagcagccgggccagccccagccagtacatgggccccaagcgcttccgccgcagcccctgcaccatcagcgagctgccccccattgatgctgtgctgatcagccacaaccactatgaccacctggactacaacagcgtgattgccctgaatgaaagatttggaaatgagctgcgctggtttgtgcccctgggcctgctggactggatgcagaagtgtggctgtgaaaatgtcatcgagctggactggtgggaggagaactgtgtgcccggccatgacaaggtgacctttgtgttcacccccagccagcactggtgcaagaggaccctgatggatgacaacaaggtgctgtggggctcctggagcgtgctgggcccctggaaccgcttcttctttgctggggacaccggctactgcccagcctttgaggagatcggcaagcgcttcggcccctttgacctggccgccatccccatcggggcctatgagccccgctggttcatgaagtaccagcacgtggaccctgaggaggccgtgcgcatccacacagatgtgcagaccaagaagtccatggccatccactggggcacctttgccctggccaatgagcactacctggagccccctgtgaagctgaatgaggccctggagagatatggcctgaatgctgaggacttctttgtgctgaagcacggggagagccgctacctgaacaatgatgatgagaacttctag

SEQ ID NO: 40212 - DNA, 483 bp, Artificial Sequence
  Description of Artificial Sequence: Synthetic coding sequence
atggtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 40213 - DNA, 498 bp, Artificial Sequence
  Description of Artificial Sequence: Synthetic coding sequence
atgaggcagcaccggcagttcatggacaggacccactacctgctgaccttcagcagcagcgagaccctgctgcggctgctgctgcgcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 40214 - DNA, 483 bp, Artificial Sequence; identical to SEQ ID NO: 40212
  Description of Artificial Sequence: Synthetic coding sequence

SEQ ID NO: 40215 - DNA, 1122 bp, Artificial Sequence
  Description of Artificial Sequence: Synthetic coding sequence
atggagcctgctgtgtctgagcccatgagggaccaggtggcccggacccacctgacagaggacacccccaaggtgaatgctgacatcgagaaggtgaaccagaaccaggccaagcgctgcaccgtgattggaggcagcggcttcctgggccagcacatggtggagcagctgctggcccggggctatgctgtgaatgtgtttgacatccagcagggctttgacaacccccaggtgcgcttcttcctgggggacctgtgcagccggcaggacctgtacccagccctgaagggcgtgaacacagtgttccactgtgccagccccccacccagcagcaacaacaaggagctgttctacagagtgaactacatcggcaccaagaatgtgattgagacctgcaaggaggccggcgtgcagaagctgatcctgaccagcagcgccagcgtcatctttgagggcgtggacatcaagaatggaacagaggacctgccctatgccatgaagcccatcgactactacacagagaccaagatcctgcaggagagagctgtgctgggcgccaatgaccctgagaagaacttcctgaccacagccatccggccccacggcatcttcggcccccgggacccccagctggtgcccatcctgattgaggccgccagaaatggcaagatgaagtttgtgattggaaatggcaagaacctggtggacttcacctttgtggagaatgtggtgcacggccacatcctggccgctgagcagctgagccgggacagcaccctgggcggcaaggccttccacatcaccaatgatgagcccatccccttctggaccttcctgagccgcatcctgaccggcctgaactatgaggcccccaagtaccacatcccctactgggtggcctactacctggccctgctgctgagcctgctggtgatggtgatcagccctgtgatccagctgcagcccaccttcacccccatgagggtggccctggccggcaccttccactactacagctgtgagcgggccaagaaggccatgggctaccagcccctggtgaccatggatgatgccatggagaggacagtgcagagcttccgccacctgcggcgggtgaagtag

SEQ ID NO: 40216 - DNA, 1122 bp, Artificial Sequence; identical to SEQ ID NO: 40215
  Description of Artificial Sequence: Synthetic coding sequence

SEQ ID NO: 40217 - DNA, 264 bp, Artificial Sequence
  Description of Artificial Sequence: Synthetic coding sequence
atggccggggccagcctgggcgcccgcttctaccggcagatcaagaggcaccctggcatcatccccatgattggcctcatctgcctgggcatgggcagcgctgccctgtacctgctgcggctggccctgcggagcccagatgtgtgctgggacaggaagaacaaccctgagccctggaaccggctgagccccaatgaccagtacaagttcctggccgtgtccacagactacaagaagctgaagaaggacagaccagacttctag

SEQ ID NO: 40218 - DNA, 264 bp, Artificial Sequence; identical to SEQ ID NO: 40217
  Description of Artificial Sequence: Synthetic coding sequence

SEQ ID NO: 40219 - DNA, 387 bp, Artificial Sequence
  Description of Artificial Sequence: Synthetic coding sequence
atgacaggctacaccccagatgagaagctgcggctgcagcagctgcgggagctgcggcggcgctggctgaaggaccaggagctgagcccccgggagcctgtgctgcccccccagaagatgggccccatggagaagttctggaacaagttcctggagaacaagagcccctggaggaagatggtgcacggcgtgtacaagaagagcatctttgtgttcacccacgtgctggtgcctgtgtggatcatccactactacatgaagtaccacgtgtctgagaagccctatggaattgtggagaagaagagccgcatcttccctggggacaccatcctggagactggagaggtgatcccccccatgaaggagttcccagaccagcaccactag

SEQ ID NO: 40220 - DNA, 753 bp, Artificial Sequence
  Description of Artificial Sequence: Synthetic coding sequence
atggacatgctgcaggacctggagagcctgcagtttgaatatggagtgcctgaagaagatcgcatctggctgtacctgcagggccgcagccggggcctgatgattgaggcctgtgcccacgccaccttcttctgcaagctgctgtacaacctgcgggccagcctgaacaagaaccagagcagccgccacctgagcatcggcagcctgaacagcgccaccccagaggagttcaaggtgggcatcatcggcggcggccacctgggcaagcagctggccggcaccctgctgcagctgggccccatcccagctgagagcctgcgcatcagcaccaggaggcctgagaccctgggggagctgcagaagctgggcatcaagtgcttctaccacaatgctgacctggtgtcctgggcagatgtgatcttcctgtgctgcctgcccagccagctgcccaacatctgtgtggagatctacaccagcctggagaaggccagcatcgtgtacagctttgtggccgccatccccctgccccggctgaagctgctgctgaaccacaccaacatcctgcggccccagtaccagtatgatgaggacagcgtgtctgtgtggggcgccaacaagggcgtgattgctgccctgcaggaccccaccatcctgcaggccacctgcccctacagccctgctggccacggcagcacctacttctggcacagctttgagaactacttccctgtgggccccctgctgagctactag

SEQ ID NO: 40221 - DNA, 1080 bp, Artificial Sequence
  Description of Artificial Sequence: Synthetic coding sequence
atggacatgctgcaggacctggagagcctgcagtttgaatatggagtgcctgaagaagatcgcatctggctgtacctgcagggccgcagccggggcctgatgattgaggcctgtgcccacgccaccttcttctgcaagctgctgtacaacctgcgggccagcctgaacaagaaccagagcagccgccacctgagcatcggcagcctgaacagcgccaccccagaggagttcaaggtgggcatcatcggcggcggccacctgggcaagcagctggccggcaccctgctgcagctgggccccatcccagctgagagcctgcgcatcagcaccaggaggcctgagaccctgggggagctgcagaagctgggcatcaagtgcttctaccacaatgctgacctggtgtcctgggcagatgtgatcttcctgtgctgcctgcccagccagctgcccaacatctgtgtggagatctacaccagcctggagaaggccagcatcgtgtacagctttgtggccgccatccccctgccccggctgaagctgctgctgaaccacaccaacatcctgcggccccagtaccagtatgatgaggacagcgtgtctgtgtggggcgccaacaagggcgtgattgctgccctgcaggaccccaccatcctgcaggccacctgcccctacagccctgctgggggcatcatcctgaacatcaagtggctggagggcgtcttctatgctgccctgaacatctgcacagccaggaacatggcccacagccaggtgctgcagctgctgtctgagctgttcctgtctgtgcactttgaggactgtgggaaggacacagccagctgccccaagctgcagctgacagactttgtgtccaaggcctacggcaagaacctgagccaggagcggcccttcccctggtttgacctgacagctgtgcagctgaaggagacccccttcagccagcacctgagcagcagccctgtgctgcaggaccacctgacccacctgtactgtgccagctttggcatcagcctgaccaaggagcagcccgtcatcagcacaggcttccccagccagtag

SEQ ID NO: 40222 - DNA, 672 bp, Artificial Sequence
  Description of Artificial Sequence: Synthetic coding sequence
atggacatgctgcaggacctggagagcctgcagtttgaatatggagtgcctgaagaagatcgcatctggctgtacctgcagggccgcagccggggcctgatgattgaggcctgtgcccacgccaccttcttctgcaagctgctgtacaacctgcgggccagcctgaacaagaaccagagcagccgccacctgagcatcggcagcctgaacagcgccaccccagaggagttcaaggtgggcatcatcggcggcggccacctgggcaagcagctggccggcaccctgctgcagctgggccccatcccagctgagagcctgcgcatcagcaccaggaggcctgagaccctgggggagctgcagaagctgggcatcaagtgcttctaccacaatgctgacctggtgtcctgggcagatgtgatcttcctgtgctgcctgcccagccagctgcccaacatctgtgtggagatctacaccagcctggagaaggccagcatcgtgtacagctttgtggccgccatccccctgccccggctgaagctgctgctgaaccacaccaacatcctgcggccccagtaccagtatgatgaggacagcgtgtctgtgtggggcgccaacaagggcgtgattgctgccctgcaggaccccaccatcctgcaggccacctgcccctag

SEQ ID NO: 40223 - DNA, 699 bp, Artificial Sequence
  Description of Artificial Sequence: Synthetic coding sequence
atggacctgcccatccaggacagccatgacagcagcaccagccccaagggcaagcagcccaccacagctgagaagagcgccaccaagaaggaggacaaggtgcctgtgaagaagcagaagaccaggacagtgttcagcagcacccagctgtgtgtgctgaatgaccgcttccagaggcagaagtacctgagcctgcagcagatgcaggagctgagcaacatcctgaacctgagctacaagcaggtgaagacctggttccagaaccagaggatgaagagcaagcgctggcagaagaacaactggctgaagaacagcaatggagtgacccagggctgcctggtgaaccccactggaaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgtggggaggagagcctgcagagctgcatgcagttccagcccaacagccctgccagtgacctggaggccgccctggaggccgccggggagggcctgaatgtcatccagcagaccacccgctacttcaacaccccccagaccatggacctcttcctgaactacagcatgaacatgcagccagaagatgtgtag

SEQ ID NO: 40224 - DNA, 912 bp, Artificial Sequence
  Description of Artificial Sequence: Synthetic coding sequence
atgagcagcaccctgcctgccctgctgtgtgtgggcctgtgcctgagccagaggatcagcgcccagcagcagaccctgcccaagcccttcatctgggccgagccccacttcatggtgcccaaggagaagcaggtgaccatctgctgccagggcaactatggagctgtggagtaccagctgcactttgagggcagcctgtttgctgtggaccggcccaagcccccagagcgcatcaacaaggtgaagttctacatcccagacatgaacagcaggatggccggccagtacagctgcatctacagagtgggggagctgtggagcgagcccagcaacctgctggacctggtggtgacagagatgtatgacacccccaccctgtctgtgcaccctggccctgaggtgatcagcggggagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttcccagacacctggggcacctacctgctgaccacagaaacaggcctgcagaaggaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 40225 - DNA, 912 bp, Artificial Sequence; identical to SEQ ID NO: 40224
  Description of Artificial Sequence: Synthetic coding sequence

SEQ ID NO: 40226 - DNA, 912 bp, Artificial Sequence; identical to SEQ ID NO: 40224
  Description of Artificial Sequence: Synthetic coding sequence

SEQ ID NO: 40227 - DNA, 912 bp, Artificial Sequence; identical to SEQ ID NO: 40224
  Description of Artificial Sequence: Synthetic coding sequence

SEQ ID NO: 40228 - DNA, 912 bp, Artificial Sequence; identical to SEQ ID NO: 40224
  Description of Artificial Sequence: Synthetic coding sequence

SEQ ID NO: 40229 - DNA, 912 bp, Artificial Sequence; identical to SEQ ID NO: 40224
  Description of Artificial Sequence: Synthetic coding sequence

SEQ ID NO: 40230 - DNA, 912 bp, Artificial Sequence; identical to SEQ ID NO: 40224
  Description of Artificial Sequence: Synthetic coding sequence

SEQ ID NO: 40231 - DNA, 912 bp, Artificial Sequence; identical to SEQ ID NO: 40224
  Description of Artificial Sequence: Synthetic coding sequence

SEQ ID NO: 40232 - DNA, 5730 bp, Artificial Sequence
  Description of Artificial Sequence: Synthetic coding sequence
atggagggcaagaggcagctggagaagagggactttgggaagaggctgagcctggacagcagcctggtggagtacatggacagcaacaagtacatcgagcacctgctgacccagctggaggagcagcacaggagcctgtggagggagaagctggccgtggcccggctgcagcgggaggtggcccagaggaccagcgagggcgccatgcatgagaagctgattcatgagctggaggaggagcggcacctgcggctgcagagcgagaagaggctgcaggaggtgaccctggagagcgagaggaaccgcatccagatgaggagcctgcagcagcagttcagcaggatggaggagaccgtgaggaacctgctgcagagccagggcagccctgagcagaagaaggaggagaccgtgaacatcatggtgtaccaggagaagctgtctgaggaggagaggaagcacaaggaggccctggaggacctgcacatggtggtggatgaggacagccgctctgagagcagcagcacagatgagggcaaggagaagaccaagctgctgctggagcggctgaaggccctggaggctgaaaattctgccctggccctggagaatgaaaaccagcgggagcagtatgagcgctgcctggatgaggtggccaaccaggtggtgcaggccctgctgacccagaaggacctgcgggaggagtgtgtgaagctgaagaccagggtgtttgacctggagcagcagaacagaaccctgagcatcctcttccagcagagggtgcggcccaccagtgacctgctgctgcagaagctgcacagccggctgctggacctgagcagcggggacctgctgtctgaggtggagaggaacagaagcctgacccagagcaggacagatgctgaggtgcatgagcaccagctgaacaccaagagcgccctgaagtgccccggcctgggcgccgtcatccctggccacctgtgccccagaaattcctacagcagcagcagcgagctgagcctgagcagcacctgcagcgagtacagcagcggcagcagctacacctggcatgatggcaagaacctgaggaagaggcagagcagccagaactgggacaagaggctgagcattgacagcagcctgcccagcggctttgccagccccaccaatgagctgccccccacccgcatcaaggagagccacatcctggagggcctgaggaagctgcagaagaggaaggtgctgctggagcccccatctgtcatcaccaagtggggctacaaggactgcatgaacagcaatgaaggcatctacagccctggcatcaagagcagcagcctgaaggagtacccaccctgcaagacagctgacctgggcagcccctgcaaggagccccacaagacctttgtgtatgacctggacagccacgtggatgctgatgatgaccccagcaccctggccctgctgcaggccgtgcccaaccagagctgccggccccacggcagcaagctgacccacagcgtgtctgacagcctgtttggctgggagaccaacaggaagcacttcctggagggcaccagctctgtgtaccccaaggagaggcctgagaagctgaccagctgtgccagcagctgccccctggagatgaagctgtgccccagcgtgcagaccccccaggtgcagcgggagcggggcccccagggccagggccacggccgcatggccctgaacctgcagctgagtgacacagatgacaatgagacctttgatgagctgcacatcgagagcagtgatgagaagagccccagtgatgtgtccctggccgctgacacagacaagtctgtggagaacctggatgtgctggtgggctttgggaagagcctgtgtggcagccctgaggaggaggagaagcaggtgcccatccccagcgagacccggcccaagaccttctccttcatcaagcagcagagggtggtgaagaggaccagcagtgaagaatgtgtgaccgtcatctttgatgctgaagatggagagcccatcgagttcagcagccaccagacaggagtggtgacagtgaccagaaatgagatcagcatcaacagcaccccagctggccccaaggccgagcacacagagctgctgccccagggcatcgcctgcctgcagcccagggctgctgcccgggactacaccttcttcaagagaagtgaggaggacacagagaagaacatccccaaggacaacgtggacaacgtgccccgggtgtccacagagagcttcagcagcaggacagtgacccagaacccccagcagcagaagctggtgaagcccacccacaacatcagctgccagagcaacagccgcagcagcgcccccatgggcatctaccagaagcagaacctgaccaagatccccccccggggcaagagcagcccccagaagagcaagctgatggagcctgaggccaccaccctgctgcccagcagcggcctggtgaccctggagaagagccctgccctggcccctgggaagctgagccgcttcatgaagacagagagcagcggccccctgtttgagctgcggagtgacccccacatccccaagcacagcgcccagctgccccacagcagcaggatgcccagcagaagagactgggtgcagtgccccaagagccagaccccaggcagccgcagcaggcctgccatcgagagcagtgacagcggggagccccccaccagagatgagcactgcggcagcggccctgaggccggcgtgaagagccccagccccccacctcctcctggccgctctgtgtccctgctggcccggcccagctatgactacagccctgcccccagcagcaccaagtctgagaccagggtgcccagcgagacagcccggacccccttcaagagccccctgctgaagggcatcagcgcccctgtgatcagcagcaacccagccaccacagaggtgcagaggaagaagcccagcgtggccttcaagaagcccatcttcacccaccccatgcccagccctgaggccgtcatccagacccgctgcccagcccacgcccccagcagcagcttcaccgtgatggccctgggcccccccaaggtgagccccaagaggggcgtgcccaagaccagcccccggcagaccctgggcaccccccagagggacatcggcctgcagaccccccgcatcagccccagcacccatgagcccctggagatgaccagcagcaagtctgtgtccccaggcaggaagggccagctgaatgattctgccagcaccccacccaagcccagcttcctgggcgtgaatgaaagccccagcagccaggtgagcagcagcagcagcagcagcagccctgccaagagccacaacagcccccacggctgccagagcgcccacgagaagggcctgaagacccggctgcctgtgggcctgaaggtgctgatgaagagcccccagctgctgaggaagagcagcacagtgcctgggaagcatgagaaggacagcctgaatgaggccagcaagagctctgtggccgtgaacaagagcaagccagaggacagcaagaacccagcctccatggagatcacagctggggagagaaatgtgaccctgcctgacagccaggcccagggcagcctggctgatggcctgcccctggagacagccctgcaggagcccctggagagcagcatccctggcagtgatggaagagatggagtggacaacagatccatgaggaggagcctgagcagcagcaagccccacctgaagccagccctgggcatgaatggagccaaggcccggagccacagcttcagcacccacagcggggacaagcccagcaccccacccatcgagggcagcggcaaggtgaggacccagatcatcaccaacacagctgagcggggcaacagcctgacccggcagaacagcagcacagagagcagccccaacaaggcccccagcgcccccatgctggagagcctgcccagcgtgggccggcccagcggccaccccagcagcggcaagggcagcctgggcagcagcggcagcttcagcagccagcacggcagccccagcaagctgcccctgcgcatcccccccaagtctgagggcctgctgatccccccaggcaaggaggaccagcaggccttcacccagggagaatgtcccagcgccaacgtggccgtgctgggggagcccggcagtgacagaagaagctgcccccccacccccacagactgcccagaggccctgcagagccctggccgcacccagcaccccagcacctttgagaccagcagcaccagcaagctggagaccagcggccgccacccagatgccagcgccacagccacagatgctgtgagcagcgaggcccccctgagccccaccatcgaggagaaggtgatgctgtgcatccaggagaatgtggagaagggccaggtgcagaccaagcccacctctgtggaggccaagcagaagccaggccccagctttgcctcctggtttggcttcaggaagagccggctgcctgccctgagcagcaggaagatggacatcagcaagaccaaggtggagaagaaggatgccaaggtgctgggcttcggcaaccggcagctgaagtctgagaggaagaaggagaagaagaagccagagctgcagtgtgaaacagaaaatgagctgatcaaggacaccaagtctgctgacaacccagatggcggcctgcagagcaagaacaacagaaggaccccccaggacatctacaaccagctgaagattgagcccaggaacagacacagccctgtggcctgcagcaccaaggacaccttcatgacagagctgctgaacagagtggacaagaaggccgccccccagacagaaagtggcagcagcaatgccagctgcagaaatgtgctgaagggcagcagccagggcagctgcctgattggcagcagcatcagcacccagggcaaccacaagaagaacatgaagatcaaggctgacatggaggtgcccaaggacagcctggtgaaggaggccaatgaaaacctgcaggaggatgaagatgatgctgtggccgacagcgtcttccagagccacatcatcgagagcaactgccagatgaggaccctggacagcggcatcggcaccttccccctgcctgacagcggcaacagaagcacaggccgctacctgtgccagcctgacagcccagaagatgctgagcccctgctgcccctgcagagcgccctgtctgctgtgtcctccatgagggcccagaccctggagcgggaggtgcccagcagcacagatggccagaggcctgctgacagcgccatcgtgcacagcaccagtgaccccatcatgacagcccggggcatgaggcccctgcagagccggctgcccaagccagccagcagcggcaaggtgagcagccagaagcagaatgaagctgagccccggccccagacctgcagcagctttggctatgcagaggaccccatggccagccagcccctgcctgactggggcagcgaggtggccgccaccggcacccaggacaaggcccccaggatgtgcacctacagcgccagcggcggcagcaacagcgacagcgacctggactatggagacaatggatttggagctggccggggccagctggtgaaggccctgaagtctgctgcccctgagattgagaccacctag

SEQ ID NO: 40233 - DNA, 210 bp, Artificial Sequence
  Description of Artificial Sequence: Synthetic coding sequence
atggagggcaagaggcagctggagaagagggactttgggaagaggctgagcctggacagcagcctggtggagtacatggacagcaacaagtacatcgagcacctgctgacccagctggaggagcagcacaggagcctgtggagggagaagctggccgtggcccggctgcagcgggaggtggcccagaggaccagcgagggcgccatgtag

SEQ ID NO: 40234 - DNA, 1773 bp, Artificial Sequence
  Description of Artificial Sequence: Synthetic coding sequence
atggagggcaagaggcagctggagaagagggactttgggaagaggctgagcctggacagcagcctggtggagtacatggacagcaacaagtacatcgagcacctgctgacccagctggaggagcagcacaggagcctgtggagggagaagctggccgtggcccggctgcagcgggaggtggcccagaggaccagcgagggcgccatgcatgagaagctgattcatgagctggaggaggagcggcacctgcggctgcagagcgagaagaggctgcaggaggtgaccctggagagcgagaggaaccgcatccagatgaggagcctgcagcagcagttcagcaggatggaggagaccgtgaggaacctgctgcagagccagggcagccctgagcagaagaaggaggagaccgtgaacatcatggtgtaccaggagaagctgtctgaggaggagaggaagcacaaggaggccctggaggacctgcacatggtggtggatgaggacagccgctctgagagcagcagcacagatgagggcaaggagaagaccaagctgctgctggagcggctgaaggccctggaggctgaaaattctgccctggccctggagaatgaaaaccagcgggagcagtatgagcgctgcctggatgaggtggccaaccaggtggtgcaggccctgctgacccagaaggacctgcgggaggagtgtgtgaagctgaagaccagggtgtttgacctggagcagcagaacagaaccctgagcatcctcttccagcagagggtgcggcccaccagtgacctgctgctgcagaagctgcacagccggctgctggacctgagcagcggggacctgctgtctgaggtggagaggaacagaagcctgacccagagcaggacagatgctgaggtgcatgagcaccagctgaacaccaagagcgccctgaagtgccccggcctgggcgccgtcatccctggccacctgtgccccagaaattcctacagcagcagcagcgagctgagcctgagcagcacctgcagcgagtacagcagcggcagcagctacacctggcatgatggcaagaacctgaggaagagggtgaaggaggccaatgaaaacctgcaggaggatgaagatgatgctgtggccgacagcgtcttccagagccacatcatcgagagcaactgccagatgaggaccctggacagcggcatcggcaccttccccctgcctgattctggcaacagaagcacaggccgctacctgtgccagcctgacagcccagaagatgctgagcccctgctgcccctgcagagcgccctgtctgctgtgtcctccatgagggcccagaccctggagcgggaggtgcccagcagcacagatggccagaggcctgctgacagcgccatcgtgcacagcaccagtgaccccatcatgacagcccggggcatgaggcccctgcagagccggctgcccaagccagccagcagcggcaaggtgagcagccagaagcagaatgaggccgagccccggccccagacctgcagcagctttggctatgcagaggaccccatggccagccagcccctgcctgactggggcagcgaggtggccgccaccggcacccaggacaaggcccccaggatgtgcacctacagcgccagcggcggcagcaacagcgacagcgacctggactatggagacaatggatttggagctggccggggccagctggtgaaggccctgaagtctgctgcccctgagattgagaccacctag

SEQ ID NO: 40235 - DNA, 1773 bp, Artificial Sequence; identical to SEQ ID NO: 40234
  Description of Artificial Sequence: Synthetic coding sequence

SEQ ID NO: 40236 - DNA, 5730 bp, Artificial Sequence; identical to SEQ ID NO: 40232
  Description of Artificial Sequence: Synthetic coding sequence

SEQ ID NO: 40237 - DNA, 1773 bp, Artificial Sequence
  Description of Artificial Sequence: Synthetic coding sequence
atggagggcaagaggcagctggagaagagggactttgggaagaggctgagcctggacagcagcctggtggagtacatggacagcaacaagtacatcgagcacctgctgacccagctggaggagcagcacaggagcctgtggagggagaagctggccgtggcccggctgcagcgggaggtggcccagaggaccagcgagggcgccatgcatgagaagctgattcatgagctggaggaggagcggcacctgcggctgcagagcgagaagaggctgcaggaggtgaccctggagagcgagaggaaccgcatccagatgaggagcctgcagcagcagttcagcaggatggaggagaccgtgaggaacctgctgcagagccagggcagccctgagcagaagaaggaggagaccgtgaacatcatggtgtaccaggagaagctgtctgaggaggagaggaagcacaaggaggccctggaggacctgcacatggtggtggatgaggacagccgctctgagagcagcagcacagatgagggcaaggagaagaccaagctgctgctggagcggctgaaggccctggaggctgaaaattctgccctggccctggagaatgaaaaccagcgggagcagtatgagcgctgcctggatgaggtggccaaccaggtggtgcaggccctgctgacccagaaggacctgcgggaggagtgtgtgaagctgaagaccagggtgtttgacctggagcagcagaacagaaccctgagcatcctcttccagcagagggtgcggcccaccagtgacctgctgctgcagaagctgcacagccggctgctggacctgagcagcggggacctgctgtctgaggtggagaggaacagaagcctgacccagagcaggacagatgctgaggtgcatgagcaccagctgaacaccaagagcgccctgaagtgccccggcctgggcgccgtcatccctggccacctgtgccccagaaattcctacagcagcagcagcgagctgagcctgagcagcacctgcagcgagtacagcagcggcagcagctacacctggcatgatggcaagaacctgaggaagagggtgaaggaggccaatgaaaacctgcaggaggatgaagatgatgctgtggccgacagcgtcttccagagccacatcatcgagagcaactgccagatgaggaccctggacagcggcatcggcaccttccccctgcctgattctggcaacagaagcacaggccgctacctgtgccagcctgacagcccagaagatgctgagcccctgctgcccctgcagagcgccctgtctgctgtgtcctccatgagggcccagaccctggagcgggaggtgcccagcagcacagatggccagaggcctgctgacagcgccatcgtgcacagcaccagtgaccccatcatgacagcccggggcatgaggcccctgcagagccggctgcccaagccagccagcagcggcaaggtgagcagccagaagcagaatgaggccgagccccggccccagacctgcagcagctttggctatgcagaggaccccatggccagccagcccctgcctgactggggcagcgaggtggccgccaccggcacccaggacaaggcccccaggatgtgcacctacagcgccagcggcggcagcaacagcgacagcgacctggactatggagacaatggatttggagctggccggggccagctggtgaaggccctgaagtctgctgcccctgagatgcccatcacctag

SEQ ID NO: 40238 - DNA, 537 bp, Artificial Sequence
  Description of Artificial Sequence: Synthetic coding sequence
atggacagcaacaagtacatcgagcacctgctgacccagctggaggagcagcacaggagcctgtggagggagaagctggccgtggcccggctgcagcgggaggtggcccagaggaccagcgagggcgccatgcatgagaagctgatccacgagctggaggaggagcggcacctgcggctgcagagcgagaagaggctgcaggaggtgaccctggagagcgagaggaaccgcatccagatgaggagcctgcagcagcagttcagcaggatggaggagaccgtgaggaacctgctgcagagccagggcagccctgagcagaagaaggaggagaccgtgaacatcatggtgtaccaggagaagctgtctgaggaggagaggaagcacaaggaggccctggaggacctgcacatggtggtggatgaggacagccgctctgagagcagcagcacagatgagggcaaggagaagaccaagctgctgctggagcggctgaaggccctggagagaaatggctggaactggcaccctgtgtcctag

SEQ ID NO: 40239 - DNA, 4005 bp, Artificial Sequence
  Description of Artificial Sequence: Synthetic coding sequence
atgtctgaggccatggaccagcctgctgggggccctggcaaccccaggcctggagaaggagatgatggctccatggagcccggcacctgccaggagctgctgcaccggctgcgggagctggaggctgaaaattctgccctggcccaggccaatgaaaaccagcgggagacctatgagcgctgcctggatgaggtggccaaccacgtggtgcaggccctgctgaaccagaaggacctgcgggaggagtgcatcaagctgaagaagagggtgtttgacctggagcggcagaaccagatgctgagcgccctcttccagcagaagctgcagctgaccaccggcagcctgccccagatccccctgacccccctgcagcccccatctgagcccccagccagccccagcctgagcagcacagagggccctgctgcccccctgcccctgggccactgtgccggccagcgggaggtgtgctgggagcagcagctgcggcctgggggccctggccccccagctgcccctcctccagccctggatgccctgagccccttcctgaggaagaaggcccagatcctggaggtgctgcgggccctggaggagacagaccccctgctgctgtgcagccctgccaccccctggaggcctcctggccagggccctggcagccctgagcccatcaacggggagctgtgtggccccccccagcctgagcccagcccctgggccccctgcctgctgctgggccctggcaacctgggcggcctgctgcactgggagcggctgctgggcggcctgggcggggaggaggacaccggccggccctggggccccagccggggccccccccaggcccagggcaccagcagcggccccaactgtgcccctggcagcagcagcagcagcagcagtgatgaagctggggaccccaatgaggcccccagcccagacaccctgctgggcgccctggcccggcggcagctgaacctgggccagctgctggaggacacagagagctacctgcaggccttcctggccggggctgctggccccctgaatggagaccaccctggccctggccagagcagcagcccagaccaggccccaccccagctgagcaagagcaagggcctgcccaagagcgcctggggcggcggcaccccagaggcccacaggcctggctttggagccaccagcgagggccagggccccctgcccttcctgtccatgttcatgggcgctggagatgcccccctgggcagcaggcctggccacccccacagcagcagccaggtgaagagcaagctgcagatcggcccccccagccctggagaggcccagggccccctgctgcccagccctgcccggggcctgaagttcctgaagctgccccccaccagcgagaagagccccagccctgggggcccccagctgagcccccagctgcccaggaacagccgcatcccctgcagaaattctggcagtgatggcagccccagccccctgctggcccggcggggcctgggcggcggggagctgagccctgagggcgcccagggcctgcccaccagccccagcccctgctacaccaccccagacagcacccagctgcggcccccccagagcgccctgagcaccaccctgagccctggccctgtggtgagcccctgctatgagaacatcctggacctgagccgcagcaccttccggggccccagccctgagcccccacccagccccctgcaggtgcccacctacccccagctgaccctggaggtgccccaggcccctgaggtgctgcggagccctggggtgccccccagcccctgcctgcctgagagctacccctacggcagcccccaggagaagagcctggacaaggccggcagcgagagcccccaccctggaagaaggaccccaggcaacagcagcaagaagcccagccagggcagcggcagaagacctggggaccccggcagcacccccctgcgggaccggctggccgccctgggcaagctgaagacaggccctgagggcgccctgggcagcgagaagaatggagtgcctgcccggcccggcacagagaagacccggggccctgggaagtctggagagagcgctggggacatggtgcccagcatccaccggcccctggagcagctggaggccaagggcggcatcagaggagctgtggccctgggcaccaacagcctgaagcagcaggagcccggcctgatgggagaccccggggcccgggtgtacagcagccacagcatgggcgcccgggtggacctggagcctgtgagccccaggagctgcctgaccaaggtggagctggccaagagccggctggccggggccctgtgcccccaggtgcccaggaccccagccaaggtgcccaccagcgcccccagcctgggcaagcccaacaagagcccccacagcagccccaccaagctgcccagcaagagccccaccaaggtggtgcccaggcctggggcccccctggtgaccaaggagagccccaagccagacaagggcaagggccccccctgggccgactgtggcagcaccacagcccagagcacccccctggtgcccggccccacagaccccagccagggccctgagggcctggccccccacagcgccatcgaggagaaggtgatgaagggcattgaagaaaatgtgctgcggctgcagggccaggagcgggcccctggagctgaggtgaagcacaggaacaccagcagcatcgcctcctggtttggcctgaagaagagcaagctgcctgccctgaacagaagaacagaggccaccaagaacaaggagggcgctgggggcggcagccccctgcggcgggaggtgaagatggaggccaggaagctggaggccgagagcctgaacatcagcaagctgatggccaaggccgaggacctgcggcgggccctggaggaggagaaggcctacctgagcagccgggcccggcccaggcctgggggccctgcccctggccccaacacaggcctgggccaggtgcagggccagctggccggcatgtaccagggcgctgacaccttcatgcagcagctgctgaacagagtggatggcaaggagctgcccagcaagtcctggagggagcccaagccagaatatggagacttccagcctgtgtccagtgaccccaagagcccctggccagcctgtggccccagaaatggcctggtgggccccctgcagggctgtgggaagcccccaggcaagcccagcagcgagcctggaagaagagaggagatgcccagcgaggacagcctggccgagcctgtgcccaccagccacttcaccgcctgtggcagcctgaccaggaccctggacagcggcatcggcaccttccccccaccagaccacggcagcagcggcacccccagcaagaacctgcccaagaccaagccaccccggctggaccccccacctggggtgcccccagcccggcccccacccctgaccaaggtgccccggcgggcccacaccctggagcgggaggtgcccggcatcgaggagctgctggtgtctggccgccaccccagcatgcctgccttccctgccctgctgcctgctgcccctggccaccggggccacgagacctgcccagatgacccctgtgaggaccccggccccaccccacctgtgcagctggccaagaactggaccttccccaacaccagggctgctggcagcagcagtgaccccctgatgtgccccccccggcagctggagggcctgcccaggacccccatggccctgcctgtggacaggaagaggagccaggagcccagccggcccagccccaccccccagggccccccatttggaggcagcaggacccccagcaccagtgacatggccgaggagggccgggtggccagcggcggccccccaggcctggagaccagcgagagcctgagtgacagcctgtatgacagcctgagcagctgtggcagccagggctag

SEQ ID NO: 40240 - DNA, 3927 bp, Artificial Sequence
  Description of Artificial Sequence: Synthetic coding sequence
atggaccagcctgctgggggccctggcaaccccaggcctggagaaggagatgatggctccatggagcccggcacctgccaggagctgctgcaccggctgcgggagctggaggctgaaaattctgccctggcccaggccaatgaaaaccagcgggagacctatgagcgctgcctggatgaggtggccaaccacgtggtgcaggccctgctgaaccagaaggacctgcgggaggagtgcatcaagctgaagaagagggtgtttgacctggagcggcagaaccagatgctgagcgccctcttccagcagaagctgcagctgaccaccggcagcctgccccagatccccctgacccccctgcagcccccatctgagcccccagccagccccagcctgagcagcacagagggccctgctgcccccctgcccctgggccactgtgccggccagcgggaggtgtgctgggagcagcagctgcggcctgggggccctggccccccagctgcccctcctccagccctggatgccctgagccccttcctgaggaagaaggcccagatcctggaggtgctgcgggccctggaggagacagaccccctgctgctgtgcagccctgccaccccctggaggcctcctggccagggccctggcagccctgagcccatcaacggggagctgtgtggccccccccagcctgagcccagcccctgggccccctgcctgctgctgggccctggcaacctgggcggcctgctgcactgggagcggctgctgggcggcctgggcggggaggaggacaccggccggccctggggccccagccggggccccccccaggcccagggcaccagcagcggccccaactgtgcccctggcagcagcagcagcagcagcagtgatgaagctggggaccccaatgaggcccccagcccagacaccctgctgggcgccctggcccggcggcagctgaacctgggccagctgctggaggacacagagagctacctgcaggccttcctggccggggctgctggccccctgaatggagaccaccctggccctggccagagcagcagcccagaccaggccccaccccagctgagcaagagcaagggcctgcccaagagcgcctggggcggcggcaccccagaggcccacaggcctggctttggagccaccagcgagggccagggccccctgcccttcctgtccatgttcatgggcgctggagatgcccccctgggcagcaggcctggccacccccacagcagcagccaggtgaagagcaagctgcagatcggcccccccagccctggagaggcccagggccccctgctgcccagccctgcccggggcctgaagttcctgaagctgccccccaccagcgagaagagccccagccctgggggcccccagctgagcccccagctgcccaggaacagccgcatcccctgcagaaattctggcagtgatggcagccccagccccctgctggcccggcggggcctgggcggcggggagctgagccctgagggcgcccagggcctgcccaccagccccagcccctgctacaccaccccagacagcacccagctgcggcccccccagagcgccctgagcaccaccctgagccctggccctgtggtgagcccctgctatgagaacatcctggacctgagccgcagcaccttccggggccccagccctgagcccccacccagccccctgcaggtgcccacctacccccagctgaccctggaggtgccccaggcccctgaggtgctgcggagccctggggtgccccccagcccctgcctgcctgagagctacccctacggcagcccccaggagaagagcctggacaaggccggcagcgagagcccccaccctggaagaaggaccccaggcaacagcagcaagaagcccagccagggcagcggcagaagacctggggaccccggcagcacccccctgcgggaccggctggccgccctgggcaagctgaagacaggccctgagggcgccctgggcagcgagaagaatggagtgcctgcccggcccggcacagagaagacccggggccctgggaagtctggagagagcgctggggacatggtgcccagcatccaccggcccctggagcagctggaggccaagggcggcatcagaggagctgtggccctgggcaccaacagcctgaagcagcaggagcccggcctgatgggagaccccggggcccgggtgtacagcagccacagcatgggcgcccgggtggacctggagcctgtgagccccaggagctgcctgaccaaggtgcccaccagcgcccccagcctgggcaagcccaacaagagcccccacagcagccccaccaagctgcccagcaagagccccaccaaggtggtgcccaggcctggggcccccctggtgaccaaggagagccccaagccagacaagggcaagggccccccctgggccgactgtggcagcaccacagcccagagcacccccctggtgcccggccccacagaccccagccagggccctgagggcctggccccccacagcgccatcgaggagaaggtgatgaagggcattgaagaaaatgtgctgcggctgcagggccaggagcgggcccctggagctgaggtgaagcacaggaacaccagcagcatcgcctcctggtttggcctgaagaagagcaagctgcctgccctgaacagaagaacagaggccaccaagaacaaggagggcgctgggggcggcagccccctgcggcgggaggtgaagatggaggccaggaagctggaggccgagagcctgaacatcagcaagctgatggccaaggccgaggacctgcggcgggccctggaggaggagaaggcctacctgagcagccgggcccggcccaggcctgggggccctgcccctggccccaacacaggcctgggccaggtgcagggccagctggccggcatgtaccagggcgctgacaccttcatgcagcagctgctgaacagagtggatggcaaggagctgcccagcaagtcctggagggagcccaagccagaatatggagacttccagcctgtgtccagtgaccccaagagcccctggccagcctgtggccccagaaatggcctggtgggccccctgcagggctgtgggaagcccccaggcaagcccagcagcgagcctggaagaagagaggagatgcccagcgaggacagcctggccgagcctgtgcccaccagccacttcaccgcctgtggcagcctgaccaggaccctggacagcggcatcggcaccttccccccaccagaccacggcagcagcggcacccccagcaagaacctgcccaagaccaagccaccccggctggaccccccacctggggtgcccccagcccggcccccacccctgaccaaggtgccccggcgggcccacaccctggagcgggaggtgcccggcatcgaggagctgctggtgtctggccgccaccccagcatgcctgccttccctgccctgctgcctgctgcccctggccaccggggccacgagacctgcccagatgacccctgtgaggaccccggccccaccccacctgtgcagctggccaagaactggaccttccccaacaccagggctgctggcagcagcagtgaccccctgatgtgccccccccggcagctggagggcctgcccaggacccccatggccctgcctgtggacaggaagaggagccaggagcccagccggcccagccccaccccccagggccccccatttggaggcagcaggacccccagcaccagtgacatggccgaggagggccgggtggccagcggcggccccccaggcctggagaccagcgagagcctgagtgacagcctgtatgacagcctgagcagctgtggcagccagggctag

SEQ ID NO: 40241 - DNA, 1116 bp, Artificial Sequence
  Description of Artificial Sequence: Synthetic coding sequence
atggccggcctgcaggagctgcgcttccctgaggagaagcccctgctgcggggccaggatgccacagagctggagagcagtgatgccttcctgctggccgctgacacagactggaaggagcatgacatcgagaccccctacggcctgctgcacgtggtgatccggggcagccccaagggcaacagacctgccatcctgacctaccatgatgtgggcctgaaccacaagctgtgcttcaacaccttcttcaactttgaggacatgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggaattggagtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagccggcgggacctggacatcaaccggcccggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40242 - DNA, 1110 bp, Artificial Sequence
  Description of Artificial Sequence: Synthetic coding sequence
atgcctgagtgctgggatggagtgggggagggcaatgctggagctgtgaagctggccggcctgggggacccccgctggagccctggccacctgctgagccctggccaccaggagcatgacatcgagaccccctacggcctgctgcacgtggtgatccggggcagccccaagggcaacagacctgccatcctgacctaccatgatgtgggcctgaaccacaagctgtgcttcaacaccttcttcaactttgaggacatgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggaattggagtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagccggcgggacctggacatcaaccggcccggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40243 - DNA, 1116 bp, Artificial Sequence; identical to SEQ ID NO: 40241
  Description of Artificial Sequence: Synthetic coding sequence

SEQ ID NO: 40244 - DNA, 1176 bp, Artificial Sequence
  Description of Artificial Sequence: Synthetic coding sequence
atgaaggtgctgggccaccggctggagctgctgaccggcctgctgctgcatgatgtgaccatggccggcctgcaggagctgcgcttccctgaggagaagcccctgctgcggggccaggatgccacagagctggagagcagtgatgccttcctgctggccgctgacacagactggaaggagcatgacatcgagaccccctacggcctgctgcacgtggtgatccggggcagccccaagggcaacagacctgccatcctgacctaccatgatgtgggcctgaaccacaagctgtgcttcaacaccttcttcaactttgaggacatgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggaattggagtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagccggcgggacctggacatcaaccggcccggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40245 - DNA, 894 bp, Artificial Sequence
  Description of Artificial Sequence: Synthetic coding sequence
atgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggcatcggcgtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagcagaagagacctggacatcaacagacctggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatcgcctacctgaaggaccggcggctgtctggaggagctgtgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40246 - DNA, 1020 bp, Artificial Sequence
  Description of Artificial Sequence: Synthetic coding sequence
atgcctgagtgctgggatggagaacatgacatcgagaccccctacggcctgctgcacgtggtgatccggggcagccccaagggcaacagacctgccatcctgacctaccatgatgtgggcctgaaccacaagctgtgcttcaacaccttcttcaactttgaggacatgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggaattggagtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagccggcgggacctggacatcaaccggcccggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40247 - DNA, 1059 bp, Artificial Sequence
  Description of Artificial Sequence: Synthetic coding sequence
atgcctgagtgctgggatggagaacatgacatcgagaccccctacggcctgctgcacgtggtgatccggggcagccccaagggcaacagacctgccatcctgacctaccatgatgtgggcctgaaccacaagctgtgcttcaacaccttcttcaactttgaggacatgcaggagatcaccaagcactttgtggtgtgccacgtggatgcccctggccagcaggtgggcgccagccagttcccccagggctaccagttccccagcatggagcagctggccgccatgctgcccagcgtggtgcagcacttcggcttcaagtatgtgattggaattggagtgggcgctggggcctacgtgctggccaagtttgccctgatcttcccagacctggtggagggcctggtgctggtgaacatcgaccccaacgggaagggctggattgactgggccgccaccaagctgagcggcctgaccagcaccctgcctgacacagtgctgagccacctgttcagccaggaggagctggtgaacaacacagagctggtgcagagctaccggcagcagattggaaatgtggtgaaccaggccaacctgcagctgttctggaacatgtacaacagccggcgggacctggacatcaaccggcccggcaccgtgcccaatgccaagaccctgcgctgccctgtgatgctggtggtgggggacaatgccccagcagaagatggagtggtggagtgcaacagcaagctggaccccaccaccaccaccttcctgaagatggctgacagcggcggcctgccccaggtgacccagcccgggaagctgacagaggccttcaagtacttcctgcagggcatgggctacatcgcctacctgaaggaccggcggctgagcggcggcgctgtgcccagcgcctccatgacccggctggcccggagcaggacagccagcctgaccagcgccagctctgtggatggcagccggccccaggcctgcacccacagcgagagcagcgagggcctgggccaggtgaaccacaccatggaggtgtcctgctag

SEQ ID NO: 40248 - DNA, 345 bp, Artificial Sequence
  Description of Artificial Sequence: Synthetic coding sequence
atgattgccaggagaaatcctgagcccctgcgcttcctgcctgatgaggcccggagcctgcccccacccaagctgacagacccccggctgctgtacatcggcttcctgggctactgcagcggcctgattgacaacctgatcagaagaagacccatcgccacagctggcctgcaccggcagctgctgtacatcacagccttcttctttgctggctactacctggtgaagcgggaggactacctgtatgctgtgcgggaccgggagatgtttggctacatgaagctgcaccctgaggacttcccagaagaagatgtgtactgctgcggggctgagcggcggggctag

SEQ ID NO: 40249 - DNA, 732 bp, Artificial Sequence
  Description of Artificial Sequence: Synthetic coding sequence
atggaggacagcttcctgcagagctttggccgcctgagcctgcagccccagcagcagcagcagaggcagaggcctccccggcccccaccccggggcaccccaccccggcggcacagcttcaggaagcacctgtacctgctgcggggcctgcccggcagcggcaagaccaccctggcccggcagctgcagcacgacttcccccgggccctgatcttcagcacagatgacttcttcttcagagaagatggagcctatgagttcaacccagacttcctggaggaggcccacgagtggaaccagaagagggccaggaaggccatgagaaatggcatcagccccatcatcatcgacaacaccaacctgcacgcctgggagatgaagccctatgctgtgatggccctggagaacaactatgaggtgatcttccgggagccagacacccgctggaagttcaacgtgcaggagctggcccggaggaacatccacggcgtgtcccgggagaagatccacaggatgaaggagagatatgaacatgatgtgaccttccacagcgtgctgcacgccgagaagcccagcaggatgaacagaaaccaggacaggaacaatgccctgcccagcaacaatgcccgctactggaacagctacacagagttccccaacagaagagcccacggcggcttcaccaatgaaagcagctaccacagaagaggaggctgccaccacggctactag

SEQ ID NO: 40250 - DNA, 414 bp, Artificial Sequence
  Description of Artificial Sequence: Synthetic coding sequence
atgagaaatggcatcagccccatcatcatcgacaacaccaacctgcacgcctgggagatgaagccctatgctgtgatggccctggagaacaactatgaggtgatcttccgggagccagacacccgctggaagttcaacgtgcaggagctggcccggaggaacatccacggcgtgtcccgggagaagatccacaggatgaaggagagatatgaacatgatgtgaccttccacagcgtgctgcacgccgagaagcccagcaggatgaacagaaaccaggacaggaacaatgccctgcccagcaacaatgcccgctactggaacagctacacagagttccccaacagaagagcccacggcggcttcaccaatgaaagcagctaccacagaagaggaggctgccaccacggctactag

SEQ ID NO: 40251 - DNA, 522 bp, Artificial Sequence
  Description of Artificial Sequence: Synthetic coding sequence
atggaggacagcttcctgcagagctttggccgcctgagcctgcagccccagcagcagcagcagaggcagaggcctccccggcccccaccccggggcaccccaccccggcggcacagcttcaggaagcacctgtacctgctgcggggcctgcccggcagcggcaagaccaccctggcccggcagctgcagcacgacttcccccgggccctgatcttcagcacagatgacttcttcttcagagaagatggagcctatgagttcaacccagacttcctggaggaggcccacgagtggaaccagaagagggccaggaaggccatgagaaatggcatcagccccatcatcatcgacaacaccaacctgcacgcctgggagatgaagccctatgctgtgatggtgttccagacagagcagaagaacctcttccggctggagatggacatggtggtgttccggcctgagatgaagaagcacagctggtgcctgaagaggaagaaccccccaaatgaaagaacagtgtag

SEQ ID NO: 40252 - DNA, 1752 bp, Artificial Sequence
  Description of Artificial Sequence: Synthetic coding sequence
atgtcctatggagaaattgagggcaagttcctgggcccccgggaggaggtgaccagcgagccccgctgcaagaagctgaagagcaccacagagagctatgtgttccacaaccacagcaatgctgacttccaccgcatccaggagaagacaggaaatgactgggtgcctgtgaccatcattgatgtgcggggccacagctacctgcaggagaacaagatcaagaccacagacctgcaccggcccctgcatgatgagatgcctggcaacagaccagatgtgattgagagcattgacagccaggtgctgcaggaggcccggccccccctggtgtctgcagatgatgagatctacagcaccagcaaggccttcatcggccccatctacaagcccccagagaagaagaagagaaatgaaggaagaaatgaggcccacgtgctgaatggcatcaatgacagaggaggccagaaggagaagcagaagttcaacagcgagaagtcagaaattgacaatgagctgttccagttctacaaggagattgaggagctggagaaggagaaggatggctttgagaacagctgcaaggagagcgagcccagccaggagcagtttgtgcccttctatgagggccacaacaacggcctgctgaagccagatgaggagaagaaggacctgagcaacaaggccatgcccagccactgtgactaccagcagaacctgggcaatgaaccagacaagtacccctgcaatggccaggtgatccccaccttctgtgacaccagcttcaccagcttccggcctgagtggcagagcgtgtaccccttcatcgtgccctacggcccccccctgcccagcctgaactaccacctgaacatccagcgcttcagcggcccccccaacccccccagcaacatcttccaggcccaggatgacagccagatccagaatggctactacgtgaacaactgccacgtgaactggaactgcatgacctttgaccagaacaatgagtacacagactgcagcgagaacagaagctctgtgcaccccagcggaaatggctgcagcatgcaggaccgctacgtgtccaatggcttctgtgaggtgcgggagcgctgctggaaggaccactgcatggacaagcacaacggcacagacagatttgtgaaccagcagttccaggaggagaagctgaacaagctgcagaagctgctgatcctgctgcggggcctgcccggcagcggcaagaccaccctgagccgcatcctgctgggccagaacagagatggcatcgtgttcagcacagatgactacttccaccaccaggacggctaccgctacaacgtgaaccagctgggagatgcccatgactggaaccagaacagagccaagcaggccatcgaccagggccgcagccctgtgatcatcgacaacaccaacatccaggcctgggagatgaagccctacgtggaggtggccatcggcaagggctacagagtggagttccacgagcctgagacctggtggaagtttgatcctgaggagctggagaagaggaacaagcatggagtgtccaggaagaagatcgcccagatgctggacagatatgagtaccagatgagcatcagcatcgtgatgaacagcgtggagcccagccacaagagcacccagaggcctcctccaccccagggccggcagcgctggggcggcagcctgggcagccacaacagagtgtgtgtgaccaacaaccactag

SEQ ID NO: 40253 - DNA, 2214 bp, Artificial Sequence
  Description of Artificial Sequence: Synthetic coding sequence
atggccctgtgcagcgccctgatgaccatcttcaccatcaagatgggcacagccaagcaggccatcgaccagggccgcagccctgtgatcatcgacaacaccaacatccaggcctgggagatgaagccctacgtggaggtggccatcggcaagggctacagagtggagttccacgagcctgagacctggtggaagtttgatcctgaggagctggagaagaggaacaagcatggagtgtccaggaagaagatcgcccagatgctggacagatatgagtaccagatgagcatcagcatcgtgatgaacagcgtggagcccagccacaagagcacccagaggcctcctccaccccagggccggcagcgggagcgggtgctgaagaagacaggccaccggctgagcaagaccaagcagaagaggaacaggaagaggaacaagaagcagaacagccagaaccgcatcatggaggagaacagcctggagttcctgagtgacctgacccctggggaccaggaccccagccagagcgaggaggaggacatcgagaagacccggcgggagagcgagtaccccttcattgatggcctgcagaatgaggtgggggactttgtgacaggctacaaggagaagcgctggaagaacaaggaccccaaggacagcttccagaatgtgatgagcatcgtggagctggacaacacccccaagaactacctgagcaaggagggggacaacctgtttgtgtccctgctgctgcggcccaatgagatctctgtgacctgccccatcctgacccagaacctgagctgtgtgaccacagatgactgcagcggcatgaaggtggagaagcacatccggaacagacacaccatcgccctggacacccaggacctgtctgctgagaccagctgcctcttcatgaagaagcgggagatcgtggacaagaacctgagccatgagcccatcctgtgccaccagcacggcatccgcatgtctgacaaggtgctgcgggaggagcaggtgtacaccaccaagatcaaccactgggccttcttcaccaccaacctgagtgatgaggacctgcagctgggcagtgaccggcagccctacttcggctcctggccagctggcccccacaagttcatctgtgagcagaggcccaagaaggaccgggcctgcaagctggccggccctgacagccggggccagtggatccagatgatcttcacctctgtggccgccagcgagcccggcaacaaccctgagatcctgacagacaagctgctgattggaaatgaagacttcagccccccacctgagaccatggacagcttcatcgagaccaacctcttccgcagctgcctgccccagcctgacatccccaagaatgccctggagagcaccaagaacaagaagaggaggaagaagaggatcttcaacctggtgcccaactttgacctgctgggccagagccgcatcggcgtgaaggagcgggagaagtgtgacctgctgaccaagaaccacggcctgaagatcaccctgggggaggagaaggaccgcatcagcgagagaaattctgaggaggagaacaagcagaagctgatgacctttgaccaccaccccctgtggttctacctggacatcatcaaggccacccccctgaacattgatggccagcgctacagccactgcctgtccttcaaccggctgcgctgcagcgccagcctgtacaagaactacatccccagctttgtgctgcacaacctgagcagcatctggaagcccagcttcaccaacaagaagctgttcctgacctttgagagccagaccagggtgggcaacaagctgaatgatgctggcttcatcagccctgagatcctgcacagccacccagacaccagctgcagcctgggcgtgaccagtgacttccacttcctgaatgaaagatttgacaggaagctgaagcgctgggaggagcccaaggagctgcctgctgaggacagccaggacctgaccagcacagactaccgcagcctggagctgcccctgagccagggctttgccttccagctggtgaagctgtttggcagccctggggtgcccatggagagcctgctgcctgatgattatgtggtgcccctggactggaagaccctgaagatgatctacctgcagtggaagatgtctgtggagaagaggcagaagaagattggatag

SEQ ID NO: 40254 - DNA, 2259 bp, Artificial Sequence
  Description of Artificial Sequence: Synthetic coding sequence
atgtcctatggagaaattgaggagttctgcctggtgcgcatcgtgatggccctgtgcagcgccctgatgaccatcttcaccatcaagatgggcacagccaagcaggccatcgaccagggccgcagccctgtgatcatcgacaacaccaacatccaggcctgggagatgaagccctacgtggaggtggccatcggcaagggctacagagtggagttccacgagcctgagacctggtggaagtttgatcctgaggagctggagaagaggaacaagcacggcgtgtccaggaagaagatcgcccagatgctggacagatatgagtaccagatgagcatcagcatcgtgatgaacagcgtggagcccagccacaagagcacccagaggcctcctccaccccagggccggcagcgggagcgggtgctgaagaagacaggccaccggctgagcaagaccaagcagaagaggaacaggaagaggaacaagaagcagaacagccagaaccgcatcatggaggagaacagcctggagttcctgagtgacctgacccctggggaccaggaccccagccagagcgaggaggaggacatcgagaagacccggcgggagagcgagtaccccttcattgatggcctgcagaatgaggtgggggactttgtgacaggctacaaggagaagcgctggaagaacaaggaccccaaggacagcttccagaatgtgatgagcatcgtggagctggacaacacccccaagaactacctgagcaaggagggggacaacctgtttgtgtccctgctgctgcggcccaatgagatctctgtgacctgccccatcctgacccagaacctgagctgtgtgaccacagatgactgcagcggcatgaaggtggagaagcacatccggaacagacacaccatcgccctggacacccaggacctgtctgctgagaccagctgcctcttcatgaagaagcgggagatcgtggacaagaacctgagccatgagcccatcctgtgccaccagcacggcatccgcatgtctgacaaggtgctgcgggaggagcaggtgtacaccaccaagatcaaccactgggccttcttcaccaccaacctgagtgatgaggacctgcagctgggcagtgaccggcagccctacttcggctcctggccagctggcccccacaagttcatctgtgagcagaggcccaagaaggaccgggcctgcaagctggccggccctgacagccggggccagtggatccagatgatcttcacctctgtggccgccagcgagcccggcaacaaccctgagatcctgacagacaagctgctgattggaaatgaagacttcagccccccacctgagaccatggacagcttcatcgagaccaacctcttccgcagctgcctgccccagcctgacatccccaagaatgccctggagagcaccaagaacaagaagaggaggaagaagaggatcttcaacctggtgcccaactttgacctgctgggccagagcagaattggagtgaaggagcgggagaagtgtgacctgctgaccaagaaccacggcctgaagatcaccctgggggaggagaaggaccgcatcagcgagaggaacagcgaggaggagaacaagcagaagctgatgacctttgaccaccaccccctgtggttctacctggacatcatcaaggccacccccctgaacattgatggccagcgctacagccactgcctgtccttcaaccggctgcgctgcagcgccagcctgtacaagaactacatccccagctttgtgctgcacaacctgagcagcatctggaagcccagcttcaccaacaagaagctgttcctgacctttgagagccagaccagggtgggcaacaagctgaatgatgctggcttcatcagccctgagatcctgcacagccacccagacaccagctgcagcctgggcgtgaccagtgacttccacttcctgaatgaaagatttgacaggaagctgaagcgctgggaggagcccaaggagctgcctgctgaggacagccaggacctgaccagcacagactaccgcagcctggagctgcccctgagccagggctttgccttccagctggtgaagctgtttggcagccctggggtgcccatggagagcctgctgcctgatgattatgtggtgcccctggactggaagaccctgaagatgatctacctgcagtggaagatgtctgtggagaagaggcagaagaagattggatag

SEQ ID NO: 40255 - DNA, 513 bp, Artificial Sequence
  Description of Artificial Sequence: Synthetic coding sequence
atgctgatcaaggtgaagaccctgaccgggaaggagattgaaattgatattgagcccacagacaaggtggagcgcatcaaggagcgggtggaggagaaggagggcatccccccccagcagcagaggctcatctacagcggcaagcagattgatggcaccgtgcgggacagaagaggccaggatgtgcggctgtacccagaggtgcctgaggtgctgaagaggctgcagagcctgggcgtgcctggagctgctgccagcaggaccagcgagattgaaggagccaaccagctgctggagctgtttgacctcttccgctactttgtgcaccgggagatctacccaggcagcaagatcacccactttgagcggctgcagcagaagacaggcatccccttcagccagatgatcttctttgatgatgagaggagaaatattgtggatgtgtccaagctgggcgtgacctgcatccacatccagaatggcatgaacctgcagaccctgagccagggctag

SEQ ID NO: 40256 - DNA, 339 bp, Artificial Sequence
  Description of Artificial Sequence: Synthetic coding sequence
atgtggaagggcggccgcagccaccccttcctgccctgcagcagccggcgggccggcagcggcggccagctggacagcatcctgccccaccagagccctgcctggggcccctggggctgcaaggacctgagcagtggagtgcccagcttcctgaccagcagcatcctgtggaagtctgctgtgtttgctgaggacaatggcctgaagatccacctgtgcagctacaagagagatgacctggtgctcttctatgactgcaccagctttgtgctgaccttcggccccagcccctggttcctgacccagggcttcctgaaccccctggagttcagcgcctag

SEQ ID NO: 40257 - DNA, 2577 bp, Artificial Sequence
  Description of Artificial Sequence: Synthetic coding sequence
atgctgcagaccaaggacctgatctggaccctcttcttcctgggcacagctgtgtccctgcaggtggacatcgtgcccagccagggcgagatctctgtgggggagagcaagttcttcctgtgccaggtggccggagatgccaaggacaaggacatctcctggttcagccccaacggggagaagctgacccccaaccagcagaggatctctgtggtgtggaatgatgacagcagcagcaccctgaccatctacaatgccaacattgatgatgctggcatctacaagtgtgtggtgactggagaagatggcagcgagagcgaggccaccgtgaatgtgaagatcttccagaagctgatgttcaagaatgcccccaccccccaggagttccgggagggagaagatgctgtgattgtgtgtgatgtggtgagcagcctgccccccaccatcatctggaagcacaagggcagagatgtgatcctgaagaaggatgtgcgcttcatcgtgctgagcaacaactacctgcagatccggggcatcaagaagacagatgagggcacctaccgctgtgagggccgcatcctggcccggggggagatcaacttcaaggacatccaggtgattgtgaatgtgccccccaccatccaggcccggcagaacatcgtgaatgccacagccaacctgggccagagcgtgaccctggtgtgtgatgctgagggcttccctgagcccaccatgtcctggaccaaggatggagagcagatcgagcaggaggaggatgatgagaagtacatcttcagtgatgacagcagccagctgaccatcaagaaggtggacaagaatgatgaagctgagtacatctgcatcgccgagaacaaggccggggagcaggatgccaccatccacctgaaggtgtttgccaagcccaagatcacctacgtggagaaccagacagccatggagctggaggagcaggtgaccctgacctgtgaggccagcggggaccccatccccagcatcacctggaggaccagcaccaggaacatcagcagcgaggagaaggcctcctggaccaggcctgagaagcaggagaccctggatggccacatggtggtgcgcagccacgcccgggtgagcagcctgaccctgaagagcatccagtacacagatgctggggagtacatctgcacagccagcaacaccatcggccaggacagccagagcatgtacctggaggtgcagtatgcccccaagctgcagggccctgtggccgtgtacacctgggagggcaaccaggtgaacatcacctgtgaggtgtttgcctaccccagcgccaccatctcctggttcagagatggccagctgctgcccagcagcaactacagcaacatcaagatctacaacacccccagcgccagctacctggaggtgaccccagacagtgaaaatgactttggaaactacaactgcacagctgtgaacagaattggccaggagagcctggagttcatcctggtgcaggccgacacccccagcagccccagcattgaccaggtggagccctacagcagcacagcccaggtgcagtttgatgagcctgaggccactggaggagtgcccatcctgaagtacaaggccgagtggagggctgtgggggaggaggtgtggcacagcaagtggtatgatgccaaggaggcctccatggagggcatcgtgaccatcgtgggcctgaagccagagaccacctatgctgtgcggctggccgccctgaatggcaagggcctgggggagatctctgctgccagcgagttcaagacccagcctgtgcagggcgagcccagcgcccccaagctggagggccagatgggagaagatggcaacagcatcaaggtgaacctgatcaagcaggatgatggcggcagccccatccgccactacctggtgcgctaccgggccctgagcagcgagtggaagccagagatccggctgcccagcggcagtgaccacgtgatgctgaagagcctggactggaatgcagaatatgaggtgtatgtggtggccgagaaccagcagggcaagagcaaggccgcccactttgtgttccgcaccagcgcccagcccacagccatcccagccaacggcagccccaccagcggcctgagcactggagccatcgtgggcatcctgattgtcatctttgtgctgctgctggtggtggtggacatcacctgctacttcctgaacaagtgtggcctcttcatgtgcatcgctgtgaacctgtgtgggaaggccggccctggggccaagggcaaggacatggaggagggcaaggccgccttcagcaaggatgagagcaaggagcccatcgtggaggtgaggacagaggaggagaggacccccaaccatgatggcggcaagcacacagagcccaatgagaccacccccctgacagagcctgagaagggccctgtggaggccaagccagagtgccaggagacagagaccaagccagccccagctgaggtgaagacagtgcccaatgatgccacccagaccaaggaaaatgaaagcaaggcctag

SEQ ID NO: 40258 - DNA, 2181 bp, Artificial Sequence
  Description of Artificial Sequence: Synthetic coding sequence
atgctgcagaccaaggacctgatctggaccctcttcttcctgggcacagctgtgtccctgcaggtggacatcgtgcccagccagggcgagatctctgtgggggagagcaagttcttcctgtgccaggtggccggagatgccaaggacaaggacatctcctggttcagccccaacggggagaagctgacccccaaccagcagaggatctctgtggtgtggaatgatgacagcagcagcaccctgaccatctacaatgccaacattgatgatgctggcatctacaagtgtgtggtgactggagaagatggcagcgagagcgaggccaccgtgaatgtgaagatcttccagaagctgatgttcaagaatgcccccaccccccaggagttccgggagggagaagatgctgtgattgtgtgtgatgtggtgagcagcctgccccccaccatcatctggaagcacaagggcagagatgtgatcctgaagaaggatgtgcgcttcatcgtgctgagcaacaactacctgcagatccggggcatcaagaagacagatgagggcacctaccgctgtgagggccgcatcctggcccggggggagatcaacttcaaggacatccaggtgattgtgaatgtgccccccaccatccaggcccggcagaacatcgtgaatgccacagccaacctgggccagagcgtgaccctggtgtgtgatgctgagggcttccctgagcccaccatgtcctggaccaaggatggagagcagatcgagcaggaggaggatgatgagaagtacatcttcagtgatgacagcagccagctgaccatcaagaaggtggacaagaatgatgaagctgagtacatctgcatcgccgagaacaaggccggggagcaggatgccaccatccacctgaaggtgtttgccaagcccaagatcacctacgtggagaaccagacagccatggagctggaggagcaggtgaccctgacctgtgaggccagcggggaccccatccccagcatcacctggaggaccagcaccaggaacatcagcagcgaggagaagaccctggatggccacatggtggtgcgcagccacgcccgggtgagcagcctgaccctgaagagcatccagtacacagatgctggggagtacatctgcacagccagcaacaccatcggccaggacagccagagcatgtacctggaggtgcagtatgcccccaagctgcagggccctgtggccgtgtacacctgggagggcaaccaggtgaacatcacctgtgaggtgtttgcctaccccagcgccaccatctcctggttcagagatggccagctgctgcccagcagcaactacagcaacatcaagatctacaacacccccagcgccagctacctggaggtgaccccagacagtgaaaatgactttggaaactacaactgcacagctgtgaacagaattggccaggagagcctggagttcatcctggtgcaggccgacacccccagcagccccagcattgaccaggtggagccctacagcagcacagcccaggtgcagtttgatgagcctgaggccactggaggagtgcccatcctgaagtacaaggccgagtggagggctgtgggggaggaggtgtggcacagcaagtggtatgatgccaaggaggcctccatggagggcatcgtgaccatcgtgggcctgaagccagagaccacctatgctgtgcggctggccgccctgaatggcaagggcctgggggagatctctgctgccagcgagttcaagacccagcctgtgcagggcgagcccagcgcccccaagctggagggccagatgggagaagatggcaacagcatcaaggtgaacctgatcaagcaggatgatggcggcagccccatccgccactacctggtgcgctaccgggccctgagcagcgagtggaagccagagatccggctgcccagcggcagtgaccacgtgatgctgaagagcctggactggaatgcagaatatgaggtgtatgtggtggccgagaaccagcagggcaagagcaaggccgcccactttgtgttccgcaccagcgcccagcccacagccatcccagccaccctgggcggcaacagcgccagctacacctttgtgtccctgctcttctctgctgtgaccctgctgctgctgtgctag

SEQ ID NO: 40259 - DNA, 2286 bp, Artificial Sequence
  Description of Artificial Sequence: Synthetic coding sequence
atgctgcagaccaaggacctgatctggaccctcttcttcctgggcacagctgtgtccctgcaggtggacatcgtgcccagccagggcgagatctctgtgggggagagcaagttcttcctgtgccaggtggccggagatgccaaggacaaggacatctcctggttcagccccaacggggagaagctgacccccaaccagcagaggatctctgtggtgtggaatgatgacagcagcagcaccctgaccatctacaatgccaacattgatgatgctggcatctacaagtgtgtggtgactggagaagatggcagcgagagcgaggccaccgtgaatgtgaagatcttccagaagctgatgttcaagaatgcccccaccccccaggagttccgggagggagaagatgctgtgattgtgtgtgatgtggtgagcagcctgccccccaccatcatctggaagcacaagggcagagatgtgatcctgaagaaggatgtgcgcttcatcgtgctgagcaacaactacctgcagatccggggcatcaagaagacagatgagggcacctaccgctgtgagggccgcatcctggcccggggggagatcaacttcaaggacatccaggtgattgtgaatgtgccccccaccatccaggcccggcagaacatcgtgaatgccacagccaacctgggccagagcgtgaccctggtgtgtgatgctgagggcttccctgagcccaccatgtcctggaccaaggatggagagcagatcgagcaggaggaggatgatgagaagtacatcttcagtgatgacagcagccagctgaccatcaagaaggtggacaagaatgatgaagctgagtacatctgcatcgccgagaacaaggccggggagcaggatgccaccatccacctgaaggtgtttgccaagcccaagatcacctacgtggagaaccagacagccatggagctggaggagcaggtgaccctgacctgtgaggccagcggggaccccatccccagcatcacctggaggaccagcaccaggaacatcagcagcgaggagaagaccctggatggccacatggtggtgcgcagccacgcccgggtgagcagcctgaccctgaagagcatccagtacacagatgctggggagtacatctgcacagccagcaacaccatcggccaggacagccagagcatgtacctggaggtgcagtatgcccccaagctgcagggccctgtggccgtgtacacctgggagggcaaccaggtgaacatcacctgtgaggtgtttgcctaccccagcgccaccatctcctggttcagagatggccagctgctgcccagcagcaactacagcaacatcaagatctacaacacccccagcgccagctacctggaggtgaccccagacagtgaaaatgactttggaaactacaactgcacagctgtgaacagaattggccaggagagcctggagttcatcctggtgcaggccgacacccccagcagccccagcattgaccaggtggagccctacagcagcacagcccaggtgcagtttgatgagcctgaggccactggaggagtgcccatcctgaagtacaaggccgagtggagggctgtgggggaggaggtgtggcacagcaagtggtatgatgccaaggaggcctccatggagggcatcgtgaccatcgtgggcctgaagccagagaccacctatgctgtgcggctggccgccctgaatggcaagggcctgggggagatctctgctgccagcgagttcaagacccagcctgtgcacagccccccacctccagccagcgccagcagcagcacccctgtgcccctgagccccccagacaccacctggcccctgcctgccctggccaccacagagcccgccaagggggagcccagcgcccccaagctggagggccagatgggagaagatggcaacagcatcaaggtgaacctgatcaagcaggatgatggcggcagccccatccgccactacctggtgcgctaccgggccctgagcagcgagtggaagccagagatccggctgcccagcggcagtgaccacgtgatgctgaagagcctggactggaatgcagaatatgaggtgtatgtggtggccgagaaccagcagggcaagagcaaggccgcccactttgtgttccgcaccagcgcccagcccacagccatcccagccaccctgggcggcaacagcgccagctacacctttgtgtccctgctcttctctgctgtgaccctgctgctgctgtgctag

SEQ ID NO: 40260 - DNA, 1668 bp, Artificial Sequence
  Description of Artificial Sequence: Synthetic coding sequence
atgggcaacacagtgcacaggaccctgcctgaccccagccccccagcccggctgctggccacccggccctgctgcggccctggccctgagaggaggcctgtgctgggggaggccccccgcttccacgcccaggccaagggcaagaatgtgcggctggatggccacagcagaagagccaccaggaggaacagcttctgcaatggagtgaccttcacccagaggcccatccggctgtatgagcaggtgcggctgcggctggtggccgtgcggcccggctggagcggggccctgcgcttcggcttcaccgcccatgaccccagcctgatgtctgcccaggacatccccaagtatgcctgcccagacctggtgacccggcccggctactgggccaaggccctgcctgagaacctggccctgcgggacacagtgctggcctactgggccgacagacatggccgggtcttctacagcgtgaatgatggagagcctgtgctcttccactgcggcgtggccgtgggcggccccctgtgggccctgattgatgtgtatggcatcacagatgaggtgcagctgctggagagcgcctttgctgacaccctgaccccagcccggctgagccaggcccgcttcagcgcctgcctgccccccagcagccatgatgctgccaactttgacaacaatgagctggagaacaaccaggtggtggccaagctgggccacctggccctgggccgggcccctggccccccaccagcagatgctgctgctgctgccatcccctgtggcccccgggagcggcccaggcctgccagcagccctgccctgctggaggccgacctgcgcttccacgccacccggggcccagatgtgtccctgtctgctgacaggaaggtggcctgtgcccccaggccagatggcggccgcaccctggtgttttctgagcggcccctgcggcctggagagagcctgtttgtggaggtgggccggcccggcctggccgcccctggggccctggccttcggcatcaccagctgtgaccccggggtgctgcggcccaatgagctgcctgctgaccctgatgccctgctggacaggaaggagtactgggtggtggcccgggccggccctgtgcccagcggaggagatgccctgtccttcaccctgcggcctggaggagatgtgctgctgggcatcaatggccggccccggggccgcctgctgtgtgtggacaccacccaggccctgtgggccttctttgctgtgcggggcggcgtggccggccagctgcggctgctgggcaccctgcagagcagccctgccaccaccaccccatctggcagcctgagcggcagccaggatgacagcgacagcgacatgaccttctctgtgaaccagagcagcagcgccagcgagagcagcctggtgacagcccccagcagccccctgagcccccctgtgtcccctgtgttcagccccccagagcccgccggcatcaagaatggagagtgcaccgtgtgctttgatggagaggtggacaccgtcatctacacctgtggccacatgtgcctgtgccacagctgtggcctgcggctgaagaggcaggcccgggcctgctgccccatctgcagaagacccatcaaggatgtgatcaagatctaccggccctag

SEQ ID NO: 40261 - DNA, 4683 bp, Artificial Sequence
  Description of Artificial Sequence: Synthetic coding sequence
atggctgctggcagcggcggcagcggcggcagcggcggcggccctggccctggccctgggggcggcggcggccccagcggcagcggcagcggccctggcagcaatggaggcctgggcagcggcggggagctgcaccccaggacaggccgcctggtgtccctgagcgcctgtggccgcacagcccggcggcagcagcccggccaggagttcaaccacggcctggtgctgagccgggagcccctgagagatggccgggtcttcaccgtgagaattgacaggaaggtgaacagctggagcggcagcattgaaattggagtgacagccctggaccccagcgtgctggacttccccagcagcgccaccggcctgaagggcggctcctgggtggtgtctggctgcagcgtgctgagagatggccgctctgtgctggaggagtatggccaggacctggaccagctgggggagggggacagagtgggcgtggagaggacagtggccggggagctgcggctgtgggtgaatggccgggactgtggggtggccgccaccggcctgcccccccgggtgtgggccgtggtggacctgtatggcaagtgcacccagatcaccgtgctgcccccagagcccggcttcagcccccccacccccatccccaccccacccctggagcccctggcccccacagaagattctgccctggccgagcagggcaccagcgcagatgaggccttcatggtgtccccagcccaggcccggcctgagaccttccccaacagcctggagagccacaatgactttgccaacatggagctgtctgaggtggtgagcaacaccatcctgagcgcctacaacggcggcctgctgaatgtgaacctgagcagccccccagctggggagggcctgggcagcagcggggccgccaccagccccatcctgaccagcaatgatgccctgctcttccacgagaagtgtggcaccctcatcaagctgagcaacaacaacaagacagctgagcggcggcggcccctggatgagttcaacaacggggtggtgatgaccaaccggcccctgcgggacaatgagatgtttgagatcagaattgacaagctggtggacaagtggagcggcagcattgaaattggagtgaccacccacaaccccaacagcctggagtacccagccaccatgaccaacctgcagagcggcaccatcatgatgagcggctgcggcatcctgaccaacgggaagggcacccggcgggagtactgtgagttcagcctggatgagctgcaggagggggaccacatcggcctgaccaggaagagcaacagcgccctgcacttcttcatcaatggaattgaccagggcgtggccacccccctgaccccacctgtggtgtatggagtggtggacctgtatggcatggctgtgaaggtgaccatcgtgcacaacaacaaccacagcgaccggctgcggagaaataatgccatcctgcgggccctgagccctgagggcgccctgcggcgggccgccccagctgcccaggccgagcctgagcggctgctcttccaccccaactgtggccagaaggccgccatcacccatgagggccgcacagccctgcggccccacgccacagatgacttcaaccacggcgtggtgctgagcagccgggccctgagagatggagaggtgttccaggtgagaattgacaagatggtggacaagtgggccggcagcattgaaattggagtgaccacccacaacccagcctacctgcagctgcccagcaccatgaccaacctgcggagcggcacctggatgatgactggaaatggagtgatgcacaacggcaccaccatcctggatgaatatggccacaacctggaccggctgaaggccggggacacagtgggcgtggtgcggcgggaggatggcaccctgcacttctttgtgaatggcatgacccagggccctgctgcctggaatgtgcccccaggagtgtatgctgtggtggacctgtatggccaggccgcccaggccaccatcgtggatgatgtggaggtggcccctgtgcctgagcccctgcctgagggcaacaaccaggtgagccccagcagccccagcagcggggccggcggcagtgacctgcgcttccaccagctgcacggcagcaatgctgtgatcaccaatggaggccgcacagccctgcggcacaactgccgctctgagttcaatgatgccatcgtcatcagcaacagagccctgagagatggagagctgtttgagatcgtcatccagaagatggtggaccgctggagcggcagcattgaagctggggtgacagccatccggcctgaggacctggagttccccaacaccatgacagacatcgactatgacacctggatgctgagcggcacagccatcatgcaggacggcaacaccatgaggaacaactacggctgtgacctggatgccctgggcaccggggcccgcatcggcatgatgaggacagccaagggggacctgcactacttcatcaatggccaggaccagggcgccgcctgcagcggcctgcccccagaggtgtatgctgtggtggacctgtatggccagtgtgtgcaggtgtccatcaccaatgccaccggccccatggacaacagcctggccaccagcaacacagccacagagaagagcttccccctgcacagccctgtggccggcgtggcccaccgcttccacagcacctgtgggaagaatgtgaccctggaggaggatggcaccagggctgtgcgggctgctggctacgcccacggcctggtgttcagcaccaaggagctgcgggcagaggaggtgtttgaggtgaaggtggaggagctggatgagaagtgggccggcagcctgcggctgggcctgaccaccctggcccctggagagatgggccctggagctgggggcggcggccctggcctgccccccagcctgcctgagctgcggaccaagaccacctggatggtgagcagctgtgaggtgagaagagatggccagctgcagaggatgaactatggaagaaacctggagcggctgggcgtgggcagccgggtgggcgtgagaagaggagcagatgacaccatgcacatcctggtggatggagaggacatgggccctgctgccaccggcatcgccaagaatgtgtgggccgtgctggacctgtatggccctgtgcggggcgtgtccatcgtgagcagcacccggctggaggagagcgagggcacccagccccccagccccagcagtgacaccggcagcgagggggaggaggatgatgaaggagaggagcacggcctgggcggccagaatgaggtgggcatcatccccaccaccctggagttcctggagaaccacggcaagaacatcctgctgagcaatggaaacagaacagccaccagggtggccagctacaaccagggcatcgtggtgatcaaccagcccctggtgccccagctgctggtgcaggtgagaattgacttcctgaaccggcagtggaccagcagcctggtgctgggcgtcatcacctgtgcccctgagcggctgaacttccctgccagcgcctgtgccctgaagagagctgcctggctgctgcggggccggggcgtcttccacaacggcctgaagatctgtgagaagtttggccccaacctggacacctgcccagagggcaccatcctgggcctgcggctggacagcagcggcggcctgcacctgcacgtgaatggagtggaccagggcgtggccgtgcctgatgtgccccagccctgccacgccctggtggacctgtatggccagtgtgagcaggtgaccatcgtgaaccctgagcccggggccgccagcggcaagtctgctggcacccagggcgacatggagaaggctgacatggtggatggcatcaaggagagcgtgtgctggggccccccacctgctgccagccccctgaagagctgtgagtaccacgccctgtgcagccgcttccaggagctgctgctgctgcctgaggactacttcatgcccccacccaagaggagcctgtgctactgtgagagctgcaggaagctgcggggagatgaggcccacagaagaagaggagagcccccccgggagtatgccctgcccttcggctggtgccgcttcaacctgcgggtgaacccccggctggaggccggcaccctgaccaagaagtggcacatggcctaccacggcagcaatgtggccgctgtgagaagagtgctggacagaggagagctgggcgccggcacagccagcatcctgagctgccggcccctgaagggggagcccggggtgggctttgaggagcctggagagaactgtgccccaccccgggaggagcagcccccacctgtgctgctgagccccagcctgcagtatgctggagctgagaccctggccagcaaggtgcagttccgggaccccaagagccagaggacccaccaggcccaggtggccttccaggtgtgtgtgcggcccggcagctacaccccaggcccccccagcgctgccctgggggagcccccagacccccacttctccccagctgagctggagtgggtgaccaaggagaagggggccaccctgctgtgtgccctgctggtgcgggtggagtag

SEQ ID NO: 40262 - DNA, 4689 bp, Artificial Sequence
  Description of Artificial Sequence: Synthetic coding sequence
atggctgctggcagcggcggcagcggcggcagcggcggcggccctggccctggccctgggggcggcggcggccccagcggcagcggcagcggccctggcagcaatggaggcctgggcagcggcggggagctgcaccccaggacaggccgcctggtgtccctgagcgcctgtggccgcacagcccggcggcagcagcccggccaggagttcaaccacggcctggtgctgagccgggagcccctgagagatggccgggtcttcaccgtgagaattgacaggaaggtgaacagctggagcggcagcattgaaattggagtgacagccctggaccccagcgtgctggacttccccagcagcgccaccggcctgaagggcggctcctgggtggtgtctggctgcagcgtgctgagagatggccgctctgtgctggaggagtatggccaggacctggaccagctgggggagggggacagagtgggcgtggagaggacagtggccggggagctgcggctgtgggtgaatggccgggactgtggggtggccgccaccggcctgcccccccgggtgtgggccgtggtggacctgtatggcaagtgcacccagatcaccgtgctgcccccagagcccggcttcagcccccccacccccatccccaccccacccctggagcccctggcccccacagaagattctgccctggccgagcagggcaccagcgcagatgaggccttcatggtgtccccagcccaggcccggcctgagaccttccccaacagcctggagagccacaatgactttgccaacatggagctgtctgaggtggtgagcaacaccatcctgagcgcctacaacggcggcctgctgaatgtgaacctgagcagccccccagctggggagggcctgggcagcagcggggccgccaccagccccatcctgaccagcaatgatgccctgctcttccacgagaagtgtggcaccctcatcaagctgagcaacaacaacaagacagctgagcggcggcggcccctggatgagttcaacaacggggtggtgatgaccaaccggcccctgcgggacaatgagatgtttgagatcagaattgacaagctggtggacaagtggagcggcagcattgaaattggagtgaccacccacaaccccaacagcctggagtacccagccaccatgaccaacctgcagagcggcaccatcatgatgagcggctgcggcatcctgaccaacgggaagggcacccggcgggagtactgtgagttcagcctggatgagctgcaggagggggaccacatcggcctgaccaggaagagcaacagcgccctgcacttcttcatcaatggaattgaccagggcgtggccacccccctgaccccacctgtggtgtatggagtggtggacctgtatggcatggctgtgaaggtgaccatcgtgcacaacaacaaccacagcgaccggctgcggagaaataatgccatcctgcgggccctgagccctgagggcgccctgcggcgggccgccccagctgcccaggccgagcctgagcggctgctcttccaccccaactgtggccagaaggccgccatcacccatgagggccgcacagccctgcggccccacgccacagatgacttcaaccacggcgtggtgctgagcagccgggccctgagagatggagaggtgttccaggtgagaattgacaagatggtggacaagtgggccggcagcattgaaattggagtgaccacccacaacccagcctacctgcagctgcccagcaccatgaccaacctgcggagcggcacctggatgatgactggaaatggagtgatgcacaacggcaccaccatcctggatgaatatggccacaacctggaccggctgaaggccggggacacagtgggcgtggtgcggcgggaggatggcaccctgcacttctttgtgaatggcatgacccagggccctgctgcctggaatgtgcccccaggagtgtatgctgtggtggacctgtatggccaggccgcccaggccaccatcgtggatgatgtggaggtggcccctgtgcctgagcccctgcctgagggcaacaaccaggtgagccccagcagccccagcagcggggccggcggcagtgacctgcgcttccaccagctgcacggcagcaatgctgtgatcaccaatggaggccgcacagccctgcggcacaactgccgctctgagttcaatgatgccatcgtcatcagcaacagagccctgagagatggagagctgtttgagatcgtcatccagaagatggtggaccgctggagcggcagcattgaagctggggtgacagccatccggcctgaggacctggagttccccaacaccatgacagacatcgactatgacacctggatgctgagcggcacagccatcatgcaggacggcaacaccatgaggaacaactacggctgtgacctggatgccctgggcaccggggcccgcatcggcatgatgaggacagccaagggggacctgcactacttcatcaatggccaggaccagggcgccgcctgcagcggcctgcccccaggcaaggaggtgtatgctgtggtggacctgtatggccagtgtgtgcaggtgtccatcaccaatgccaccggccccatggacaacagcctggccaccagcaacacagccacagagaagagcttccccctgcacagccctgtggccggcgtggcccaccgcttccacagcacctgtgggaagaatgtgaccctggaggaggatggcaccagggctgtgcgggctgctggctacgcccacggcctggtgttcagcaccaaggagctgcgggcagaggaggtgtttgaggtgaaggtggaggagctggatgagaagtgggccggcagcctgcggctgggcctgaccaccctggcccctggagagatgggccctggagctgggggcggcggccctggcctgccccccagcctgcctgagctgcggaccaagaccacctggatggtgagcagctgtgaggtgagaagagatggccagctgcagaggatgaactatggaagaaacctggagcggctgggcgtgggcagccgggtgggcgtgagaagaggagcagatgacaccatgcacatcctggtggatggagaggacatgggccctgctgccaccggcatcgccaagaatgtgtgggccgtgctggacctgtatggccctgtgcggggcgtgtccatcgtgagcagcacccggctggaggagagcgagggcacccagccccccagccccagcagtgacaccggcagcgagggggaggaggatgatgaaggagaggagcacggcctgggcggccagaatgaggtgggcatcatccccaccaccctggagttcctggagaaccacggcaagaacatcctgctgagcaatggaaacagaacagccaccagggtggccagctacaaccagggcatcgtggtgatcaaccagcccctggtgccccagctgctggtgcaggtgagaattgacttcctgaaccggcagtggaccagcagcctggtgctgggcgtcatcacctgtgcccctgagcggctgaacttccctgccagcgcctgtgccctgaagagagctgcctggctgctgcggggccggggcgtcttccacaacggcctgaagatctgtgagaagtttggccccaacctggacacctgcccagagggcaccatcctgggcctgcggctggacagcagcggcggcctgcacctgcacgtgaatggagtggaccagggcgtggccgtgcctgatgtgccccagccctgccacgccctggtggacctgtatggccagtgtgagcaggtgaccatcgtgaaccctgagcccggggccgccagcggcaagtctgctggcacccagggcgacatggagaaggctgacatggtggatggcatcaaggagagcgtgtgctggggccccccacctgctgccagccccctgaagagctgtgagtaccacgccctgtgcagccgcttccaggagctgctgctgctgcctgaggactacttcatgcccccacccaagaggagcctgtgctactgtgagagctgcaggaagctgcggggagatgaggcccacagaagaagaggagagcccccccgggagtatgccctgcccttcggctggtgccgcttcaacctgcgggtgaacccccggctggaggccggcaccctgaccaagaagtggcacatggcctaccacggcagcaatgtggccgctgtgagaagagtgctggacagaggagagctgggcgccggcacagccagcatcctgagctgccggcccctgaagggggagcccggggtgggctttgaggagcctggagagaactgtgccccaccccgggaggagcagcccccacctgtgctgctgagccccagcctgcagtatgctggagctgagaccctggccagcaaggtgcagttccgggaccccaagagccagaggacccaccaggcccaggtggccttccaggtgtgtgtgcggcccggcagctacaccccaggcccccccagcgctgccctgggggagcccccagacccccacttctccccagctgagctggagtgggtgaccaaggagaagggggccaccctgctgtgtgccctgctggtgcgggtggagtag

SEQ ID NO: 40263 - DNA, 2760 bp, Artificial Sequence
  Description of Artificial Sequence: Synthetic coding sequence
atggtgaagcagaacaacatcatccctggagagacccagatcctgctgcgcttcaccggctgggagagcaaggtgaatgccaagaagcagctgcctgtgggcatcaagtgtgagcccatggaccaggtgcctgacagcaccagcagcgccaccaacgtgtccatggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcacccccagcgtgtacctgggcctgacagacagctgccagccctaccgcagcgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagaggcggggccggggcaggaaggagggggaggaggaccagaggaggaaggaggagggggaggagaagaagggcaagaagatcaagacccaccacgcccctggcagcgctgcctgctag

SEQ ID NO: 40264 - DNA, 2373 bp, Artificial Sequence
  Description of Artificial Sequence: Synthetic coding sequence
atgttcagcaacagcacaggccgcctgcccggccagcccacccaggagatccagcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcaccccatctgtgtacctgggcctgacagacagctgccagccctacagaagtgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcgctgcctgctag

SEQ ID NO: 40265 - DNA, 1101 bp, Artificial Sequence
  Description of Artificial Sequence: Synthetic coding sequence
ctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcacccccagcgtgtacctgggcctgacagacagctgccagccctaccgcagcgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctgtgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagctctgtgctgatggaggtggaggtgcctgaggtgctgcaggacagcctggaccgctactacagcacccccagcatgtactttgagctgcctgacagcttccagcactaccgcagcgtcttctacagctttgaggagcagcacatcagctttgccctggacatggacaaccgcttcttcaccctgactgtgcgcagcctgcacctggtgttccagatgggcgtcatcttcccccagtag

SEQ ID NO: 40266 - DNA, 2517 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaacagacacaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagcccaagagccacctgaggaagaccaagagcacccagctgagcctggcccaccccctgatgctgaatggaaggatgctgtacaccctgagccagaagatgaaggtgatgatgaggaagaggaagaagaagggccagtgcctgcccggcatctgccgcagcctgaagaggaggaagagccccaggagccctggcatgaaggtgatccggctgagccagttcctgctgaagggccaccgctgggaccaggtgaagaaggaggaccaggaggccaccggcccccggctgagccgggagctgctggatgagaaggagcctgaggtgctgcaggacagcctggaccgctgctacagcaccccatctgtgtacctgggcctgacagacagctgccagccctacagaagtgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcgctgcctgctag

SEQ ID NO: 40267 - DNA, 258 bp, Artificial Sequence
  Description of Artificial Sequence: Synthetic coding sequence
gagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagcccctag

SEQ ID NO: 40268 - DNA, 3570 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggacctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccaaccacccctacaatgacagcagcctgaggaaccacccagacatgtacagcgcccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaggaggacagcggggagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaacggcaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgaacatggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcagaaaagaagaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatctttggagtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtcatcgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggcggcgggagacccgggaggcctggaacaacgtgacagtgtggggcagccgctacgtggtgggccagacccctgtgtatgtgccctatgagatccgggtgcaggctgaaaatgactttgggaagggccctgagcctgagagcgtcatcggctacagcggggaggactacccccgggccgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgagccgcctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcagccccctggccgcctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40269 - DNA, 3774 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccaacccccagcaccggctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcagccctgtgatgagcccccccaccctgccccccaccaccgtgggcgccactggagctgtgagcagcacagatgccacagccatcgccgccaccacagaggccaccaccgtgcccatcatccccaccgtggcccccaccaccatcgccaccaccaccaccgtggccaccaccaccaccaccacagctgctgccaccaccaccacagagagcccccccaccaccaccagcggcaccaagatccatgaaagtgcctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40270 - DNA, 3675 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccaacccccagcaccggctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcaaccacaccaagaagacagtgcctgtgaaggcccaggcccagcccatccagctgacagacctgtacccaggcatgacctacaccctgcgggtgtacagccgggacaatgaaggcatcagcagcaccgtcatcaccttcatgaccagcacagcctacaccaacaaccaggccgacatcgccacccagggctggttcatcggcctgatgtgtgccatcgccctgctggtgctgatcctgctgattgtgtgcttcatcaagaggagccggggcggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaatcttctgaggccaccagccctgtgaatgccatctacagcctggcctag

SEQ ID NO: 40271 - DNA, 3723 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccagcatccagaatgagctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggacctgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaggccacccccacagctgccccacccaccctgccccccaccaccgtgggcgccaccggggctgtgagcagcacagatgccacagccatcgccgccaccacagaggccaccaccgtgcccatcatccccaccgtggcccccaccaccatcgccaccaccaccaccgtggccaccaccaccaccaccacagctgctgccaccaccaccacagagagcccccccaccaccaccagcggcaccaagatccacgagagcgccccagatgagcagagcatctggaatgtgacagtgctgcccaacagcaagtgggccaacatcacctggaagcacaactttggacctggaacagactttgtggtggagtacatcgacagcaaccacaccaagaagacagtgcctgtgaaggcccaggcccagcccatccagctgacagacctgtacccaggcatgacctacaccctgcgggtgtacagccgggacaatgaaggcatcagcagcaccgtcatcaccttcatgaccagcacagcctacaccaacaaccaggccgacatcgccacccagggctggttcatcggcctgatgtgtgccatcgccctgctggtgctgatcctgctgattgtgtgcttcatcaagaggagccggggcggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaatcttctgaggccaccagccctgtgaatgccatctacagcctggcctag

SEQ ID NO: 40272 - DNA, 3510 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggacctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccaaccacccctacaatgacagcagcctgaggaaccacccagacatgtacagcgcccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaggaggacagcggggagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaacggcaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgaacatggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcagaaaagaagaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatctttggagtggccgagcgggaccagggcagctacacctgtgtggccagcacagagctggaccaggacctggccaaggcctacctgactgtgctgggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaggcctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40273 - DNA, 3216 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccaacccccagcaccggctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggacctgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcagccctgtgatgagctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40274 - DNA, 3807 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccaacccccagcaccggctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcagccctgtgatgagcccagatgagcagagcatctggaatgtgacagtgctgcccaacagcaagtgggccaacatcacctggaagcacaactttggacctggaacagactttgtggtggagtacatcgacagcaaccacaccaagaagacagtgcctgtgaaggcccaggcccagcccatccagctgacagacctgtacccaggcatgacctacaccctgcgggtgtacagccgggacaatgaaggcatcagcagcaccgtcatcaccttcatgaccagcacagcctacaccaacaaccaggccgacatcgccacccagggctggttcatcggcctgatgtgtgccatcgccctgctggtgctgatcctgctgattgtgtgcttcatcaagaggagccggggcggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaatcttctgaggccaccagccctgtgaatgccatctacagcctggcctag

SEQ ID NO: 40275 - DNA, 3999 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggacctgagcattgagaccaccgtgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctgggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtcatcgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggcggcgggagacccgggaggcctggaacaacgtgacagtgtggggcagccgctacgtggtgggccagacccctgtgtatgtgccctatgagatccgggtgcaggctgaaaatgactttgggaagggccctgagcctgagagcgtcatcggctacagcggggaggactacccccgggccgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgagccgcctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggccgctgcatggccgccgcccctggggtgaagggccccagcgtgggcgccaccggggctgtgagcagcacagatgccacagccatcgccgccaccacagaggccaccaccgtgcccatcatccccaccgtggcccccaccaccatcgccaccaccaccaccgtggccaccaccaccaccaccacagctgctgccaccaccaccacagagagcccccccaccaccaccagcggcaccaagatccacgagagcgccccagatgagcagagcatctggaatgtgacagtgctgcccaacagcaagtgggccaacatcacctggaagcacaactttggacctggaacagactttgtggtggagtacatcgacagcaaccacaccaagaagacagtgcctgtgaaggcccaggcccagcccatccagctgacagacctgtacccaggcatgacctacaccctgcgggtgtacagccgggacaatgaaggcatcagcagcaccgtcatcaccttcatgaccagcacagcctacaccaacaaccaggccgacatcgccacccagggctggttcatcggcctgatgtgtgccatcgccctgctggtgctgatcctgctgattgtgtgcttcatcaagaggagccggggcggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaatcttctgaggccaccagccctgtgaatgccatctacagcctggcctag

SEQ ID NO: 40276 - DNA, 4044 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccaacccccagcaccggctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaaggcagccctgtgatgagcccccccaccctgccccccaccaccgtgggcgccactggagctgtgagcagcacagatgccacagccatcgccgccaccacagaggccaccaccgtgcccatcatccccaccgtggcccccaccaccatcgccaccaccaccaccgtggccaccaccaccaccaccacagctgctgccaccaccaccacagagagcccccccaccaccaccagcggcaccaagatccatgaaagtgccccagatgagcagagcatctggaatgtgacagtgctgcccaacagcaagtgggccaacatcacctggaagcacaactttggacctggaacagactttgtggtggagtacatcgacagcaaccacaccaagaagacagtgcctgtgaaggcccaggcccagcccatccagctgacagacctgtacccaggcatgacctacaccctgcgggtgtacagccgggacaatgaaggcatcagcagcaccgtcatcaccttcatgaccagcacagcctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40277 - DNA, 3723 bp, Artificial Sequence; identical to SEQ ID NO: 40271
  Description of Artificial Sequence: Synthetic coding sequence

SEQ ID NO: 40278 - DNA, 1860 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccagcatccagaatgagctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaagaagattctggagagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaatggaaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgagcacggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcaggaaggaggaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatcttcggcgtggccgagcgggaccagggcagctacacctgtgtggccagcacagagctggaccaggacctggccaaggcctacctgactgtgctgggcaactgcccctgcagcccctggcactag

SEQ ID NO: 40279 - DNA, 3525 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggacctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccaaccacccctacaatgacagcagcctgaggaaccacccagacatgtacagcgcccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaggaggacagcggggagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaacggcaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgaacatggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcagaaaagaagaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatctttggagtggccgagcgggaccagggcagctacacctgtgtggccagcacagagctggaccaggacctggccaaggcctacctgactgtgctgggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtgattgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggagaagagagacccgggaggcctggaacaacgtgacagtgtggggcagccgctacgtggtgggccagacccctgtgtatgtgccctatgagatccgggtgcaggccgagaatgactttggaaaaggacctgagcctgagagcgtgattggctacagcggggaggactaccccagggctgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgtcccggctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaggccacccccacagctgcctacaccaacaaccaggccgacatcgccacccagggctggttcatcggcctgatgtgtgccatcgccctgctggtgctgatcctgctgattgtgtgcttcatcaagaggagccggggcggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaatcttctgaggccaccagccctgtgaatgccatctacagcctggcctag

SEQ ID NO: 40280 - DNA, 3498 bp, Artificial Sequence
  Description of Artificial Sequence: Synthetic coding sequence
attgagatccccatggacctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccaaccacccctacaatgacagcagcctgaggaaccacccagacatgtacagcgcccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgcgcatcaccaacgtgtctgaggaggacagcggggagtacttctgcctggccagcaacaagatgggcagcatccgccacaccatctctgtgcgggtgaaggccgccccctactggctggatgagcccaagaacctgatcctggcccctggagaagatggccgcctggtgtgccgggccaacggcaaccccaagcccaccgtgcagtggatggtgaatggagagcccctgcagagcgccccacccaaccccaaccgggaggtggccggggacaccatcatcttccgggacacccagatcagcagcagagctgtgtaccagtgcaacaccagcaatgaacatggctacctgctggccaatgcctttgtgtctgtgctggatgtgccccccaggatgctgagccccaggaaccagctgatccgggtcatcctgtacaacagaacccggctggactgccccttcttcggcagccccatccccaccctgcgctggttcaagaatggccagggcagcaacctggatggcggcaactaccacgtgtatgaaaatggcagcctggagatcaagatgatcagaaaagaagaccagggcatctacacctgtgtggccaccaacatcctgggcaaggccgagaaccaggtgcggctggaggtgaaggaccccacccgcatctacaggatgcctgaggaccaggtggcccggcggggcaccaccgtgcagctggagtgccgggtgaagcatgaccccagcctgaagctgactgtgtcctggctgaaggatgatgagcccctgtacatcggcaacaggatgaagaaggaggatgacagcctgaccatctttggagtggccgagcgggaccagggcagctacacctgtgtggccagcacagagctggaccaggacctggccaaggcctacctgactgtgctggccgaccaggccacccccaccaaccggctggccgccctgcccaagggccgcccagaccggccccgggacctggagctgacagacctggccgagaggtctgtgcggctgacctggatccctggagatgccaacaacagccccatcacagattatgtggtgcagtttgaggaggaccagttccagcccggggtgtggcatgaccacagcaagtacccaggctctgtgaacagcgctgtgctgcggctgagcccctacgtgaactaccagttccgggtcatcgccatcaatgaggtgggcagcagccaccccagcctgcccagcgagcgctaccgcaccagcggggcccctcctgagagcaaccctggagatgtgaagggggagggcaccaggaagaacaacatggagatcacctggacccccatgaatgccaccagcgccttcggccccaacctgcgctacatcgtgaagtggaggcggcgggagacccgggaggcctggaacaacgtgacagtgtggggcagccgctacgtggtgggccagacccctgtgtatgtgccctatgagatccgggtgcaggctgaaaatgactttgggaagggccctgagcctgagagcgtcatcggctacagcggggaggactacccccgggccgcccccacagaggtgaaggtgcgggtgatgaacagcacagccatcagcctgcagtggaacagagtgtacagcgacacagtgcagggccagctgcgggagtaccgggcctactactggagggagagcagcctgctgaagaacctgtgggtgtcccagaagaggcagcaggccagcttccctggggaccggctgcggggcgtggtgagccgcctcttcccctacagcaactacaagctggagatggtggtggtgaatggaagaggagatggccccaggtctgagaccaaggagttcaccaccccagagggcgtgcccagcgccccccggcgcttccgggtgcggcagcccaacctggagaccatcaacctggagtgggaccaccctgagcaccccaacggcatcatgattggctacaccctgaagtatgtggccttcaacggcaccaaggtgggcaagcagatcgtggagaacttcagccccaaccagaccaagttcaccgtgcagaggacagatcctgtgagccgctaccgcttcaccctgagcgcccggacccaggtgggcagcggggaggccgtgacagaggagagccctgcccccccaaatgaggccacccccacagctgcctacaccaacaaccaggccgacatcgccacccagggctggttcatcggcctgatgtgtgccatcgccctgctggtgctgatcctgctgattgtgtgcttcatcaagaggagcagaggaggcaagtaccctgtgcgggagaagaaggatgtgcccctgggccctgaggaccccaaggaggaggatggcagctttgactacagtgatgaggacaacaagcccctgcagggcagccagaccagcctggatggcaccatcaagcagcaggagagtgatgacagcctggtggactatggagagggcggggagggccagttcaatgaagatggcagcttcatcggccagtacacagtgaagaaggacaaggaggagacagagggcaatgaaagcagcgaggccaccagccctgtgaatgccatctacagcctggcctag

SEQ ID NO: 40281 - DNA, 909 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccagcatccagaatgagctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgagcaaccgcatccggctgcaggtgtccaagagccccctgtggcccaaggagaacctggaccctgtggtggtgcaggagggcgcccccctgaccctgcagtgcaaccccccacctggcctgcccagccctgtgatcttctggatgagcagctccatggagcccatcacccaggacaagagggtgtcccagggccacaacggggacctgtacttcagcaatgtgatgctgcaggacatgcagacagactacagctgcaatgcccgcttccacttcacccacaccatccagcagaagaaccccttcaccctgaaggtgctgaccacccggggcgtggccgagaggacccccagcttcatgtacccccagggcacagccagcagccagatggtgctgcggggcatggacctgctgctggagtgcatcgccagcggcgtgcccaccccagacatcgcctggtacaagaagggcggggacctgcccagcgacaaggccaagtttgagaacttcaacaaggccctgaggtag

SEQ ID NO: 40282 - DNA, 390 bp, Artificial Sequence
  Description of Artificial Sequence: Synthetic coding sequence
atggcccggcagcccccaccaccctgggtgcacgccgccttcctgctgtgcctgctgagcctgggcggggccatcgagatccccatggaccccagcatccagaatgagctgacccagccccccaccatcaccaagcagagcgccaaggaccacatcgtggacccccgggacaacatcctgattgaatgtgaggccaagggcaacccagcccccagcttccactggaccaggaacagccgcttcttcaacatcgccaaggacccccgggtgtccatgagaagaagaagtggcaccctggtgattgacttccgcagcggcggccggcctgaggagtatgaaggagagtaccagtgctttgccaggaacaagtttggaacagccctgtcctag

SEQ ID NO: 40283 - DNA, 3510 bp, Artificial Sequence; identical to SEQ ID NO: 40272
  Description of Artificial Sequence: Synthetic coding sequence

SEQ ID NO: 40284 - DNA, 3525 bp, Artificial Sequence; identical to SEQ ID NO: 40279
  Description of Artificial Sequence: Synthetic coding sequence

SEQ ID NO: 40285 - DNA, 1503 bp, Artificial Sequence
  Description of Artificial Sequence: Synthetic coding sequence
ctgaagttcctggccgtgctgctggccgccggcatgctggccttcctgggcgccgtcatctgcatcatcgcctctgtgcccctggccgccagccctgcccgggccctgcctggaggagctgacaatgcctctgtggccagcggggccgccgccagccctggcccccagaggagcctgagcgccctgcatggagctgggggcagcgctggccccccagccctgcccggggccccagctgccagcgcccaccccctgcccccaggccccctcttcagccgcttcctgtgcacccccctggccgccgcctgccccagcggggcccagcagggagatgctgctggagctgcccctggagagcgggaggagctgctgctgctgcagagcacagctgagcagctgcggcagacagccctgcagcaggaggcccgcatccgggctgaccaggacaccatccgggagctgaccgggaagctgggccgctgtgagagcggcctgccccggggcctgcagggcgccggcccccggcgggacaccatggctgatggcccctgggacagccctgccctgatcctggagctggaggatgctgtgcgggccctgcgggacagaattgaccggctggagcaggagctgcctgcccgggtgaacctgtctgctgccccagcccctgtgtctgctgtgcccaccggcctgcacagcaagatggaccagctggagggccagctgctggcccaggtgctggccctggagaaggagcgggtggccctgagccacagcagccggcggcagaggcaggaggtggagaaggagctggatgtgctgcagggccgggtggccgagctggagcacggcagcagcgcctacagccccccagatgccttcaagatcagcatccccatccggaacaactacatgtatgcccgggtgaggaaggccctgcctgagctgtatgccttcaccgcctgcatgtggctgcggagccgcagcagcggcaccggccagggcacccccttctcctacagcgtgcccggccaggccaatgaaattgtgctgctggaggccggccacgagcccatggagctgctgatcaatgacaaggtggcccagctgcccctgagcctgaaggacaatggctggcaccacatctgcatcgcctggaccaccagagatggcctgtggagcgcctaccaggatggagagctgcagggcagcggggagaacctggccgcctggcaccccatcaagccccacggcatcctgatcctgggccaggagcaggacaccctgggcggccgctttgatgccacccaggcctttgtgggggacatcgcccagttcaacctgtgggaccacgccctgaccccagcccaggtgctgggcatcgccaactgcacagcccccctgctgggcaatgtgctgccctgggaggacaagctggtggaggcctttggaggagccaccaaggccgcctttgatgtgtgcaagggccgggccaaggcctag

SEQ ID NO: 40286 - DNA, 2526 bp, Artificial Sequence
  Description of Artificial Sequence: Synthetic coding sequence
atgaacctgctgtacaggaagaccaagctggagtggaggcagcacaaggaggaggaggccaagaggagcagcagcaaggaggtggccccagctggcagcgctggccctgctgctggccagggccctggggtgcgggtgcgggacatcgccagcctgcggcgcagcctgaggatgggcttcatgaccatgcctgccagccaggagcacaccccccacccctgccgcagcgccatggcccccaggagcctgagctgccacagcgtgggctccatggattctgtgggcggcggccctgggggcgccagcggcggcctgacagaggacagcagcacccggcggcccccagccaagcccaggaggcaccccagcaccaagctgtccatggtgggccctggcagcggggctgagaccccacccagcaagaaggccggcagccagaagcccaccccagagggccgggagagcagcaggaaggtgcccccccagaagcccaggaggagccccaacacccagctgtctgtgtcctttgatgagagctgccccccaggccccagcccccggggcggcaacctgcccctgcagaggctgacccggggcagccgggtggccggggaccctgatgtgggcgcccaggaggagcctgtgtacatcgagatggtgggagatgtgttccggggcggcggccgcagcggcggcggcctggccggcccccccctgggcggcggcggccccaccccacctgctggagctgacagcgacagcgaggagagcgaggccatctatgaggagatgaagtaccccctgcctgaggaggccggggagggccgggccaacggccccccacccctgacagccaccagccccccccagcagccccacgccctgcccccccacgcccacagaagacctgccagcgccctgcccagcagaagagatggcacccccaccaagaccaccccctgtgagatccccccacccttccccaacctgctgcagcacaggcctcccctgctggccttcccccaggccaagagcgccagcaggaccccaggagatggagtgtcccggctgcctgtgctgtgccacagcaaggagcctgctggcagcaccccagccccccaggtgcctgcccgggagcgggagaccccacctcctcctcctcctcctcctgctgccaacctgctgctgctgggccccagcggccgggcccggagccacagcacccccctgcccccccagggcagcggccagcccagaggagagcgggagctgcccaacagccacagcatgatctgccccaaggccgccggggccccagctgcccccccagccccagctgccctgctgcccggcccccccaaggacaaggctgtgtcctacaccatggtgtacagcgctgtgaaggtgaccacccacagcgtgctgcctgctggcccccccctgggcgctggggagcccaagacagagaaggagatctctgtgctgcacggcatgctgtgcaccagcagcaggcctcctgtgcctgggaagaccagcccccacggcggggccatgggcgctgctgctggggtgctgcaccaccggggctgcctggccagcccccacagcctgcctgaccccaccgtgggccccctgacccccctgtggacctacccagccacagctgctggcctgaagaggcccccagcctatgagagcctgaaggccggcggcgtgctgaacaagggctgcggcgtgggcgcccccagccccatggtgaagatccagctgcaggagcagggcacagatggaggagcctttgccagcatcagctgtgcccacgtgattgccagcgctggcaccccagaggaggaggaggaggaggtgggcgccgccacctttggagctggctgggccctgcagaggaaggtgctgtatggaggcaggaaggccaaggagctggacaaggtggaggatggagcccgggcctggaatggcagcgctgagggccctgggaaggtggagcgggaggaccggggccctggcaccagcggcatccctgtgcgcagccagggcgctgagggcctgctggcccgcatccaccacggggacagaggaggcagcaggacagccctgcccatcccctgccagaccttccctgcctgccacagaaatggagacttcaccggcggctaccgcctgggccgcagcgccagcaccagcggcgtgcggcaggtggtgctgcacaccccccggccctgcagccagcccagagatgccctgagccagccccacccagccctgcccctgcccctgcccctgcccccccagcctgcccgggagagagatggcaagctgctggaggtgattgaaaggaagagatgtgtgtgcaaggagatcaaggcccggcacaggccagaccggggcctgtgcaagcaggagagcatgcccatcctgcccagctggaggcggggccctgagcccaggaagagcggcaccccaccctgccggcggcagcacacagtgctgtgggacacagccatctag

SEQ ID NO: 40287 - DNA, 2529 bp, Artificial Sequence
  Description of Artificial Sequence: Synthetic coding sequence
atgaacctgctgtacaggaagaccaagctggagtggaggcagcacaaggaggaggaggccaagaggagcagcagcaaggaggtggccccagctggcagcgctggccctgctgctggccagggccctggggtgcgggtgcgggacatcgccagcctgcggcgcagcctgaggatgggcttcatgaccatgcctgccagccaggagcacaccccccacccctgccgcagcgccatggcccccaggagcctgagctgccacagcgtgggctccatggattctgtgggcggcggccctgggggcgccagcggcggcctgacagaggacagcagcacccggcggcccccagccaagcccaggaggcaccccagcaccaagctgtccatggtgggccctggcagcggggctgagaccccacccagcaagaaggccggcagccagaagcccaccccagagggccgggagagcagcaggaaggtgcccccccagaagcccaggaggagccccaacacccagctgtctgtgtcctttgatgagagctgccccccaggccccagcccccggggcggcaacctgcccctgcagaggctgacccggggcagccgggtggccggggaccctgatgtgggcgcccaggaggagcctgtgtacatcgagatggtgggagatgtgttccggggcggcggccgcagcggcggcggcctggccggcccccccctgggcggcggcggccccaccccacctgctggagctgacagcgacagcgaggagagcgaggccatctatgaggagatgaagtaccccctgcctgaggaggccggggagggccgggccaacggccccccacccctgacagccaccagccccccccagcagccccacgccctgcccccccacgcccacagaagacctgccagcgccctgcccagcagaagagatggcacccccaccaagaccaccccctgtgagatccccccacccttccccaacctgctgcagcacaggcctcccctgctggccttcccccaggccaagagcgccagcaggaccccaggagatggagtgtcccggctgcctgtgctgtgccacagcaaggagcctgctggcagcaccccagccccccaggtgcctgcccgggagcgggagaccccacctcctcctcctcctcctcctgctgccaacctgctgctgctgggccccagcggccgggcccggagccacagcacccccctgcccccccagggcagcggccagcccagaggagagcgggagctgcccaacagccacagcatgatctgccccaaggccgccggggccccagctgcccccccagccccagctgccctgctgcccggcccccccaaggacaaggctgtgtcctacaccatggtgtacagcgctgtgaaggtgaccacccacagcgtgctgcctgctggcccccccctgggcgctggggagcccaagacagagaaggagatctctgtgctgcacggcatgctgtgcaccagcagcaggcctcctgtgcctgggaagaccagcccccacggcggggccatgggcgctgctgctggggtgctgcaccaccggggctgcctggccagcccccacagcctgcctgaccccaccgtgggccccctgacccccctgtggacctacccagccacagctgctggcctgaagaggcccccagcctatgagagcctgaaggccggcggcgtgctgaacaagggctgcggcgtgggcgcccccagccccatggtgaagatccagctgcaggagcagggcacagatggaggagcctttgccagcatcagctgtgcccacgtgattgccagcgctggcaccccagaggaggaggaggaggaggtgggcgccgccacctttggagctggctgggccctgcagaggaaggtgctgtatggaggcaggaaggccaaggagctggacacagaggtggaggatggagcccgggcctggaatggatctgctgagggccctgggaaggtggagagagaagatcggggccctggcaccagcggcatccctgtgcgcagccagggcgctgagggcctgctggcccgcatccaccacggggaccggggcggcagcaggacagccctgcccatcccctgccagaccttccctgcctgccacagaaatggagacttcaccggcggctaccgcctgggccgcagcgccagcaccagcggcgtgcggcaggtggtgctgcacaccccccggccctgcagccagcccagagatgccctgagccagccccacccagccctgcccctgcccctgcccctgcccccccagcctgcccgggagagagatggcaagctgctggaggtgattgaaaggaagagatgtgtgtgcaaggagatcaaggcccggcacaggccagaccggggcctgtgcaagcaggagagcatgcccatcctgcccagctggaggcggggccctgagcccaggaagagcggcaccccaccctgccggcggcagcacacagtgctgtgggacacagccatctag

SEQ ID NO: 40288 - DNA, 2358 bp, Artificial Sequence
  Description of Artificial Sequence: Synthetic coding sequence
atgggcttcatgaccatgcctgccagccaggagcacaccccccacccctgccgcagcgccatggcccccaggagcctgagctgccacagcgtgggctccatggacagcgtgggcggcggccctggaggagccagcggcggcctgacagaggacagcagcacccggcggcccccagccaagccccggcggcaccccagcaccaagctgtccatggtgggccctggcagcggggctgagaccccacccagcaagaaggccggcagccagaagcccaccccagagggccgggagagcagcaggaaggtgcccccccagaagccccggcgcagccccaacacccagctgtctgtgtcctttgatgagagctgccccccaggccccagcccccggggcggcaacctgcccctgcagaggctgacccggggcagccgggtggccggggaccctgatgtgggcgcccaggaggagcctgtgtacatcgagatggtgggagatgtgttccggggcggcggccgcagcggcggcggcctggccggcccccccctgggcggcggcggccccaccccacctgctggagctgacagcgacagcgaggagagcgaggccatctatgaggagatgaagtaccccctgcctgaggaggccggggagggccgggccaatggacctccacccctgacagccaccagccccccccagcagccccacgccctgccccctcatgcccaccggcggcctgccagcgccctgcccagcagaagagatggcacccccaccaagaccaccccctgtgagatccccccacccttccccaacctgctgcagcaccggccccccctgctggccttcccccaggccaagagcgccagcaggaccccaggagatggagtgtcccggctgcctgtgctgtgccacagcaaggagcccgccggcagcaccccagccccccaggtgcctgcccgggagcgggagaccccacctcctcctcctcctcctcctgctgccaacctgctgctgctgggccccagcggccgggcccggagccacagcacccccctgcccccccagggcagcggccagcccagaggagagcgggagctgcccaacagccacagcatgatctgccccaaggctgctggggccccagctgcccccccagccccagctgccctgctgcccggcccccccaaggacaaggctgtgtcctacaccatggtgtacagcgctgtgaaggtgaccacccacagcgtgctgcctgctggcccccccctgggcgctggggagcccaagacagagaaggagatctctgtgctgcacggcatgctgtgcaccagcagccggccccctgtgcctgggaagaccagcccccatggaggagccatgggcgctgctgctggggtgctgcaccaccggggctgcctggccagcccccacagcctgcctgaccccaccgtgggccccctgacccccctgtggacctacccagccacagctgctggcctgaagaggcccccagcctatgagagcctgaaggccggcggcgtgctgaacaagggctgcggcgtgggcgcccccagccccatggtgaagatccagctgcaggagcagggcacagatggaggagcctttgccagcatcagctgtgcccacgtgattgccagcgctggcaccccagaggaggaggaggaggaggtgggcgccgccaccttcggggccggctgggccctgcagaggaaggtgctgtatggaggcaggaaggccaaggagctggacacagaggtggaggatggagcccgggcctggaatggcagcgctgagggccctgggaaggtggagcgggaggaccggggccctggcaccagcggcatccctgtgcgcagccagggcgctgagggcctgctggcccgcatccaccacggggacagaggaggcagcaggacagccctgcccatcccctgccagaccttccctgcctgccacagaaatggagacttcaccggcggctaccgcctgggccgcagcgccagcaccagcggcgtgcggcaggtggtgctgcacaccccccggccctgcagccagcccagagatgccctgagccagccccacccagccctgcccctgcccctgcccctgcccccccagcctgcccgggagagagatggcaagctgctggaggtgattgaaaggaagagatgtgtgtgcaaggagatcaaggcccggcacaggccagaccggggcctgtgcaagcaggagagcatgcccatcctgcccagctggaggcggggccctgagcccaggaagagcggcaccccaccctgccggcggcagcacacagtgctgtgggacacagccatctag

SEQ ID NO: 40289 - DNA, 1962 bp, Artificial Sequence
  Description of Artificial Sequence: Synthetic coding sequence
atgatcagcagcaagatgatgagcagcaaccctgaggaggaccccctggacaccttcctgcagtacatcgaggacatgggcatgaaggcctatgatggcctggtgatccagaatgccagtgacatcgccagagaaaatgaccggctgagaaatgagaccaacctggcctacctgaaggagaagaatgagaagagaagacggcaggaggaggccatcaagagaattggaggagaggtgggccggggccacgagggcagctatgtgggcaagcacttcaggatgggcttcatgaccatgcctgccccccaggaccggctgccccacccctgcagcagcggcttctctgtgcgcagccagagcctgcacagcgtgggcggcacagatgatgacagcagctgtggcagccggcggcagcccccacccaagcccaagagggaccccagcaccaagctgagcaccagcagcgagaccgtgagcagcacagctgccagcaagagcggcaagaccccagagaggacagaggccagcgccaagccccggccccacagtgatgagtacagcaagaagatccccccacccaagcccaagaggaaccccaacacccagctgagcaccagctttgatgagacctacatcaagaagcacggccccaggaggaccagcctgccccgggacagcagcctgagccagatgggcagccctgctggggaccctgaggaggaggagcctgtgtacatcgagatggtgggcaacatcctgcgggacttcagaaaagaagatgatgaccagagcgaggccgtgtatgaggagatgaagtaccccatctttgatgacctgggccaggatgccaagtgtgactttgaccaccacagctgcagcagccagtgtgccacccccaccgtgcctgacctggactttgccaaggcctctgtgccctgcccccccaagggcctgctgtgtgacatccccccacccttccccaacctgctgagccaccggccccccctgctggtgttccccccagcccctgtgcactgcagccccaacagtgatgagagccccctgacccccctggaggtgaccaagctgcctgtgctggagaatgtgtcctacatgaagcagcctgctggggccagccccagcaccctgcccagccacgtgcccggccacgccaagctggagaaggagcaggccgccgccctgggccctgccagcgccaccccagccctgagcagcagccccccaccacccagcaccctgtaccgcacccagagcccccacggctaccccaagagccacagcaccagccccagccctgtgtccatgggccgcagcctgacccccctgagcctgaagaggcccccaccctatgatgctgtgcacagcggcagcctgagccgcagcagccccagcgtgccccacagcacccccaggcctgtgtcccaggatggagccaagatggtgaatgctgctgtgaacacctatggagctgcccctgggggcagccgcagcaggacccccaccagccccctggaggagctgaccagcctcttcagcagcggccgcagcctgctgaggaagagcagcagcggccgccgcagcaaggagcctgctgagaagagcacagaggagctgaaggtgcgcagccacagcacagagcccctgcccaagctggacaacaaggagcggggccaccacggggccagcagcagccgggagcctgtgaaggcccaggagtgggatggcaccccaggcacccctgtggtgaccagccggctgggccgctgcagcgtgagccccaccctgctggccggcaaccacagcagcgagcccaaggtgtcctgcaagctgggccgcagcgccagcaccagcggcgtgcccccacccagcgtgacccccctgcggcagagcagtgacctgcagcagagccaggtgcccagcagcctggccaacagagactag

SEQ ID NO: 40290 - DNA, 435 bp, Artificial Sequence
  Description of Artificial Sequence: Synthetic coding sequence
atgatcagcagcaagatgatgagcagcaaccctgaggaggaccccctggacaccttcctgcagtacatcgaggacatgggcatgaaggcctatgatggcctggtgatccagaatgccagtgacatcgccagagaaaatgaccggctgagaaatgagaccaacctggcctacctgaaggagaagaatgagaagagaagacggcaggaggaggccatcaagaggatcaacagaggaacagagagccccaagccccagcacggggccatcaccaaggtgggccagcagggcaagaggcctccctggggcgtcttcctgcagagggcctgccagagcagcggcatgggctggaacacccgggacacctgtggccaccagagcaccaggaagatgctgtgtgagccccacctggtgtctgggaagccccagttcagatag

SEQ ID NO: 40291 - DNA, 498 bp, Artificial Sequence
  Description of Artificial Sequence: Synthetic coding sequence
ctggcctggaggcctggagagcggggggccccagccagccggccccggctggccctgctgctgctgctgctgctgctgcccctgcccagcggggcctggtacaagcacgtggccagcccccgctaccacacagtgggccgggctgctggcctgctgatgggcctgcggcgcagcccctacctgtggaggcgggccctgcgggctgctgctggccccctggcccgggacaccctgagccctgagcctgctgcccgggaggcccccctgctgctgcccagctgggtgcaggagctgtgggagaccaggagaagaagcagccaggccggcatccctgtgcgggcccccaggagcccccgggcccctgagcccgccctggagcctgagagcctggacttctctggagctggccagaggctgcggagagatgtgtccaggcctgctgtggaccctgctgccaaccggctgggcctgccctgcctggcccctggccccttctag

SEQ ID NO: 40292 - DNA, 1260 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggccagagcgtggaggccgccctgaggatggagcggcaggccgccagcgaggagaagaggaagctggcccagctgcaggtggcctaccaccagctgttccaggagtatgacaaccacatcaagagctctgtggtgggcagcgagaggaagaggggcatgcagctggaggacctgaagcagcagctgcagcaggccgaggaggccctggtggccaagcaggaggtgattgacaagctgaaggaggaggccgagcagcacaagatcgtgatggagaccgtgcctgtgctgaaggcccaggccgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcatcgagtag

SEQ ID NO: 40293 - DNA, 1209 bp, Artificial Sequence
  Description of Artificial Sequence: Synthetic coding sequence
atgcctcctgtgagccgcagcagctacagtgaagatattgtgggcagcagaagaagaagaagaagcagcagcggcagcccccccagcccccagagccgctgcagctcctgggatggctgcagccgcagccacagccggggccgggagggcctgcggcccccctggagcgagctggatgtgggcgccctgtaccccttcagccgcagcggcagccggggccgcctgccccgcttcagaaattatgcctttgccagctcctggagcaccagctacagcggctaccgctaccaccgccactgctacgccgaggagcggcagagcgcagaagattatgagaaggaggagagccaccggcagaggcggctgaaggagcgggagcgcatcggggagctgggcgcccctgaggtgtggggccccagccccaagttcccccagctggacagtgatgagcacacccctgtggaggatgaggaggaggtgacccaccagaagagcagcagcagtgacagcaacagcgaggagcacaggaagaagaagaccagccgcagcaggaacaagaagaagaggaagaacaagagcagcaagaggaagcacaggaagtacagcgacagcgacagcaacagcgagagtgacaccaacagcgacagtgatgatgacaagaagagggtgaaggccaagaagaagaagaagaagaagaagcacaagaccaagaagaagaagaacaagaagaccaagaaggagagcagtgacagcagctgcaaggacagcgaggaggacctgtctgaggccacctggatggagcagcccaacgtggccgacaccatggacctgattggccctgaggcccccatcatccacaccagccaggatgagaagcccctgaagtatggccacgccctgctgcccggggagggcgccgccatggccgagtatgtgaaggccggcaagaggatcccccggcggggggagatcggcctgaccagcgaggagatcggcagctttgaatgttctggctacgtgatgagcggcagccgccacaggaggatggaggccgtgcggctgaggaaagaaaaccagatctacagcgcagatgagaagagggccctggccagcttcaaccaggaggagaggaggaagcgggagagcaagatcctggccagcttccgggagatggtgcacaagaagaccaaggagaaggatgacaagtag

SEQ ID NO: 40294 - DNA, 576 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtgggcagcgagatgattgagacccaggaggacatctacgtgggcagcattgaaacagaccggggcgtgcgggagcaggtgcgcttctatgacacccggggcctgagagatggagctgagctgcccaggcactgcttcagctgcacagatggctacgtgctggtgtacagcacagacagccgggagagcttccagagggtggagctgctgaagaaggagattgacaagagcaaggacaagaaggaggtgaccatcgtggtgctgggcaacaagtgtgacctgcaggagcagaggagagtggaccctgatgtggcccagcactgggccaagtctgagaaggtgaagctgtgggaggtgtctgtggccgaccggcgcagcctgctggagccctttgtgtacctggccagcaagatgacccagccccagagcaagagcgccttccccctgagcaggaagaacaagggcagcggcagcctggatggatag

SEQ ID NO: 40295 - DNA, 2181 bp, Artificial Sequence
  Description of Artificial Sequence: Synthetic coding sequence
atggccgcccctgggggccggggccgcagcctgagcggcctgctgcctgcccagaccagcctggagtatgccctgctggatgctgtgacccagcaggagaaggacagcctggtgtaccagtacctgcagaaggtggatggctgggagcaggacctgtctgtgcctgagttccctgagggcctggagtggctgaacacagaggagcccatctctgtgtacaaggacctgtgtgggaagatcgtggtgctggacttcttcacctactgctgcatcaactgcatccacctgctgcctgacctgcacgccctggagcacacctacagcgacaaggatggcctgctgatcatcggcgtgcacagcgccaagttccccaatgagaaggtgctggacaacatcaagtctgctgtgctgcgctacaacatcacccaccccatggtgaatgatgctgatgccagcctgtggcaggagctggaggtgtcctgctggcccaccctggtgatcctgggcccccggggcaacatgctgttcagcctgattggagagggccacaaggacaagctgttcctgtacaccagcatcgccctgaagtactacaaggaccggggccagatccgggacaacaagattggcatcaagctgtacaaggacagcctgccccccagccccctgctcttccctgggaaggtgacagtggaccaggtgacagaccggctggtgattgctgacaccggccaccaccgcatcctggtggtgtggaagaatggccagatccagtacagcattggaggccccaaccctggcaggaaggatggcatcttcagcgagagcaccttcaacagcccccagggcgtggccatcatgaacaacatcatctacgtggccgacacagagaaccacctgatcaggaagattgacctggaggccgagaaggtgtccacagtggccggcatcggcatccagggcacagacaaggagggcggggccaagggggagcagcagcccatcagcagcccctgggatgtggtgtttggcaccagcggcagcgaggtgcagagaggagacatcctgtggatcgccatggccggcacccaccagatctgggccctgctgctggacagcggcaagctgcccaagaagaatgagctgaccaagggcacctgcctgcgctttgctggcagcggaaatgaagaaaatagaaataatgcctacccccacaaggccggctttgcccagcccagcggcctgagcctggccagcgaggacccctggagctgcctgtttgtggccgacagcgagagcagcacagtgaggacagtgtccctgaaggatggagctgtgaagcacctggtgggcggggagcgggaccccatgaacctgtttgcctttggagatgtggatggagtgggcatcaatgccaagctgcagcaccccctgggcgtgacctgggacaagaagaggaacctgctgtatgtggccgacagctacaaccacaagatcaaggtggtggaccccaagaccaagaactgcaccaccctggccggcactggagacaccaacaacgtgaccagcagcagcttcacagagagcaccttcaatgagcccggcggcctgtgcattggagaaaatggagagctgctgtatgtggccgacaccaacaaccaccagatcaaggtgatggacctggagaccaagatggtgtctgtgctgcccatcttccgctcagaaaatgctgtggtggatggccccttcctggtggagaagcagaagaccctgcccaagctgcccaagagcgcccccagcatccggctgagccctgtgacagcctgtgccggccagaccctgcagttcaagctgcggctggacctgcccagcggcagcaagctgacagaaggagtgagcagctgctggttcctgacagctgagggcaatgagtggctgctgcagggccagattgctgctggggacatcgagaacatcagcagccagcccaccatcagcctgcagatcccagatgactgcctgagcctggaggccatcgtgtctgtgtctgtgttcctgtactactgcagcgctgacagcagcgcctgcatgatgaaggccatcctcttcagccagcccctgcagatcacagacacccagcagggctgcatcgcccctgtggagctgcgctacgtgttctag

SEQ ID NO: 40296 - DNA, 372 bp, Artificial Sequence
  Description of Artificial Sequence: Synthetic coding sequence
atgctgggcctggagggcccctgctgggtgggccctggcccagatggcggcctggccgtgtctgaggagtttggagatgtgcggctgtttggcagcgcccggcagcccctgggcagcctgggcggctggacaggccacaccttcggctgcccagctggcatctgcagcaacagcgagggcaatgtgattgtggctgatgagcagaggcggcaggtgaccctcttcccccgggccggcccccccatctgcctggtgtctgagggcctgggccagcccctgggcgtggcctgtgccccccagggccagctgctggtggctgatgccaaggacaacagcatcaaggtgtaccagggcctgaaggagctggcctag

SEQ ID NO: 40297 - DNA, 372 bp, Artificial Sequence; identical to SEQ ID NO: 40296
  Description of Artificial Sequence: Synthetic coding sequence

SEQ ID NO: 40298 - DNA, 4821 bp, Artificial Sequence
  Description of Artificial Sequence: Synthetic coding sequence
atggtggtgttcatcaatgccaagatcaagagcctcatcaagctgttcaagaagaagacagtgagcaacctggatgaggagagccgctggacagtgcactacacagccccctggcaccagcaggagaatgtgttcctgcccaccaccaggcctccctgtgtggaggacctgcaccggcaggccaagctgaacctgaagtctgtgctgagagaatgtgacaagctgcggcatgatggctaccgcagcagccagtactacagccagggccccacctttgctgccaatgccagccccttctgtgatgactaccaggatgaagatgaggagacagaccagaagtgcagcctgagcagcagcgaggaggagcgcttcatcagcatccggcggcccaagaccccagccagcagtgacttcagtgacctgaacacccagaccaactggaccaagagcctgcccctgcccaccccagaggagaagatgaggcagcaggcccagacagtgcaggctgatgtggtgcccatcaacatcactggagaaaattttgaccggcaggccagcctgcggcgcagcctcatctacacagacaccctggtgagaagacccaagaaggtgaagaggaggaagaccatcactggagtgcctgacaacatccagaaggagctggccagcggcaccggccaggatgatgctgatggccacagcgtgtacaccccagaccactacagcaccctgggccgcttcaacagctgccgctctgctggccagaggtctgagacccgggacagcagctgccagacagaagatgtgaaggtggtgcccccatccatgaggcgcatccgggcccagaagggccagggcattgctgcccagatgggccacttcagcggcagcagcggcaacatgtctgtgctgagtgacagcgctggcatcgtgttccccagccggctggacagtgatgctggcttccacagcctgcccaggtctggggcccgggccaacatccagagcctggagccccggctgggcgccctgggccctgctggggacatgaatggcaccttcctgtaccagaggggccacccccaggctgatgagaacctgggccacctgggcggggccagcggcaccggcaccctgctgcggcccaagagccaggagctgcggcactttgaaagtgagaacatcatgagccctgcctgtgtggtgagcccccacgccacctacagcaccagcatcatccccaatgccaccctgagcagcagcagcgaggtgattgccatccccacagcccagagcgctggccagcgggagagcaagagcagcggcagcagccacgcccgcatcaagagccgggaccacctgatcagcagacatgctgtgaagggggacccccagagccctggccgccactggaatgaaggacatgccaccatcctgagccaggacctggacccccacagccctggagagcccgccctgctgagcctgtgtgacagcgctgtgcccctgaatgccccagccaaccgggagaatggcagccaggccatgccctacaactgcaggaacaacctggccttccctgcccacccccaggatgtggatggcaagtctgagagcagctacagcggcggcggcggccacagcagcagcgagccctgggagtacaagagcagtggaaatggccgggccagccccctgaagccccacctggccaccccaggctacagcacccccaccagcaacatgagcagctgcagcctggaccagaccagcaacaaggaggatgctggcagcctgtacagcgaggaccatgatggctactgtgcctctgtgcacacagattctggccacggcagcggcaacctgtgcaacagcagtgatggctttggaaaccccaggcacagcgtcatcaacgtgtttgtgggccgggcccagaagaaccagggcgacaggagcaactaccaggacaagagcctgagcaggaacatcagcctgaagaaggccaagaagccacccctgccccccagcaggacagacagcctgcggcgcatccccaagaagagcagccagtgcaatggccaggtgctgaatgaaagcctgattgccaccctgcagcacagcctgcagctgagcctgcccgggaagagcggcagcagccccagccagagcccctgcagcgacctggaggagccctggctgcccaggagccgcagccagagcacagtgtctgctggcagctccatgaccagcgccaccaccccaaatgtgtacagcctgtgtggggccacccccagccagagcgacaccagctctgtgaagtctgagtacacagacccctggggctactacatcgactacacaggcatgcaggaggaccccggcaacccagctgggggctgcagcaccagcagcggcgtgcccactggaaatggacctgtgagacatgtgcaggagggcagccgggccaccatgccccaggtgcctgggggctctgtgaagcccaagatcatgagccctgagaagagccacagggtcatcagccccagcagcggctacagcagccagagcaacacccccacagccctgacccctgtgcctgtgttcctgaagtctgtgtccccagccaacgggaagggcaagcccaagcccaaggtgcctgagaggaagagcagcctcatcagctctgtgtccatcagcagcagcagcaccagcctgagcagcagcaccagcacagagggcagcggcaccatgaagaagctggaccctgctgtgggcagccccccagcccctcctcctcctcctgtgcccagcccccccttcccctgcccagctgacaggagccccttcctgcccccacctcctcctgtgacagactgcagccagggcagccccctgccccacagccctgtgttccccccacctcctcctgaggccctgatccccttctgcagccccccagactggtgcctgagcccccccaggcctgccctgagccccatcctgcctgacagccctgtgtccctgcccctgcccccacccctgctgcccagcagcgagcccccaccagccccacccctggaccccaagttcatgaaggacacccggccccccttcaccaacagcggccagcctgagagcagccggggcagcctgcggccccccagcaccaaggaggagaccagcaggcctcccatgcccctcatcaccacagaggccctgcagatggtgcagctgcggcctgtgaggaagaacagcggggctgaggccgcccagctgtctgagaggacagcccaggagcagaggacccctgtggccccccagtaccacctgaagcccagcgccttcctgaagagcaggaacagcaccaatgagatggagagcgagagccagcctgcctctgtgaccagcagcctgcccaccccagccaagagcagcagccagggcgaccacggcagcgctgctgagcggggcggccctgtgagccgcagccctggggcccccagcgctggggaggccgaggcccggcccagccccagcaccacccccctgcctgacagcagccccagcaggaagcccccacccatcagcaagaagcccaagctgttcctggtggtgcccccaccccagaaggactttgctgtggagccagcagaaaatgtgtctgaggccctgcgggctgtgcccagccccaccaccggggaggagggctctgtgcacagccgggaggccaaggagagcagcgctgcccaggccggcagccacgccacccaccctggcacctctgtgctggagggcggggccgccggctccatgagccccagccgggtggaggccaacgtgcccatggtgcagccagatgtgtccccagcccccaagcaggaggagcctgctgagaacagcgctgacacaggaggagatggagagagctgcctgagccagcaggatggagctgctggggtgcctgagaccaatgctgctggcagcagcagcgaggcctgtgacttcctgaaggaggatggaaatgatgaggtgatgacccccagccggcccaggaccacagaggacctgtttgctgccatccacaggagcaagaggaaggtgctgggccggcgggacagtgatgatgaccacagcaggaaccacagccccagcccccctgtgacccccaccggggccgcccccagcctggccagccccaagcaggtgggcagcatccagaggagcatcaggaagagcagcaccagcagtgacaacttcaaggccctgctgctgaagaagggcagcagaagtgacaccagcgccaggatgtctgctgctgagatgctgaagaacacagacccccgcttccagaggagccgctctgagcccagcccagatgcccctgagagccccagcagctgcagccccagcaagaacagaagagcccaggaggagtgggccaagaatgaaggcctgatgcccaggagcctgtccttcagcggccccaggtatggccgcagcaggaccccaccttctgctgccagcagccgctacagcatgaggaaccgcatccagagcagccccatgaccgtcatcagcgagggggagggggaggccgtggagcctgtggacagcatcgcccggggggccctgggcgctgctgagggctgcagcctggatggcctggcccgggaggagatggatgaaggaggcctgctgtgtggggagggccctgctgccagcctgcagccccaggcccctggccctgtggatggaacagccagcgctgagggccgggagcccagcccccagtgtggcggcagcctgtctgaggagagctag

SEQ ID NO: 40299 - DNA, 4833 bp, Artificial Sequence
  Description of Artificial Sequence: Synthetic coding sequence
atgaagaaggagggcagcagcggcagcttccggctgcagcccaacacaggcagcctgagcagagctgtgtcctggatcaacttcagcagcctgagccggcagaccaagaggctcttcagaagtgatggagagctgtctgtgtgtggccagcaggtggaggtggatgatgagaactggatctaccgggcccagcccaggaaggctgtgagcaacctggatgaggagagccgctggacagtgcactacacagccccctggcaccagcaggagaatgtgttcctgcccaccaccaggcctccctgtgtggaggacctgcaccggcaggccaagctgaacctgaagtctgtgctgagagaatgtgacaagctgcggcatgatggctaccgcagcagccagtactacagccagggccccacctttgctgccaatgccagccccttctgtgatgactaccaggatgaagatgaggagacagaccagaagtgcagcctgagcagcagcgaggaggagcgcttcatcagcatccggcggcccaagaccccagccagcagtgacttcagtgacctgaacacccagaccaactggaccaagagcctgcccctgcccaccccagaggagaagatgaggcagcaggcccagacagtgcaggctgatgtggtgcccatcaacatcacagccagcggcaccggccaggatgatgctgatggccacagcgtgtacaccccagaccactacagcaccctgggccgcttcaacagctgccgctctgctggccagaggtctgagacccgggacagcagctgccagacagaagatgtgaaggtggtgcccccatccatgaggcgcatccgggcccagaagggccagggcattgctgcccagatgggccacttcagcggcagcagcggcaacatgtctgtgctgagtgacagcgctggcatcgtgttccccagccggctggacagtgatgctggcttccacagcctgcccaggtctggggcccgggccaacatccagagcctggagccccggctgggcgccctgggccctgctggggacatgaatggcaccttcctgtaccagaggggccacccccaggctgatgagaacctgggccacctgggcggggccagcggcaccggcaccctgctgcggcccaagagccaggagctgcggcactttgaaagtgagaacatcatgagccctgcctgtgtggtgagcccccacgccacctacagcaccagcatcatccccaatgccaccctgagcagcagcagcgaggtgattgccatccccacagcccagagcgctggccagcgggagagcaagagcagcggcagcagccacgcccgcatcaagagccgggaccacctgatcagcagacatgctgtgaagggggacccccagagccctggccgccactggaatgaaggacatgccaccatcctgagccaggacctggacccccacagccctggagagcccgccctgctgagcctgtgtgacagcgctgtgcccctgaatgccccagccaaccgggagaatggcagccaggccatgccctacaactgcaggaacaacctggccttccctgcccacccccaggatgtggatggcaagtctgagagcagctacagcggcggcggcggccacagcagcagcgagccctgggagtacaagagcagtggaaatggccgggccagccccctgaagccccacctggccaccccaggctacagcacccccaccagcaacatgagcagctgcagcctggaccagaccagcaacaaggaggatgctggcagcctgtacagcgaggaccatgatggctactgtgcctctgtgcacacagattctggccacggcagcggcaacctgtgcaacagcagtgatggctttggaaaccccaggcacagcgtcatcaacgtgtttgtgggccgggcccagaagaaccagggcgacaggagcaactaccaggacaagagcctgagcaggaacatcagcctgaagaaggccaagaagccacccctgccccccagcaggacagacagcctgcggcgcatccccaagaagagcagccagtgcaatggccaggtgctgaatgaaagcctgattgccaccctgcagcacagcctgcagctgagcctgcccgggaagagcggcagcagccccagccagagcccctgcagcgacctggaggagccctggctgcccaggagccgcagccagagcacagtgtctgctggcagctccatgaccagcgccaccaccccaaatgtgtacagcctgtgtggggccacccccagccagagcgacaccagctctgtgaagtctgagtacacagacccctggggctactacatcgactacacaggcatgcaggaggaccccggcaacccagctgggggctgcagcaccagcagcggcgtgcccactggaaatggacctgtgagacatgtgcaggagggcagccgggccaccatgccccaggtgcctgggggctctgtgaagcccaagatcatgagccctgagaagagccacagggtcatcagccccagcagcggctacagcagccagagcaacacccccacagccctgacccctgtgcctgtgttcctgaagtctgtgtccccagccaacgggaagggcaagcccaagcccaaggtgcctgagaggaagagcagcctcatcagctctgtgtccatcagcagcagcagcaccagcctgagcagcagcaccagcacagagggcagcggcaccatgaagaagctggaccctgctgtgggcagccccccagcccctcctcctcctcctgtgcccagcccccccttcccctgcccagctgacaggagccccttcctgcccccacctcctcctgtgacagactgcagccagggcagccccctgccccacagccctgtgttccccccacctcctcctgaggccctgatccccttctgcagccccccagactggtgcctgagcccccccaggcctgccctgagccccatcctgcctgacagccctgtgtccctgcccctgcccccacccctgctgcccagcagcgagcccccaccagccccacccctggaccccaagttcatgaaggacacccggccccccttcaccaacagcggccagcctgagagcagccggggcagcctgcggccccccagcaccaaggaggagaccagcaggcctcccatgcccctcatcaccacagaggccctgcagatggtgcagctgcggcctgtgaggaagaacagcggggctgaggccgcccagctgtctgagaggacagcccaggagcagaggacccctgtggccccccagtaccacctgaagcccagcgccttcctgaagagcaggaacagcaccaatgagatggagagcgagagccagcctgcctctgtgaccagcagcctgcccaccccagccaagagcagcagccagggcgaccacggcagcgctgctgagcggggcggccctgtgagccgcagccctggggcccccagcgctggggaggccgaggcccggcccagccccagcaccacccccctgcctgacagcagccccagcaggaagcccccacccatcagcaagaagcccaagctgttcctggtggtgcccccaccccagaaggactttgctgtggagccagcagaaaatgtgtctgaggccctgcgggctgtgcccagccccaccaccggggaggagggctctgtgcacagccgggaggccaaggagagcagcgctgcccaggccggcagccacgccacccaccctggcacctctgtgctggagggcggggccgccggctccatgagccccagccgggtggaggccaacgtgcccatggtgcagccagatgtgtccccagcccccaagcaggaggagcctgctgagaacagcgctgacacaggaggagatggagagagctgcctgagccagcaggatggagctgctggggtgcctgagaccaatgctgctggcagcagcagcgaggcctgtgacttcctgaaggaggatggaaatgatgaggtgatgacccccagccggcccaggaccacagaggacctgtttgctgccatccacaggagcaagaggaaggtgctgggccggcgggacagtgatgatgaccacagcaggaaccacagccccagcccccctgtgacccccaccggggccgcccccagcctggccagccccaagcaggtgggcagcatccagaggagcatcaggaagagcagcaccagcagtgacaacttcaaggccctgctgctgaagaagggcagcagaagtgacaccagcgccaggatgtctgctgctgagatgctgaagaacacagacccccgcttccagaggagccgctctgagcccagcccagatgcccctgagagccccagcagctgcagccccagcaagaacagaagagcccaggaggagtgggccaagaatgaaggcctgatgcccaggagcctgtccttcagcggccccaggtatggccgcagcaggaccccaccttctgctgccagcagccgctacagcatgaggaaccgcatccagagcagccccatgaccgtcatcagcgagggggagggggaggccgtggagcctgtggacagcatcgcccggggggccctgggcgctgctgagggctgcagcctggatggcctggcccgggaggagatggatgaaggaggcctgctgtgtggggagggccctgctgccagcctgcagccccaggcccctggccctgtggatggaacagccagcgctgagggccgggagcccagcccccagtgtggcggcagcctgtctgaggagagctag

SEQ ID NO: 40300 - DNA, 2130 bp, Artificial Sequence
  Description of Artificial Sequence: Synthetic coding sequence
atggagagcatgggcatggtgtacagcgtgcccagcagctgcaatggccccacagagagcaccttcagcacctcctggaagggagatgccttcacctacatgaccccatctgccaccagccagagcaaccaggtgaatgaaaatggcaagaaccccagctgtggcaacagctgggtgtccctgaacaaggtgccccccctggtgcccaaggaggccgccaccctgctggtggcccgggacaacccagctggctgcagcggcagcgctggctacccagagcggctcatccagcagaggcacatgcctgagcggcccagcaagattggcctgctgaccagcggcaccagccggctggagaccggccctgggggcgccagccgcttccgggagaggagcctgtctgtgcccacagattctggcaccacagatgtggactatgatgaggagcagaaggccaatgaggcctgtgccctgccctttgccagcaccagcagcgagggcagcaacagcgctgacaacatcgccagcctgagcgcccagcaggaggcccagcaccggcggcagaggagcaagagcatcagcctgaggaaggccaagaagaagcccagcccccccaccaggtctgtgtccctggtgaaggatgagcccggcctgctgcctgagggcggcagcgccctgcccaaggaccagaggcccaagagcctgtgcctgagcctggagcaccagggccaccacagcagccacccagatgcccagggccacccagccatccccaaccacaaggaccctgagagcacccagttcagccaccactggtacctgacagactggaagagcggggacacctaccagagcctgagcagcagcagcacagccaccggcaccaccgtgattgaatgtacccaggtgcagggcagcagcgagagcctggccagccccagcaccagccgggccaccacccccagccagctgagcattgaggtggaggcccgggagatcagcagccctggccggcccccaggcctgatgagccccagcagcggctacagcagccagagcgagacccccacccccaccgtgtccatgagcctgaccctgggccacctgcccccacccagcagctctgtgcgggtgcggcctgtggtgcctgagaggaagagcagcctgccccccaccagccccatggagaagttccccaagagccggctgagctttgacctgcccctgaccagcagccccaacctggacctgagcggcatgagcatcagcatccgcagcaagaccaaggtgagccgccaccacagcgagaccaactttggagtgaagctggcccagaagaccaaccccaaccagcccatcatgcccatggtgacccagagcgacctgcggtctgtgcggctgcggtctgtgtccaagtctgagccagaagatgacatcgagagcccagaatatgcagaggagcccagggctgaggaggtgttcaccctgcctgagaggaagaccaagccccctgtggccgagaagccccctgtggcccggcggccccccagcctggtgcacaagccacccagcgtgcctgaggagtatgccctgaccagccccaccctggccatgccacccaggagcagcatccagcacgcccggcccctgccccaggacagctacacagtggtgaggaagcccaagcccagcagcttcccagatggccgcagccctggagagagcacagcccccagcagcctggtgttcaccccatttgccagcagcagtgatgccttcttcagcggcacccagcagcccccccagggctctgtggaggatgagggccccaaggtgcgggtgctgcctgagcgcatcagcctgcagagccaggaggaggccgagaagaagaagggcaagatccccccacctgtgcccaagaagcccagcgtgctgtacctgcccctgaccagccccacagcccagatggaggcctacgtggccgagccccggctgcccctgagccccatcatcaccctggaggaggacaccaagtgcccagccactggagatgacctgcagagcctgggccagagggtgaccagcaccccccaggccgacagcgagcgggaggccagccccctgggctag

SEQ ID NO: 40301 - DNA, 2130 bp, Artificial Sequence; identical to SEQ ID NO: 40300
  Description of Artificial Sequence: Synthetic coding sequence

SEQ ID NO: 40302 - DNA, 3678 bp, Artificial Sequence
  Description of Artificial Sequence: Synthetic coding sequence
atgcccttctacagaagaacagtggtgccccagaggctgtgccccaggaaccccccccagcagctggccgagctgagagatgtgagccacctggccgccctgagcctgctgcggcagctggccgacctgtgtggccacagcctggccctgctggaggacctggagggccacctgctggccctgggcagaagaacagacagcctgtacagaagaacagtgcggctgcggcggcggctgccctgccgcctgctgggccctgaggaggatgaggaggagctggccgccgccaacagcggcagagaaaatgccacagccacagcccacagccgcagctcctggaggcagcctgtgaatgtgttcctgagcagcggccggccccccagcgtggaggagctgctgcgggaggcccagctgaacctgcagagcctgctgcaggaggagtatgaggagcagtacagcgaggcccggctggtgggccagaccttccgcagcagtgatgaggccaccaagcccacccccaacccccggccccagagcgcccggcggctggagttcatcctgatgcccaccaagaggcagctgtctgaagatgagaccaccacccagggcgtgcgggcccctgaggccagcctgagcctgagcaccacagctgacaagcagacagcctggaacagcctcttccccctgcccatcctggaggagaagcgctggccccagctgtgcagcacccagagcgacatcgtgcccatcaacatcagcggccagcagtttgacaagcacgccagcctgcggcacagcctcttcaacacagaaacagctgtgaaccccaagagcaccctgcggcggcggaggaccatcatcggcttcagcaacttcagccagagggaccagggccacagcaacagccctgctggctctgtggcccacagcaccaccagtgacatccggcccagccacagcgtgcctgagggcgtgcacggccgggtggccgtgggccaggatgcccgcttccccagcctgaccagccctgtgctgcggacccccagcagcgagccagatgagccccaccaggcccggagcggccccaaccccccaggcatggagagcatgggcatggtgtacagcgtgcccagcagctgcaatggccccacagagagcaccttcagcacctcctggaagggagatgccttcacctacatgaccccatctgccaccagccagagcaaccaggtgaatgaaaatggcaagaaccccagctgtggcaacagctgggtgtccctgaacaaggtgccccccctggtgcccaaggaggccgccaccctgctggtggcccgggacaacccagctggctgcagcggcagcgctggctacccagagcggctcatccagcagaggcacatgcctgagcggcccagcaagattggcctgctgaccagcggcaccagccggctggagaccggccctgggggcgccagccgcttccgggagaggagcctgtctgtgcccacagattctggcaccacagatgtggactatgatgaggagcagaaggccaatgaggcctgtgccctgccctttgccagcaccagcagcgagggcagcaacagcgctgacaacatcgccagcctgagcgcccagcaggaggcccagcaccggcggcagaggagcaagagcatcagcctgaggaaggccaagaagaagcccagcccccccaccaggtctgtgtccctggtgaaggatgagcccggcctgctgcctgagggcggcagcgccctgcccaaggaccagaggcccaagagcctgtgcctgagcctggagcaccagggccaccacagcagccacccagatgcccagggccacccagccatccccaaccacaaggaccctgagagcacccagttcagccaccactggtacctgacagactggaagagcggggacacctaccagagcctgagcagcagcagcacagccaccggcaccaccgtgattgaatgtacccaggtgcagggcagcagcgagagcctggccagccccagcaccagccgggccaccacccccagccagctgagcattgaggtggaggcccgggagatcagcagccctggccggcccccaggcctgatgagccccagcagcggctacagcagccagagcgagacccccacccccaccgtgtccatgagcctgaccctgggccacctgcccccacccagcagctctgtgcgggtgcggcctgtggtgcctgagaggaagagcagcctgccccccaccagccccatggagaagttccccaagagccggctgagctttgacctgcccctgaccagcagccccaacctggacctgagcggcatgagcatcagcatccgcagcaagaccaaggtgagccgccaccacagcgagaccaactttggagtgaagctggcccagaagaccaaccccaaccagcccatcatgcccatggtgacccagagcgacctgcggtctgtgcggctgcggtctgtgtccaagtctgagccagaagatgacatcgagagcccagaatatgcagaggagcccagggctgaggaggtgttcaccctgcctgagaggaagaccaagccccctgtggccgagaagccccctgtggcccggcggccccccagcctggtgcacaagccacccagcgtgcctgaggagtatgccctgaccagccccaccctggccatgccacccaggagcagcatccagcacgcccggcccctgccccaggacagctacacagtggtgaggaagcccaagcccagcagcttcccagatggccgcagccctggagagagcacagcccccagcagcctggtgttcaccccatttgccagcagcagtgatgccttcttcagcggcacccagcagcccccccagggctctgtggaggatgagggccccaaggtgcgggtgctgcctgagcgcatcagcctgcagagccaggaggaggccgagaagaagaagggcaagatccccccacctgtgcccaagaagcccagcgtgctgtacctgcccctgaccagccccacagcccagatggaggcctacgtggccgagccccggctgcccctgagccccatcatcaccctggaggaggacaccaagtgcccagccactggagatgacctgcagagcctgggccagagggtgaccagcaccccccaggccgacagcgagcgggaggccagccccctgggcagctctgtggagcccggcacagaggagaagagcctcatcagtgacaagacagctgagtggattgctgaagatgatgatgatgtgtttgtggccagcaggaccacagaagatctcttcaccgtcatccacaggagcaagaggaagctgctgggctggaaggagcccggggaggcctttgtgggcggccgcaccagcagccacagccccatcaagaacacagctgagagccccatcagcgagagcacagccacagctggcagcggcagcagcgccaacctggatgctggaagaaatgatgacttcaaggccctgctgcagaagaagggcagcaaggccacccccaggagccggcccagcgctgctgagctgctgaagaccaccaaccccctggcccggcgcatcatcgcccagttcagcaaggactatgagaccacagacaaccccagcacctag

SEQ ID NO: 40303 - DNA, 2139 bp, Artificial Sequence
  Description of Artificial Sequence: Synthetic coding sequence
atgccagaccaggacaagaaggtgaagaccacagagaagagcacagacaagcagcaggagatcaccatccgggactacagcgacctgaagaggctgcgctgcctgctgaatgtgcagagcagcaagcagcagctgcctgccatcaactttgacagcgcccagaacagcatgaccaagtctgagcccgccatccgggccggcggccaccgggcccggggccagtggcatgagagcacagaagctgtggagctggagaacttcagcatcaactacaagaatgaaagaaacttcagcaagcacccccagaggaagctgttccaggagatcttcaccgccctggtgaagaacagactcatcagccgggagtgggtgaacagagcccccagcatccacttcctgcgggtgctgatctgcctgcggctgctgatgagggacccctgctaccaggagatcctgcacagcctgggcggcatcgagaacctggcccagtacatggagatcgtggccaatgagtacctgggctatggagaggagcagcacacagtggacaagctggtgaacatgacctacatcttccagaagctggccgctgtgaaggaccagcgggagtgggtgaccaccagcggggcccacaagaccctggtgaacctgctgggcgcccgggacaccaacgtgctgctgggcagcctgctggccctggccagcctggccgagagccaggagtgccgggagaagatcagcgagctgaacatcgtggagaacctgctgatgatcctgcacgagtatgacctgctgagcaagaggctgacagctgagctgctgcggctgctgtgtgccgagccccaggtgaaggagcaggtgaagctgtatgagggcatccctgtgctgctgagcctgctgcacagcgaccacctgaagctgctgtggagcatcgtgtggatcctggtgcaggtgtgtgaggaccctgagacctctgtggagatccgcatctggggcggcatcaagcagctgctgcacatcctgcagggcgacaggaactttgtgtctgaccacagcagcatcggcagcctgagcagcgccaatgctgctggccgcatccagcagctgcacctgtctgaggacctgagcccccgggagatccaggagaacaccttcagcctgcaggccgcctgctgtgccgccctgacagagctggtgctgaatgacaccaatgcccaccaggtggtgcaggagaatggagtgtacaccatcgccaagctgatcctgcccaacaagcagaagaatgctgccaagagcaacctgctgcagtgctacgccttccgggccctgcgcttcctgttctccatggagaggaaccggcccctcttcaagaggctcttccccacagacctgtttgagatcttcattgatattggccactacgtgcgggacatcagcgcctatgaggagctggtgtccaagctgaacctgctggtggaggatgagctgaagcagattgctgaaaatattgagagcatcaaccagaacaaggcccccctgaagtacatcggcaactatgccatcctggaccacctgggcagcggggccttcggctgtgtgtacaaggtgaggaagcacagcggccagaacctgctggccatgaaggaggtgaacctgcacaacccagccttcggcaaggacaagaaggaccgggacagctctgtgagaaatattgtgtctgagctgaccatcatcaaggagcagctgtaccaccccaacatcgtgcgctactacaagaccttcctggagaatgaccggctgtacatcgtgatggagctgattgaaggagcccccctgggggagcacttcagcagcctgaaggagaagcaccaccacttcacagaggagcggctgtggaagatcttcatccagctgtgcctggccctgcgctacctgcacaaggagaagagaattgtgcaccgggacctgacccccaacaacatcatgctgggggacaaggacaaggtgacagtgacagactttggcctggccaagcagaagcaggagaacagcaagctgacctctgtggtgggcaccatcctgtacagctgtgtgcagcacctgtacctgcggagccctgccccagccctggccacctag

SEQ ID NO: 40304 - DNA, 1215 bp, Artificial Sequence
  Description of Artificial Sequence: Synthetic coding sequence
atggagctgattgagggcgcccccctgggggagcacttcagcagcctgaaggagaagcaccaccacttcacagaggagcggctgtggaagatcttcatccagctgtgcctggccctgcgctacctgcacaaggagaagagaattgtgcaccgggacctgacccccaacaacatcatgctgggggacaaggacaaggtgacagtgacagactttggcctggccaagcagaagcaggagaacagcaagctgacctctgtggtgggcaccatcctgtacagctgcccagaggtgctgaagtctgagccctatggagagaaggcagatgtgtgggccgtgggctgcatcctgtaccagatggccaccctgagcccccccttctacagcaccaacatgctgagcctggccaccaagatcgtggaggccgtgtatgagcctgtgcctgagggcatctacagcgagaaggtgacagacaccatcagccgctgcctgaccccagatgctgaggcccggccagacatcgtggaggtgtcctccatgatcagtgatgtgatgatgaagtacctggacaacctgagcaccagccagctgagcctggagaagaagctggagcgggagaggaggaggacccagcgctacttcatggaggccaacagaaacacagtgacctgccaccacgagctggccgtgctgagccatgagacctttgagaaggccagcctgagcagcagcagcagtggagctgccagcctgaagtctgagctgtctgagagcgctgacctgcccccagagggcttccaggccagctatggcaaggatgaagatcgggcctgtgatgagatcctgagtgatgacaacttcaacctggagaatgctgagaaggacacctacagcgaggtggatgatgagctggacatcagtgacaacagcagcagcagcagcagcagccccctgaaggagagcaccttcaacatcctgaagaggagcttcagcgccagcggcggggagcggcagagccagacccgggacttcaccggcggcaccggcagccggcccaggcctgccctgctgcccctggacctgctgctgaaggtgcccccccacatgctgcgggcccacatcaaggagattgaggccgagctggtgacaggctggcagagccacagcctgcctgctgtgatcctgaggaacctgaaggaccacggcagcacctactag

SEQ ID NO: 40305 - DNA, 1284 bp, Artificial Sequence
  Description of Artificial Sequence: Synthetic coding sequence
atggtgcctgtgcagcctgctgagcccccagaggtgctgaagtctgagccctacggggagaaggcagatgtgtgggccgtgggctgcatcctgtaccagatggccaccctgagcccccccttctacagcaccaacatgctgagcctggccaccaagatcgtggaggccgtgtatgagcctgtgcctgagggcatctacagcgagaaggtgacagacaccatcagccgctgcctgaccccagatgctgaggcccggccagacatcgtggaggtgtcctccatgatcagtgatgtgatgatgaagtacctggacaacctgagcaccagccagctgagcctggagaagaagctggagcgggagaggaggaggacccagcgctacttcatggaggccaacagaaacacagtgacctgccaccacgagctggccgtgctgagccatgagacctttgagaaggccagcctgagcagcagcagcagcggggccgccagcctgaagtctgagctgtctgagagcgctgacctgcccccagagggcttccaggccagctatggcaaggatgaggaccgggcctgtgatgagatcctgagtgatgacaacttcaacctggagaatgctgagaaggacacctacagcgaggtggatgatgagctggacatcagtgacaacagcagcagcagcagcagcagccccctgaaggagagcaccttcaacatcctgaagaggagcttcagcgccagcggcggggagcggcagagccagacccgggacttcaccggcggcaccggcagccggcccaggcctgccagcgctggcattgctgtgtcccagaggaaggtgcggcagatcagtgaccccatccagcagatcctgatccagctgcacaagatcatctacatcacccagctgcccccagccctgcaccacaacctgaagagaagagtcatcgagcgcttcaagaagagcctcttcagccagcagagcaacccctgcaacctgaagtctgagatcaagaagctgagccagggcagccctgagcccatcgagcccaacttcttcaccgctgactaccacctgctgcacaggagcagcggcggcaacagcctgagccccaatgaccccaccggcctgcccaccagcattgagctggaggagggcatcacctatgagcagatgcagaccgtcatcgaggaggtgctggaggagagcggctactacaacttcaccagcaaccgctaccacagctacccctggggcaccaagaaccaccccaccaagaggtag

SEQ ID NO: 40306 - DNA, 1425 bp, Artificial Sequence
  Description of Artificial Sequence: Synthetic coding sequence
atggtgcctgtgcagcctgctgagcccccagaggtgctgaagtctgagccctacggggagaaggcagatgtgtgggccgtgggctgcatcctgtaccagatggccaccctgagcccccccttctacagcaccaacatgctgagcctggccaccaagatcgtggaggccgtgtatgagcctgtgcctgagggcatctacagcgagaaggtgacagacaccatcagccgctgcctgaccccagatgctgaggcccggccagacatcgtggaggtgtcctccatgatcagtgatgtgatgatgaagtacctggacaacctgagcaccagccagctgagcctggagaagaagctggagcgggagaggaggaggacccagcgctacttcatggaggccaacagaaacacagtgacctgccaccacgagctggccgtgctgagccatgagacctttgagaaggccagcctgagcagcagcagcagcggggccgccagcctgaagtctgagctgtctgagagcgctgacctgcccccagagggcttccaggccagctatggcaaggatgaggaccgggcctgtgatgagatcctgagtgatgacaacttcaacctggagaatgctgagaaggacacctacagcgaggtggatgatgagctggacatcagtgacaacagcagcagcagcagcagcagccccctgaaggagagcaccttcaacatcctgaagaggagcttcagcgccagcggcggggagcggcagagccagacccgggacttcaccggcggcaccggcagccggcccaggcctgccctgctgcccctggacctgctgctgaaggtgcccccccacatgctgcgggcccacatcaaggagattgaagctgagctggtgacaggctggcagagccacagcctgcctgctgtgatcctgaggaacctgaaggaccacgccagcgctggcattgctgtgtcccagaggaaggtgcggcagatcagtgaccccatccagcagatcctgatccagctgcacaagatcatctacatcacccagctgcccccagccctgcaccacaacctgaagagaagagtgattgagcgcttcaagaagagcctcttcagccagcagagcaacccctgcaacctgaagtctgagatcaagaagctgagccagggcagccctgagcccatcgagcccaacttcttcaccgctgactaccacctgctgcacaggagcagcggcggcaacagcctgagccccaatgaccccaccggcctgcccaccagcattgagctggaggagggcatcacctatgagcagatgcagacagtgattgaggaggtgctggaggagagcggctactacaacttcaccagcaaccgctaccacagctacccctggggcaccaagaaccaccccaccaagaggtag

SEQ ID NO: 40307 - DNA, 2178 bp, Artificial Sequence
  Description of Artificial Sequence: Synthetic coding sequence
atgccagaccaggacaagaaggtgaagaccacagagaagagcacagacaagcagcaggagatcaccatccgggactacagcgacctgaagaggctgcgctgcctgctgaatgtgcagagcagcaagcagcagctgcctgccatcaactttgacagcgcccagaacagcatgaccaagtctgagcccgccatccgggccggcggccaccgggcccggggccagtggcatgagagcacagaagctgtggagctggagaacttcagcatcaactacaagaatgaaagaaacttcagcaagcacccccagaggaagctgttccaggagatcttcaccgccctggtgaagaacagactcatcagccgggagtgggtgaacagagcccccagcatccacttcctgcgggtgctgatctgcctgcggctgctgatgagggacccctgctaccaggagatcctgcacagcctgggcggcatcgagaacctggcccagtacatggagatcgtggccaatgagtacctgggctatggagaggagcagcacacagtggacaagctggtgaacatgacctacatcttccagaagctggccgctgtgaaggaccagcgggagtgggtgaccaccagcggggcccacaagaccctggtgaacctgctgggcgcccgggacaccaacgtgctgctgggcagcctgctggccctggccagcctggccgagagccaggagtgccgggagaagatcagcgagctgaacatcgtggagaacctgctgatgatcctgcacgagtatgacctgctgagcaagaggctgacagctgagctgctgcggctgctgtgtgccgagccccaggtgaaggagcaggtgaagctgtatgagggcatccctgtgctgctgagcctgctgcacagcgaccacctgaagctgctgtggagcatcgtgtggatcctggtgcaggtgtgtgaggaccctgagacctctgtggagatccgcatctggggcggcatcaagcagctgctgcacatcctgcagggcgacaggaactttgtgtctgaccacagcagcatcggcagcctgagcagcgccaatgctgctggccgcatccagcagctgcacctgtctgaggacctgagcccccgggagatccaggagaacaccttcagcctgcaggccgcctgctgtgccgccctgacagagctggtgctgaatgacaccaatgcccaccaggtggtgcaggagaatggagtgtacaccatcgccaagctgatcctgcccaacaagcagaagaatgctgccaagagcaacctgctgcagtgctacgccttccgggccctgcgcttcctgttctccatggagaggaaccggcccctcttcaagaggctcttccccacagacctgtttgagatcttcattgatattggccactacgtgcgggacatcagcgcctatgaggagctggtgtccaagctgaacctgctggtggaggatgagctgaagcagattgctgaaaatattgagagcatcaaccagaacaaggcccccctgaagtacatcggcaactatgccatcctggaccacctgggcagcggggccttcggctgtgtgtacaaggtgaggaagcacagcggccagaacctgctggccatgaaggaggtgaacctgcacaacccagccttcggcaaggacaagaaggaccgggacagctctgtgagaaatattgtgtctgagctgaccatcatcaaggagcagctgtaccaccccaacatcgtgcgctactacaagaccttcctggagaatgaccggctgtacatcgtgatggagctgattgaaggagcccccctgggggagcacttcagcagcctgaaggagaagcaccaccacttcacagaggagcggctgtggaagatcttcatccagctgtgcctggccctgcgctacctgcacaaggagaagagaattgtgcaccgggacctgacccccaacaacatcatgctgggggacaaggacaaggtgacagtgtcctgcctgaagtgtgccgcccccctgcccagcctgagctgcagctgcagcggccacatcaagagagctggcagcagctttgccttctgctaccactggaagctgcctgatgccagccaggaggccaatgccatcatggtgcctgtgcagcctgctgagccctag

SEQ ID NO: 40308 - DNA, 291 bp, Artificial Sequence
  Description of Artificial Sequence: Synthetic coding sequence
atgccagaccaggacaagaaggtgaagaccacagagaagagcacagacaagcagcaggagatcaccatccgggactacagcgacctgaagaggctgcgctgcctgctgaatgtgcagagcagcaagcagcagctgcctgccatcaactttgacagcgcccagaacagcatgaccaagtctgagcccgccatccgggccggcggccaccgggcccggggccagtggcatgagagcacagaagctgtggagctggagaacttcagcatcaactacaagaatgaaagaaattag

SEQ ID NO: 40309 - DNA, 402 bp, Artificial Sequence
  Description of Artificial Sequence: Synthetic coding sequence
atgccagaccaggacaagaaggtgaagaccacagagaagagcacagacaagcagcaggagatcaccatccgggactacagcgacctgaagaggctgcgctgcctgctgaatgtgcagagcagcaagcagcagctgcctgccatcaactttgacagcgcccagaacagcatgaccaagtctgagcccgccatccgggccggcggccaccgggcccggggccagtggcatgagagcacagaagctgtggagctggagaacttcagcatcaactacaagaatgaaagaaacttcagcaagcacccccagaggaagctgttccaggagatcttcaccgccctggtgaagaacagactcatcagccgggagtgggtgaacagagcccccagcatccacttcctgtag

SEQ ID NO: 40310 - DNA, 2127 bp, Artificial Sequence
  Description of Artificial Sequence: Synthetic coding sequence
atggacaagtatgatgtgatcaaggccatcggccagggcgccttcggcaaggcctacctggccaagggcaagagtgacagcaagcactgcgtcatcaaggagatcaactttgagaagatgcccatccaggagaaggaggccagcaagaaggaggtgatcctgctggagaagatgaagcaccccaacatcgtggccttcttcaacagcttccaggagaatggccgcctcttcatcgtgatggagtactgtgatggaggagacctgatgaagaggatcaaccggcagaggggcgtgctcttcagcgaggaccagatcctgggctggtttgtgcagatcagcctgggcctgaagcacatccatgacaggaagatcctgcaccgggacatcaaggcccagaacatcttcctgagcaagaatggcatggtggccaagctgggggactttggcatcgcccgggtgctgaacaacagcatggagctggcccggacctgcatcggcaccccctactacctgagccctgagatctgccagaacaagccctacaacaacaagacagacatctggagcctgggctgtgtgctgtatgagctgtgcaccctgaagcacccctttgagggcaacaacctgcagcagctggtgctgaagatctgccaggcccactttgcccccatcagccctggcttcagccgggagctgcacagcctcatcagccagctgttccaggtgagcccccgggaccggcccagcatcaacagcatcctgaagaggcccttcctggagaacctgatccccaagtacctgaccccagaggtgatccaggaggagttcagccacatgctgatctgccgggccggggccccagccagcagacatgctgggaaggtggtgcagaagtgcaagatccagaaggtgcgcttccagggcaaatgtcctcccaggagccgcatctctgtgcccatcaagagaaatgccatcctgcacagaaatgagtggaggcctcctgctggggcccagaaggcccggagcatcaagatgattgaaagacccaagattgctgctgtgtgtggccactatgactactactatgcccagctggacatgctgcggcggcgggcccacaagcccagctaccaccccatcccccaggagaacacaggagtggaggactatggccaggagaccaggcatggccccagccccagccagtggccagctgagtacctgcagaggaagtttgaggcccagcagtacaagctgaaggtggagaagcagctgggcctgcggcccagcagcgctgagcccaactacaaccagaggcaggagctgcggagcaatggagaggagccccgcttccaggagctgcccttcaggaagaatgagatgaaggagcaggagtactggaagcagctggaggagatccggcagcagtaccacaatgacatgaaggagatcaggaagaagatgggccgggagcctgaggagaacagcaagatcagccacaagacctacctggtgaagaagagcaacctgcctgtgcaccaggatgccagcgagggggaggcccctgtgcagatggagttccgcagctgctgccccggctggagcgccatggcccgctcctggctgacagccaccagcgccagccaggacatcgagaaggacctgaagcagatgaggctgcagaacaccaaggagagcaagaaccctgagcagaagtacaaggccaagaagggcgtgaagtttgagatcaacctggacaagtgcatcagtgatgagaacatcctgcaggaggaggaggccatggacatccccaatgagaccctgacctttgaagatggcatgaagttcaaggagtatgaatgtgtgaaggagcacggggactacacagacaaggcctttgagaagctgcactgcccagaggccggcttcagcacccagacagtggccgctgtgggcaacagacggcagtgggatggaggagccccccagaccctgctgcagatgatggctgtggccgacatcaccagcacctgccccaccggccctgacagcgagagcgtgctgtctgtgtcccggcaggagggcaagaccaaggacccctacagccctgtgctgatcctgatgtag

SEQ ID NO: 40311 - DNA, 429 bp, Artificial Sequence
  Description of Artificial Sequence: Synthetic coding sequence
atgaacatcaacccctgcctggtgctgtgtgaatgttccctgagcatcagcctggatgctgaccccctggtgagcccctttgccaccggcccctgccctggggccccccgggaggtggtggccatgcagagtgatgtgggccagggcttccccatgcagagcaactggagggcccctgtgcacgcctgcaccagcggggctgtgaggaagggctggccaggctgcggcagaagaagacacaagatgggcggcggccctgtgtcctgggagcagaggcagaaggaggtggaggccgcccagggcagcgaggagcggggccctggcagcctggccgtgtccctgctgagcctggccgtgggcatccaccgcatcagccccatcctgggcttccacatctgctgcatgcaggtgctgatggtgctgaagtag

SEQ ID NO: 40312 - DNA, 744 bp, Artificial Sequence
  Description of Artificial Sequence: Synthetic coding sequence
atgctggtgctgcggagcggcctgaccaaggccctggccagcaggaccctggccccccaggtgtgcagcagctttgccaccggcccccggcagtatgatggcaccttctatgagttccgcacctactacctgaagcccagcaacatgaatgccttcatggagaacctgaagaagaacatccacctgcggaccagctacagcgagctggtgggcttctggagcgtggagtttggaggccgcaccaacaaggtgttccacatctggaagtatgacaactttgcccacagagctgaggtgaggaaggccctggccaactgcaaggagtggcaggagcagagcatcatccccaacctggccagaattgacaagcaggagacagagatcacctacctgatcccctggagcaagctggagaagccacccaaggagggcgtgtatgagctggccgtgttccagatgaagccaggcggccctgccctgtggggagatgcctttgagcgggccatcaatgcccacgtgaacctgggctacaccaaggtggtgggcgtcttccacacagaatatggagagctgaacagagtgcacgtgctgtggtggaatgaatctgctgacagcagagctgctggccgccacaagagccatgaggacccccgggtggtggccgctgtgcgggagagcgtgaactacctggtgtcccagcagaacatgctgctgatcccagccagcttcagccccctgaagtag

SEQ ID NO: 40313 - DNA, 1632 bp, Artificial Sequence
  Description of Artificial Sequence: Synthetic coding sequence
atgagggacaacaccagccccatcagcgtcatcctggtgagcagcggcagccggggcaacaagctgctcttccgctaccccttccagaggagccaggagcacccagccagccagaccagcaagcccaggagccgctatgctgccagcaacacaggagaccatgctgatgagcaggatggagacagccgcttcagtgatgtgatcctggccaccatcctggccaccaagtctgagatgtgtggccagaagtttgagctgaagattgacaacgtgcgctttgtgggccaccccaccctgctgcagcacgccctgggccaggccaatgctgaccccagcgtcatcaactgcctgcacaacctgagccgccgcatcgccaccgtgctgcagcacgaggagcggcgctgccagtacctgacccgggaggccaagctgatcctggccctgcaggatgaggtgtctgccatggctgatggaaatgaaggcccccagagccccttccaccacatcctgcccaagtgcaagctggcccgggacctgaaggaggcctatgacagcctgtgcaccagcggcgtggtgcggctgcacatcaacagctggctggaggtgtccttctgcctgccccacaagatccactatgctgccagcagcctcatccccccagaggccatcgagaggagcctgaaggccatccggccctaccacgccctgctgctgctgagtgatgagaagagcctgctgggggagctgcccatcgactgcagccctgccctggtgcgggtcatcaagaccaccagcgctgtgaagaacctgcagcagctggcccaggatgctgacctggccctgctgcaggtgttccagctggccgcccacctggtgtactggggcaaggccatcatcatctaccccctgtgtgaaaataatgtgtacatgctgagccccaatgcctctgtgtgcctgtacagccccctggccgagcagttcagccaccagttccccagccatgacctgcccagcgtgctggccaagttcagcctgcctgtgtccctgtctgagttcaggaaccccctggccccagctgtgcaggagacccagctgatccagatggtggtgtggatgctgcagaggcggctgctgatccagctgcacacctacgtgtgcctgatggccagccccagcgaggaggagccccggccccgggaggatgatgtgcccttcaccgcccgggtgggcggccgcagcctgagcaccccaaatgccctgagctttggcagccccaccagcagtgatgacatgaccctgaccagccccagcatggacaacagcagcgctgagctgctgcccagcggggacagccccctgaaccagaggatgacagagaacctgctggccagcagcgagcacgagcgggccgccatcctgtctgtgcctgctgcccagaaccctgaggacctgaggatgtttgcccggctgctgcactacttccggggccgccaccacctggaggagatcatgtacaatgaaaacacccggcgcagccagctgctgatgctgtttgacaagttccgctctgtgctggtggtgaccacccatgaagatcctgtgattgctgtgttccaggccctgctgccctag

SEQ ID NO: 40314 - DNA, 1170 bp, Artificial Sequence
  Description of Artificial Sequence: Synthetic coding sequence
atggctgatggaaatgaaggcccccagagccccttccaccacatcctgcccaagtgcaagctggcccgggacctgaaggaggcctatgacagcctgtgcaccagcggcgtggtgcggctgcacatcaacagctggctggaggtgtccttctgcctgccccacaagatccactatgctgccagcagcctcatccccccagaggccatcgagaggagcctgaaggccatccggccctaccacgccctgctgctgctgagtgatgagaagagcctgctgggggagctgcccatcgactgcagccctgccctggtgcgggtcatcaagaccaccagcgctgtgaagaacctgcagcagctggcccaggatgctgacctggccctgctgcaggtgttccagctggccgcccacctggtgtactggggcaaggccatcatcatctaccccctgtgtgaaaataatgtgtacatgctgagccccaatgcctctgtgtgcctgtacagccccctggccgagcagttcagccaccagttccccagccatgacctgcccagcgtgctggccaagttcagcctgcctgtgtccctgtctgagttcaggaaccccctggccccagctgtgcaggagacccagctgatccagatggtggtgtggatgctgcagaggcggctgctgatccagctgcacacctacgtgtgcctgatggccagccccagcgaggaggagccccggccccgggaggatgatgtgcccttcaccgcccgggtgggcggccgcagcctgagcaccccaaatgccctgagctttggcagccccaccagcagtgatgacatgaccctgaccagccccagcatggacaacagcagcgctgagctgctgcccagcggggacagccccctgaaccagaggatgacagagaacctgggccagctgtctgaacatgagcgggccgccatcctgtctgtgcctgctgcccagaaccctgaggacctgaggatgtttgcccggctgctgcactacttccggggccgccaccacctggaggagatcatgtacaatgaaaacacccggcgcagccagctgctgatgctgtttgacaagttccgctctgtgctggtggtgaccacccatgaagatcctgtgattgctgtgttccaggccctgctgccctag

SEQ ID NO: 40315 - DNA, 1707 bp, Artificial Sequence
  Description of Artificial Sequence: Synthetic coding sequence
atgagggacaacaccagccccatcagcgtcatcctggtgagcagcggcagccggggcaacaagctgctcttccgctaccccttccagaggagccaggagcacccagccagccagaccagcaagcccaggagccgctatgctgccagcaacacaggagaccatgctgatgagcaggatggagacagccgcttcagtgatgtgatcctggccaccatcctggccaccaagtctgagatgtgtggccagaagtttgagctgaagattgacaacgtgcgctttgtgggccaccccaccctgctgcagcacgccctgggccagatcagcaagacagaccccagccccaagcgggaggcccccaccatgatcctcttcaacgtggtgtttgccctgcgggccaatgctgaccccagcgtcatcaactgcctgcacaacctgagcagaagaattgccaccgtgctgcagcacgaggagcggcgctgccagtacctgacccgggaggccaagctgatcctggccctgcaggatgaggtgtctgccatggctgatggaaatgaaggcccccagagccccttccaccacatcctgcccaagtgcaagctggcccgggacctgaaggaggcctatgacagcctgtgcaccagcggcgtggtgcggctgcacatcaacagctggctggaggtgtccttctgcctgccccacaagatccactacgccgccagcagcctcatccccccagaggccatcgagaggagcctgaaggccatccggccctaccacgccctgctgctgctgagtgatgagaagagcctgctgggggagctgcccatcgactgcagccctgccctggtgcgggtcatcaagaccaccagcgctgtgaagaacctgcagcagctggcccaggatgctgacctggccctgctgcaggtgttccagctggccgcccacctggtgtactggggcaaggccatcatcatctaccccctgtgtgagaacaacgtgtacatgctgagccccaatgcctctgtgtgcctgtacagccccctggccgagcagttcagccaccagttccccagccatgacctgcccagcgtgctggccaagttcagcctgcctgtgtccctgtctgagttcaggaaccccctggccccagctgtgcaggagacccagctgatccagatggtggtgtggatgctgcagaggcggctgctgatccagctgcacacctacgtgtgcctgatggccagccccagcgaggaggagccccggcccagagaagatgatgtgcccttcaccgcccgggtgggcggccgcagcctgagcaccccaaatgccctgagctttggcagccccaccagcagtgatgacatgaccctgaccagccccagcatggacaacagcagcgctgagctgctgcccagcggggacagccccctgaaccagaggatgacagagaacctgctggccagcagcgagcacgagagagctgccatcctgtctgtgcctgctgcccagaaccctgaggacctgaggatgtttgcccggctgctgcactacttccggggccgccaccacctggaggagatcatgtacaatgaaaacaccaggaggagccagctgctgatgctgtttgacaagttccgctctgtgctggtggtgaccacccatgaggaccctgtgattgctgtgttccaggccctgctgccctag

SEQ ID NO: 40316 - DNA, 210 bp, Artificial Sequence
  Description of Artificial Sequence: Synthetic coding sequence
atgagggacaacaccagccccatcagcgtcatcctggtgagcagcggcagccggggcaacaagctgctcttccgctaccccttccagaggagccaggagcacccagccagccagaccagcaagcccaggagccgctatgctgccagcaacacaggagaccatgctgatgagcaggatggagacagccggcccacccagacccggcagtag

SEQ ID NO: 40317 - DNA, 999 bp, Artificial Sequence
  Description of Artificial Sequence: Synthetic coding sequence
atgctggcctggcaggacggcggggccaaggccgcccccagccaccacaagatctccttctctgtgctggacatcctggacccccagaagttcacccgggccgccctgcctgctgtgcggcctgccccccgggaggccaggaagagcctggccgaggtggaggccggcaaggatgccagcagccgggaccctgtgcggcagctggagaccccaggccagggctttgctgccagcctgctgacccggcaggcccacccccaccacagcagtgatgccagagatgctgctggccctggggccggccaggccagccccctggagggcagcgaggccgaggaggaggaggatgctgaggacccccggcggccccggctgcgggagagagctgcccggctgctgcccggcctggcccggagcccagatgccccagctggggccctggccagcggggagccctgtgaagatggcggcggcggccctgtgcgcagccccccaggcagccctggcagcccccggcccaggagaagaaggctggagcccaactgtgccaagccccggcgggccaggacagccttcacctatgagcagctggtggccctggagaacaagttccgggccacccgctacctgtctgtgtgtgagcggctgaacctggccctgagcctgagcctgacagagacccaggtgaagatctggttccagaacagaaggaccaagtggaagaagcagaaccctggagcagatggagctgcccaggtgggcggcggggccccccagcccggggctgctgggggcggcggcggcggcggcagcggcggcagccctggccccccaggcaccggggccctgcacttccagaccttccccagctacagcgctgccaacgtgctcttccccagcgctgccagcttccccctgacagctgctgcccctggcagcccctttgcccccttcctgggccccagctacctgacccccttctacgccccccggctgtag

SEQ ID NO: 40318 - DNA, 933 bp, Artificial Sequence
  Description of Artificial Sequence: Synthetic coding sequence
atgctggcctggcaggacggcggggccaaggccgcccccagccaccacaagatctccttctctgtgctggacatcctggacccccagaagttcacccgggccgccctgcctgctgtgcggcctgccccccgggaggccaggaagagcctggccgaggtggaggccggcaaggatgccagcagccgggaccctgtgcggcagctggagaccccagatgctgctggccctggggccggccaggccagccccctggagggcagcgaggccgaggaggaggaggatgctgaggacccccggcggccccggctgcgggagagagctgcccggctgctgcccggcctggcccggagcccagatgccccagctggggccctggccagcggggagccctgtgaagatggcggcggcggccctgtgcgcagccccccaggcagccctggcagcccccggcccaggagaagaaggctggagcccaactgtgccaagccccggcgggccaggacagccttcacctatgagcagctggtggccctggagaacaagttccgggccacccgctacctgtctgtgtgtgagcggctgaacctggccctgagcctgagcctgacagagacccaggtgaagatctggttccagaacagaaggaccaagtggaagaagcagaaccctggagcagatggagctgcccaggtgggcggcggggccccccagcccggggctgctgggggcggcggcggcggcggcagcggcggcagccctggccccccaggcaccggggccctgcacttccagaccttccccagctacagcgctgccaacgtgctcttccccagcgctgccagcttccccctgacagctgctgcccctggcagcccctttgcccccttcctgggccccagctacctgacccccttctacgccccccggctgtag

SEQ ID NO: 40319 - DNA, 114 bp, Artificial Sequence
  Description of Artificial Sequence: Synthetic coding sequence
gaggagtggatcacctacagcaacagctgctactacatcggcaaggagaggaggacctgggaggagcgggtgtgctggcctgtgctgcggaggaccctcatctgcttcctgtag

SEQ ID NO: 40320 - DNA, 3123 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagcggccccccctggatgtggatgagatgctggagcgcttcaagacagaggcccaggacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgagcggcgtggagcggctgaggaacccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgaaggagccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagtggagtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 40321 - DNA, 3189 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagcggccccccctggatgtggatgagatgctggagcgcttcaagacagaggcccaggccttcacagagaccaagggaaatgtcatctgcctgggcaaggaggtgttcaagggcaagaagccagacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgagcggcgtggagcggctgaggaacccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgaaggagccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagtggagtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 40322 - DNA, 3189 bp, Artificial Sequence; identical to SEQ ID NO: 40321
  Description of Artificial Sequence: Synthetic coding sequence

SEQ ID NO: 40323 - DNA, 3189 bp, Artificial Sequence; identical to SEQ ID NO: 40321
  Description of Artificial Sequence: Synthetic coding sequence

SEQ ID NO: 40324 - DNA, 3189 bp, Artificial Sequence; identical to SEQ ID NO: 40321
  Description of Artificial Sequence: Synthetic coding sequence

SEQ ID NO: 40325 - DNA, 3189 bp, Artificial Sequence; identical to SEQ ID NO: 40321
  Description of Artificial Sequence: Synthetic coding sequence

SEQ ID NO: 40326 - DNA, 3123 bp, Artificial Sequence; identical to SEQ ID NO: 40320
  Description of Artificial Sequence: Synthetic coding sequence

SEQ ID NO: 40327 - DNA, 3189 bp, Artificial Sequence; identical to SEQ ID NO: 40321
  Description of Artificial Sequence: Synthetic coding sequence

SEQ ID NO: 40328 - DNA, 3189 bp, Artificial Sequence; identical to SEQ ID NO: 40321
  Description of Artificial Sequence: Synthetic coding sequence

SEQ ID NO: 40329 - DNA, 3189 bp, Artificial Sequence; identical to SEQ ID NO: 40321
  Description of Artificial Sequence: Synthetic coding sequence

SEQ ID NO: 40330 - DNA, 3189 bp, Artificial Sequence; identical to SEQ ID NO: 40321
  Description of Artificial Sequence: Synthetic coding sequence

SEQ ID NO: 40331 - DNA, 3123 bp, Artificial Sequence; identical to SEQ ID NO: 40320
  Description of Artificial Sequence: Synthetic coding sequence

SEQ ID NO: 40332 - DNA, 3123 bp, Artificial Sequence; identical to SEQ ID NO: 40320
  Description of Artificial Sequence: Synthetic coding sequence

SEQ ID NO: 40333 - DNA, 3189 bp, Artificial Sequence; identical to SEQ ID NO: 40321
  Description of Artificial Sequence: Synthetic coding sequence

SEQ ID NO: 40334 - DNA, 3123 bp, Artificial Sequence; identical to SEQ ID NO: 40320
  Description of Artificial Sequence: Synthetic coding sequence

SEQ ID NO: 40335 - DNA, 3189 bp, Artificial Sequence; identical to SEQ ID NO: 40321
  Description of Artificial Sequence: Synthetic coding sequence

SEQ ID NO: 40336 - DNA, 3189 bp, Artificial Sequence; identical to SEQ ID NO: 40321
  Description of Artificial Sequence: Synthetic coding sequence

SEQ ID NO: 40337 - DNA, 3189 bp, Artificial Sequence; identical to SEQ ID NO: 40321
  Description of Artificial Sequence: Synthetic coding sequence

SEQ ID NO: 40338 - DNA, 3123 bp, Artificial Sequence; identical to SEQ ID NO: 40320
  Description of Artificial Sequence: Synthetic coding sequence

SEQ ID NO: 40339 - DNA, 3123 bp, Artificial Sequence; identical to SEQ ID NO: 40320
  Description of Artificial Sequence: Synthetic coding sequence

SEQ ID NO: 40340 - DNA, 3189 bp, Artificial Sequence; identical to SEQ ID NO: 40321
  Description of Artificial Sequence: Synthetic coding sequence

SEQ ID NO: 40341 - DNA, 2943 bp, Artificial Sequence
  Description of Artificial Sequence: Synthetic coding sequence
atgaccagcccccagctggagtggaccctgcagaccctgctggagcagctgaatgaagatgagctgaagagcttcaagagcctgctgtgggccttccccctggaggatgtgctgcagaagaccccctggagcgaggtggaggaggctgatggcaagaagctggccgagatcctggtgaacaccagcagcgagaactggatcagaaatgccaccgtgaacatcctggaggagatgaacctgacagagctgtgcaagatggccaaggccgagatgatggaggatggccaggtgcaggagattgacaaccctgagctgggagatgctgaggaggacagcgagctggccaagccaggagagaaggagggctggaggaacagcatggagaagcagagcctggtgtggaagaacaccttctggcagggcgacatcgacaacttccatgatgatgtgaccctgaggaaccagcgcttcatccccttcctgaaccccaggacccccaggaagctgaccccctacacagtggtgctgcacggccctgctggggtgggcaagaccaccctggccaagaagtgcatgctggactggacagactgcaacctgagccccaccctgcgctatgccttctacctgagctgcaaggagctgagcaggatgggcccctgcagctttgctgagctgatcagcaaggactggccagagctgcaggatgacatccccagcatcctggcccaggcccagaggatcctgtttgtggtggatggcctggatgagctgaaggtgcccccaggggccctgatccaggacatctgtggggactgggagaagaagaagcctgtgcctgtgctgctgggcagcctgctgaagaggaagatgctgcccagggctgccctgctggtgaccacccggccccgggccctgcgggacctgcagctgctggcccagcagcccatctacgtgcgggtggagggcttcctggaggaggacagaagagcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggagaagatcctgtgcccacctgcctgaccaggacaggcctcttcctgcgcttcctgtgcagccgcttcccccagggcgcccagctgcggggggccctgcggaccctgagcctgctggccgcccagggcctgtgggcccagatgtctgtgttccaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacgccctggagaaggaggagggggaggacagagatggccacgcctgggacattggagatgtgcagaagctgctgtctggagaggagcggctgaagaacccagacctgatccaggtgggccacttcctgtttggcctggccaatgagaagagggccaaggagctggaggccaccttcggctgcaggatgagcccagacatcaagcaggagctgctgcagtgcaaggcccacctgcacgccaacaagcccctgtctgtgacagacctgaaggaggtgctgggctgcctgtatgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtcttcctggagaactacatggactttgagctggacatcgagtttgagcgctgcacctacctgaccatccccaactgggcccggcaggacctgcggagcctgcggctgtggacagacttctgcagcctcttcagcagcaacagcaacctgaagttcctggaggtgaagcagagcttcctgagtgacagctctgtgcgcatcctgtgtgaccacgtgaccaggagcacctgccacctgcagaaggtggagatcaagaatgtgaccccagacacagcctacagagacttctgcctggccttcatcggcaagaagaccctgacccacctgaccctggccggccacatcgagtgggagaggaccatgatgctgatgctgtgtgacctgctgaggaaccacaagtgcaacctgcagtacctgcggctgggcggccactgtgccaccccagagcagtgggccgagttcttctacgtgctgaaggccaaccagagcctgaagcacctgcggctgagcgccaacgtgctgctggatgaaggagccatgctgctgtacaagaccatgacccggcccaagcacttcctgcagatgctgagcctggagaactgccgcctgacagaggccagctgcaaggacctggccgctgtgctggtggtgtccaagaagctgacccacctgtgcctggccaagaaccccatcggggacacaggagtgaagttcctgtgtgagggcctgagctacccagactgcaagctgcagaccctggtgctgcagcagtgcagcatcaccaagctgggctgccgctacctgtctgaggccctgcaggaggcctgcagcctgaccaacctggacctgagcatcaaccagatcgcccggggcctgtggatcctgtgccaggccctggagaaccccaactgcaacctgaagcacctgcggctgaagacctatgagaccaacctggagatcaagaagctgctggaggaggtgaaggagaagaaccccaagctgaccatcgactgcaatgccagcggggccacagccccaccctgctgtgacttcttctgctag

SEQ ID NO: 40342 - DNA, 3030 bp, Artificial Sequence
  Description of Artificial Sequence: Synthetic coding sequence
atgaccagcccccagctggagtggaccctgcagaccctgctggagcagctgaatgaagatgagctgaagagcttcaagagcctgctgtgggccttccccctggaggatgtgctgcagaagaccccctggagcgaggtggaggaggctgatggcaagaagctggccgagatcctggtgaacaccagcagcgagaactggatcagaaatgccaccgtgaacatcctggaggagatgaacctgacagagctgtgcaagatggccaaggccgagatgatggaggatggccaggtgcaggagattgacaaccctgagctgggagatgctgaggaggacagcgagctggccaagccaggagagaaggagggctggaggaacagcatggagaagcagagcctggtgtggaagaacaccttctggcagggcgacatcgacaacttccatgatgatgtgaccctgaggaaccagcgcttcatccccttcctgaaccccaggacccccaggaagctgaccccctacacagtggtgctgcacggccctgctggggtgggcaagaccaccctggccaagaagtgcatgctggactggacagactgcaacctgagccccaccctgcgctatgccttctacctgagctgcaaggagctgagcaggatgggcccctgcagctttgctgagctgatcagcaaggactggccagagctgcaggatgacatccccagcatcctggcccaggcccagaggatcctgtttgtggtggatggcctggatgagctgaaggtgcccccaggggccctgatccaggacatctgtggggactgggagaagaagaagcctgtgcctgtgctgctgggcagcctgctgaagaggaagatgctgcccagggctgccctgctggtgaccacccggccccgggccctgcgggacctgcagctgctggcccagcagcccatctacgtgcgggtggagggcttcctggaggaggacagaagagcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggagaagatcctgtgcccacctgcctgaccaggacaggcctcttcctgcgcttcctgtgcagccgcttcccccagggcgcccagctgcggggggccctgcggaccctgagcctgctggccgcccagggcctgtgggcccagatgtctgtgttccaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacgccctggagaaggaggagggggaggacagagatggccacgcctgggacattggagatgtgcagaagctgctgtctggagaggagcggctgaagaacccagacctgatccaggtgggccacttcctgtttggcctggccaatgagaagagggccaaggagctggaggccaccttcggctgcaggatgagcccagacatcaagcaggagctgctgcagtgcaaggcccacctgcacgccaacaagcccctgtctgtgacagacctgaaggaggtgctgggctgcctgtatgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtcttcctggagaactacatggactttgagctggacatcgagtttgagagcagcaacagcaacctgaagttcctggaggtgaagcagagcttcctgagtgacagctctgtgcgcatcctgtgtgaccacgtgaccaggagcacctgccacctgcagaaggtggagatcaagaatgtgaccccagacacagcctacagagacttctgcctggccttcatcggcaagaagaccctgacccacctgaccctggccggccacatcgagtgggagaggaccatgatgctgatgctgtgtgacctgctgaggaaccacaagtgcaacctgcagtacctgcggctgggcggccactgtgccaccccagagcagtgggccgagttcttctacgtgctgaaggccaaccagagcctgaagcacctgcggctgagcgccaacgtgctgctggatgaaggagccatgctgctgtacaagaccatgacccggcccaagcacttcctgcagatgctgagcctggagaactgccgcctgacagaggccagctgcaaggacctggccgctgtgctggtggtgtccaagaagctgacccacctgtgcctggccaagaaccccatcggggacacaggagtgaagttcctgtgtgagggcctgagctacccagactgcaagctgcagaccctggtgctgcagcagtgcagcatcaccaagctgggctgccgctacctgtctgaggccctgcaggaggcctgcagcctgaccaacctggacctgagcatcaaccagatcgcccggggcctgtggatcctgtgccaggccctggagaaccccaactgcaacctgaagcacctgcggctgtggagctgcagcctgatgcccttctactgccagcacctgggcagcgccctgctgagcaaccagaagctggagaccctggacctgggccagaaccacctgtggaagagcggcatcatcaagctgtttggagtgctgcggcagaggacaggcagcctgaagatcctgcggctgaagacctatgagaccaacctggagatcaagaagctgctggaggaggtgaaggagaagaaccccaagctgaccatcgactgcaatgccagcggggccacagccccaccctgctgtgacttcttctgctag

SEQ ID NO: 40343 - DNA, 3198 bp, Artificial Sequence
  Description of Artificial Sequence: Synthetic coding sequence
atgagcaggaagcaccggctggaggcccggccagacctgcgggagttcttcagcctgaacctgcggagccacaccaggagcaccatgaccagcccccagctggagtggaccctgcagaccctgctggagcagctgaatgaagatgagctgaagagcttcaagagcctgctgtgggccttccccctggaggatgtgctgcagaagaccccctggagcgaggtggaggaggctgatggcaagaagctggccgagatcctggtgaacaccagcagcgagaactggatcagaaatgccaccgtgaacatcctggaggagatgaacctgacagagctgtgcaagatggccaaggccgagatgatggaggatggccaggtgcaggagattgacaaccctgagctgggagatgctgaggaggacagcgagctggccaagccaggagagaaggagggctggaggaacagcatggagaagcagagcctggtgtggaagaacaccttctggcagggcgacatcgacaacttccatgatgatgtgaccctgaggaaccagcgcttcatccccttcctgaaccccaggacccccaggaagctgaccccctacacagtggtgctgcacggccctgctggggtgggcaagaccaccctggccaagaagtgcatgctggactggacagactgcaacctgagccccaccctgcgctatgccttctacctgagctgcaaggagctgagcaggatgggcccctgcagctttgctgagctgatcagcaaggactggccagagctgcaggatgacatccccagcatcctggcccaggcccagaggatcctgtttgtggtggatggcctggatgagctgaaggtgcccccaggggccctgatccaggacatctgtggggactgggagaagaagaagcctgtgcctgtgctgctgggcagcctgctgaagaggaagatgctgcccagggctgccctgctggtgaccacccggccccgggccctgcgggacctgcagctgctggcccagcagcccatctacgtgcgggtggagggcttcctggaggaggacagaagagcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggagaagatcctgtgcccacctgcctgaccaggacaggcctcttcctgcgcttcctgtgcagccgcttcccccagggcgcccagctgcggggggccctgcggaccctgagcctgctggccgcccagggcctgtgggcccagatgtctgtgttccaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacgccctggagaaggaggagggggaggacagagatggccacgcctgggacattggagatgtgcagaagctgctgtctggagaggagcggctgaagaacccagacctgatccaggtgggccacttcctgtttggcctggccaatgagaagagggccaaggagctggaggccaccttcggctgcaggatgagcccagacatcaagcaggagctgctgcagtgcaaggcccacctgcacgccaacaagcccctgtctgtgacagacctgaaggaggtgctgggctgcctgtatgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtcttcctggagaactacatggactttgagctggacatcgagtttgagcgctgcacctacctgaccatccccaactgggcccggcaggacctgcggagcctgcggctgtggacagacttctgcagcctcttcagcagcaacagcaacctgaagttcctggaggtgaagcagagcttcctgagtgacagctctgtgcgcatcctgtgtgaccacgtgaccaggagcacctgccacctgcagaaggtggagatcaagaatgtgaccccagacacagcctacagagacttctgcctggccttcatcggcaagaagaccctgacccacctgaccctggccggccacatcgagtgggagaggaccatgatgctgatgctgtgtgacctgctgaggaaccacaagtgcaacctgcagtacctgcggctgggcggccactgtgccaccccagagcagtgggccgagttcttctacgtgctgaaggccaaccagagcctgaagcacctgcggctgagcgccaacgtgctgctggatgaaggagccatgctgctgtacaagaccatgacccggcccaagcacttcctgcagatgctgagcctggagaactgccgcctgacagaggccagctgcaaggacctggccgctgtgctggtggtgtccaagaagctgacccacctgtgcctggccaagaaccccatcggggacacaggagtgaagttcctgtgtgagggcctgagctacccagactgcaagctgcagaccctggtgctgcagcagtgcagcatcaccaagctgggctgccgctacctgtctgaggccctgcaggaggcctgcagcctgaccaacctggacctgagcatcaaccagatcgcccggggcctgtggatcctgtgccaggccctggagaaccccaactgcaacctgaagcacctgcggctgtggagctgcagcctgatgcccttctactgccagcacctgggcagcgccctgctgagcaaccagaagctggagaccctggacctgggccagaaccacctgtggaagagcggcatcatcaagctgtttggagtgctgcggcagaggacaggcagcctgaagatcctgcggctgaagacctatgagaccaacctggagatcaagaagctgctggaggaggtgaaggagaagaaccccaagctgaccatcgactgcaatgccagcggggccacagccccaccctgctgtgacttcttctgctag

SEQ ID NO: 40344 - DNA, 3030 bp, Artificial Sequence; identical to SEQ ID NO: 40342
  Description of Artificial Sequence: Synthetic coding sequence

SEQ ID NO: 40345 - DNA, 3198 bp, Artificial Sequence; identical to SEQ ID NO: 40343
  Description of Artificial Sequence: Synthetic coding sequence

SEQ ID NO: 40346 - DNA, 3030 bp, Artificial Sequence; identical to SEQ ID NO: 40342
  Description of Artificial Sequence: Synthetic coding sequence

SEQ ID NO: 40347 - DNA, 3198 bp, Artificial Sequence; identical to SEQ ID NO: 40343
  Description of Artificial Sequence: Synthetic coding sequence

SEQ ID NO: 40348 - DNA, 2943 bp, Artificial Sequence; identical to SEQ ID NO: 40341
  Description of Artificial Sequence: Synthetic coding sequence

SEQ ID NO: 40349 - DNA, 3030 bp, Artificial Sequence; identical to SEQ ID NO: 40342
  Description of Artificial Sequence: Synthetic coding sequence

SEQ ID NO: 40350 - DNA, 2943 bp, Artificial Sequence; identical to SEQ ID NO: 40341
  Description of Artificial Sequence: Synthetic coding sequence

SEQ ID NO: 40351 - DNA, 2943 bp, Artificial Sequence; identical to SEQ ID NO: 40341
  Description of Artificial Sequence: Synthetic coding sequence

SEQ ID NO: 40352 - DNA, 2943 bp, Artificial Sequence; identical to SEQ ID NO: 40341
  Description of Artificial Sequence: Synthetic coding sequence

SEQ ID NO: 40353 - DNA, 3198 bp, Artificial Sequence; identical to SEQ ID NO: 40343
  Description of Artificial Sequence: Synthetic coding sequence

SEQ ID NO: 40354 - DNA, 3198 bp, Artificial Sequence; identical to SEQ ID NO: 40343
  Description of Artificial Sequence: Synthetic coding sequence

SEQ ID NO: 40355 - DNA, 2943 bp, Artificial Sequence; identical to SEQ ID NO: 40341
  Description of Artificial Sequence: Synthetic coding sequence

SEQ ID NO: 40356 - DNA, 3030 bp, Artificial Sequence; identical to SEQ ID NO: 40342
  Description of Artificial Sequence: Synthetic coding sequence

SEQ ID NO: 40357 - DNA, 3030 bp, Artificial Sequence; identical to SEQ ID NO: 40342
  Description of Artificial Sequence: Synthetic coding sequence

SEQ ID NO: 40358 - DNA, 3198 bp, Artificial Sequence; identical to SEQ ID NO: 40343
  Description of Artificial Sequence: Synthetic coding sequence

SEQ ID NO: 40359 - DNA, 3114 bp, Artificial Sequence
  Description of Artificial Sequence: Synthetic coding sequence
atgaccagcccccagctggagtggaccctgcagaccctgctggagcagctgaatgaagatgagctgaagagcttcaagagcctgctgtgggccttccccctggaggatgtgctgcagaagaccccctggagcgaggtggaggaggctgatggcaagaagctggccgagatcctggtgaacaccagcagcgagaactggatcagaaatgccaccgtgaacatcctggaggagatgaacctgacagagctgtgcaagatggccaaggccgagatgatggaggatggccaggtgcaggagattgacaaccctgagctgggagatgctgaggaggacagcgagctggccaagccaggagagaaggagggctggaggaacagcatggagaagcagagcctggtgtggaagaacaccttctggcagggcgacatcgacaacttccatgatgatgtgaccctgaggaaccagcgcttcatccccttcctgaaccccaggacccccaggaagctgaccccctacacagtggtgctgcacggccctgctggggtgggcaagaccaccctggccaagaagtgcatgctggactggacagactgcaacctgagccccaccctgcgctatgccttctacctgagctgcaaggagctgagcaggatgggcccctgcagctttgctgagctgatcagcaaggactggccagagctgcaggatgacatccccagcatcctggcccaggcccagaggatcctgtttgtggtggatggcctggatgagctgaaggtgcccccaggggccctgatccaggacatctgtggggactgggagaagaagaagcctgtgcctgtgctgctgggcagcctgctgaagaggaagatgctgcccagggctgccctgctggtgaccacccggccccgggccctgcgggacctgcagctgctggcccagcagcccatctacgtgcgggtggagggcttcctggaggaggacagaagagcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggagaagatcctgtgcccacctgcctgaccaggacaggcctcttcctgcgcttcctgtgcagccgcttcccccagggcgcccagctgcggggggccctgcggaccctgagcctgctggccgcccagggcctgtgggcccagatgtctgtgttccaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacgccctggagaaggaggagggggaggacagagatggccacgcctgggacattggagatgtgcagaagctgctgtctggagaggagcggctgaagaacccagacctgatccaggtgggccacttcctgtttggcctggccaatgagaagagggccaaggagctggaggccaccttcggctgcaggatgagcccagacatcaagcaggagctgctgcagtgcaaggcccacctgcacgccaacaagcccctgtctgtgacagacctgaaggaggtgctgggctgcctgtatgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtcttcctggagaactacatggactttgagctggacatcgagtttgagcgctgcacctacctgaccatccccaactgggcccggcaggacctgcggagcctgcggctgtggacagacttctgcagcctcttcagcagcaacagcaacctgaagttcctggaggtgaagcagagcttcctgagtgacagctctgtgcgcatcctgtgtgaccacgtgaccaggagcacctgccacctgcagaaggtggagatcaagaatgtgaccccagacacagcctacagagacttctgcctggccttcatcggcaagaagaccctgacccacctgaccctggccggccacatcgagtgggagaggaccatgatgctgatgctgtgtgacctgctgaggaaccacaagtgcaacctgcagtacctgcggctgggcggccactgtgccaccccagagcagtgggccgagttcttctacgtgctgaaggccaaccagagcctgaagcacctgcggctgagcgccaacgtgctgctggatgaaggagccatgctgctgtacaagaccatgacccggcccaagcacttcctgcagatgctgagcctggagaactgccgcctgacagaggccagctgcaaggacctggccgctgtgctggtggtgtccaagaagctgacccacctgtgcctggccaagaaccccatcggggacacaggagtgaagttcctgtgtgagggcctgagctacccagactgcaagctgcagaccctggtgctgcagcagtgcagcatcaccaagctgggctgccgctacctgtctgaggccctgcaggaggcctgcagcctgaccaacctggacctgagcatcaaccagatcgcccggggcctgtggatcctgtgccaggccctggagaaccccaactgcaacctgaagcacctgcggctgtggagctgcagcctgatgcccttctactgccagcacctgggcagcgccctgctgagcaaccagaagctggagaccctggacctgggccagaaccacctgtggaagagcggcatcatcaagctgtttggagtgctgcggcagaggacaggcagcctgaagatcctgcggctgaagacctatgagaccaacctggagatcaagaagctgctggaggaggtgaaggagaagaaccccaagctgaccatcgactgcaatgccagcggggccacagccccaccctgctgtgacttcttctgctag

SEQ ID NO: 40360 - DNA, 3114 bp, Artificial Sequence; identical to SEQ ID NO: 40359
  Description of Artificial Sequence: Synthetic coding sequence

SEQ ID NO: 40361 - DNA, 3114 bp, Artificial Sequence; identical to SEQ ID NO: 40359
  Description of Artificial Sequence: Synthetic coding sequence

SEQ ID NO: 40362 - DNA, 3114 bp, Artificial Sequence; identical to SEQ ID NO: 40359
  Description of Artificial Sequence: Synthetic coding sequence

SEQ ID NO: 40363 - DNA, 3114 bp, Artificial Sequence; identical to SEQ ID NO: 40359
  Description of Artificial Sequence: Synthetic coding sequence

SEQ ID NO: 40364 - DNA, 3114 bp, Artificial Sequence; identical to SEQ ID NO: 40359
  Description of Artificial Sequence: Synthetic coding sequence

SEQ ID NO: 40365 - DNA, 3114 bp, Artificial Sequence; identical to SEQ ID NO: 40359
  Description of Artificial Sequence: Synthetic coding sequence

SEQ ID NO: 40366 - DNA, 1080 bp, Artificial Sequence
  Description of Artificial Sequence: Synthetic coding sequence
atgaacttcatcaaggacaacagccgggccctgatccagaggatgggcatgaccgtcatcaagcagatcacagatgacctgtttgtgtggaatgtgctgaaccgggaggaggtgaacatcatctgctgtgagaaggtggagcaggatgctgcccggggcatcatccacatgatcctgaagaagggcagcgagagctgcaacctcttcctgaagagcctgaaggagtggaactaccccctcttccaggacctgaatggccagagcggcctgacagacagcctgggcaacctgaagaacctgaccaagctgatcatggacaacatcaagatgaatgaagaagatgccatcaagctggccgagggcctgaagaacctgaagaagatgtgcctcttccacctgacccacctgagtgacattggagagggcatggactacatcgtgaagagcctgagcagcgagccctgtgacctggaggagatccagctggtgtcctgctgcctgagcgccaatgctgtgaagatcctggcccagaacctgcacaacctggtgaagctgagcatcctggacctgtctgagaactacctggagaaggatggaaatgaggccctgcacgagctgattgacaggatgaatgtgctggagcagctgacagccctgatgctgccctggggctgtgatgtgcagggcagcctgagcagcctgctgaagcacctggaggaggtgccccagctggtgaagctgggcctgaagaactggaggctgacagacacagagatccgcatcctgggcgccttcttcggcaagaaccccctgaagaacttccagcagctgaacctggccggcaacagagtgtccagtgatggctggctggccttcatgggcgtgtttgagaacctgaagcagctggtgttctttgacttcagcaccaaggagttcctgcctgaccctgccctggtgaggaagctgagccaggtgctgagcaagctgaccttcctgcaggaggcccggctggtgggctggcagtttgatgatgatgacctgagcgtcatcactggagccttcaagctggtgacagcctag

SEQ ID NO: 40367 - DNA, 5514 bp, Artificial Sequence
  Description of Artificial Sequence: Synthetic coding sequence
atggaccctgtgggcctgcagctgggcaacaagaacctgtggagctgcctggtgcggctgctgaccaaggaccctgagtggctgaatgccaagatgaagttcttcctgcccaacacagacctggacagcagaaatgagaccctggaccctgagcagagggtcatcctgcagctgaacaagctgcacgtgcagggcagtgacacctggcagagcttcatccactgtgtgtgcatgcagctggaggtgcccctggacctggaggtgctgctgctgagcaccttcggctatgatgatggcttcaccagccagctgggcgctgagggcaagagccagcctgagagccagctgcaccacggcctgaagaggccccaccagagctgtggcagcagccccaggaggaagcagtgcaagaagcagcagctggagctggccaagaagtacctgcagctgctgcggaccagcgcccagcagcgctaccgcagccagatccctggcagcggccagccccacgccttccaccaggtgtatgtgccccccatcctgcggcgggccacagccagcctggacaccccagagggcgccatcatgggagatgtgaaggtggaggatggagcagatgtgtccatcagtgacctcttcaacaccagggtgaacaagggcccccgggtgacagtgctgctgggcaaggccggcatgggcaagaccaccctggcccaccggctgtgccagaagtgggccgagggccacctgaactgcttccaggccctcttcctgtttgagttccggcagctgaacctgatcacccgcttcctgacccccagcgagctgctgtttgacctgtacctgagccctgagagtgaccatgacaccgtcttccagtacctggagaagaatgctgaccaggtgctgctgatctttgatggcctggatgaggccctgcagcccatgggcccagatggccctggccctgtgctgaccctcttcagccacctgtgcaatggcaccctgctgcccggctgccgggtgatggccaccagcaggcctgggaagctgcctgcctgcctgcctgctgaggccgccatggtgcacatgctgggctttgatggcccccgggtggaggagtatgtgaaccacttcttcagcgcccagcccagccgggagggcgccctggtggagctgcagaccaacggccgcctgcggagcctgtgtgctgtgcctgccctgtgccaggtggcctgcctgtgcctgcaccacctgctgcctgaccacgcccctggccagagcgtggccctgctgcccaacatgacccagctgtacatgcagatggtgctggccctgagccccccaggccacctgcccaccagcagcctgctggacctgggggaggtggccctgcggggcctggagaccgggaaggtgatcttctacgccaaggacatcgccccacccctgattgcctttggagccacccacagcctgctgaccagcttctgtgtgtgcaccggccctggccaccagcagacaggctacgccttcacccacctgagcctgcaggagttcctggccgccctgcacctgatggccagccccaaggtgaacaaggacaccctgacccagtatgtgaccctgcacagccgctgggtgcagaggaccaaggcccggctgggcctgagtgaccacctgcccaccttcctggccggcctggccagctgcacctgccggcccttcctgagccacctggcccagggcaatgaagactgtgtgggcgccaagcaggccgctgtggtgcaggtgctgaagaagctggccaccaggaagctgaccggccccaaggtggtggagctgtgccactgtgtggatgagacccaggagcctgagctggccagcctgacagcccagagcctgccctaccagctgcccttccacaacttccccctgacctgcacagacctggccaccctgaccaacatcctggagcaccgggaggcccccatccacctggactttgatggctgccccctggagccccactgcccagaggccctggtgggctgcggccagatcgagaacctgtccttcaagagcaggaaatgtggagatgcctttgctgaggccctgagccgcagcctgcccaccatgggccgcctgcagatgctgggcctggccggcagcaagatcacagcccggggcatcagccacctggtgaaggccctgcccctgtgcccccagctgaaggaggtgtccttccgggacaaccagctgagtgaccaggtggtgctgaacatcgtggaggtgctgccccacctgccccggctgaggaagctggacctgagcagcaacagcatctgtgtgtccaccctgctgtgcctggcccgggtggccgtgacctgccccaccgtgaggatgctgcaggcccgggaggccgacctgatcttcctgctgagccccccaacagagaccacagctgagctgcagagggccccagacctgcaggagagtgatggccagaggaagggggcccagagccgcagcctgaccctgcggctgcagaagtgccagctgcaggtgcatgatgctgaggccctgattgccctgctgcaggagggcccccacctggaggaggtggacctgagcggcaaccagctggaggatgagggctgccgcctgatggccgaggccgccagccagctgcacatcgccaggaagctggacctgagcaacaacggcctgtctgtggccggcgtgcactgtgtgctgcgggctgtgtctgcctgctggaccctggccgagctgcacatcagcctgcagcacaagacagtcatcttcatgtttgcccaggagcctgaggagcagaagggcccccaggagcgggccgccttcctggacagcctgatgctgcagatgcccagcgagctgcccctgagcagcaggaggatgaggctgacccactgcggcctgcaggagaagcacctggagcagctgtgcaaggccctgggcggcagctgccacctgggccacctgcacctggacttctctggaaatgccctgggagatgagggcgccgcccggctggcccagctgctgcccggcctgggcgccctgcagagcctgaacctgtctgaaaatggcctgagcctggatgctgtgctgggcctggtgcgctgcttcagcaccctgcagtggctgttccggctggacatcagctttgagagccagcacatcctgctgcggggggacaagaccagccgggacatgtgggccaccggcagcctgcctgacttccctgctgctgccaagttcctgggcttccggcagcgctgcatccccaggagcctgtgcctgtctgagtgccccctggagccccccagcctgacccggctgtgtgccaccctgaaggactgccccggccccctggagctgcagctgagctgtgagttcctgagtgaccagagcctggagaccctgctggactgcctgccccagctgccccagctgagcctgctgcagctgagccagacaggcctgagccccaagagccccttcctgctggccaacaccctgagcctgtgcccccgggtgaagaaggtggacctgcggagcctgcaccacgccaccctgcacttccgcagcaatgaggaggaggagggcgtgtgctgcggcctgagcgccaacctgctgggggacagcggcctgcgctgcctgctggagtgcctgccccaggtgcccatcagcggcctgctggacctgagccacaacagcatcagccaggagagcgccctgtacctgctggagaccctgcccagctgcccccgggtgcgggaggcctctgtgaacctgggcagcgagcagagcttccgcatccacttcagccgggaggaccaggccggcaagaccctgcggctgtctgaatgttccttccggcctgagcacgtgtcccggctggccaccggcctgagcaagagcctgcagctgacagagctgaccctgacccagtgctgcctgggccagaagcagctggccatcctgctgagcctggtgggccggcctgctggcctcttcagcctgcgggtgcaggagccctgggccgaccgggcccgggtgctgagcctgctggaggtgtgtgcccaggccagcggctctgtgacagagatcagcatcagcgagacccagcagcagctgtgtgtgcagctggagttcccccggcaggaggagaaccctgaggccgtggccctgcggctggcccactgtgacctgggcgcccaccacagcctgctggtgggccagctgatggagacctgtgcccggctgcagcagctgagcctgagccaggtgaacctgtgtgaagatgatgatgccagcagcctgctgctgcagagcctgctgctgagcctgtctgagctgaagaccttccggctgaccagcagctgtgtgtccacagagggcctggcccacctggccagcggcctgggccactgccaccacctggaggagctggacctgagcaacaaccagtttgatgaggagggcaccaaggccctgatgagggccctggagggcaagtggatgctgaagaggctggacctgagccacctgctgctgaacagcagcaccctggccctgctgacccaccggctgagccagatgacctgcctgcagagcctgcggctgaacagaaacagcattggagatgtgggctgctgccacctgtctgaggccctgcgggccgccaccagcctggaggagctggacctgagccacaaccagattggagatgctggggtgcagcacctggccaccatcctgcccggcctgcctgagctgaggaagattgacctgagcggcaacagcatcagcagcgctgggggcgtgcagctggccgagagcctggtgctgtgccggcggctggaggagctgatgctgggctgcaatgccctgggggaccccacagccctgggcctggcccaggagctgccccagcacctgcgggtgctgcacctgcccttcagccacctgggccctggaggagccctgagcctggcccaggccctggatggcagcccccacctggaggagatcagcctggccgagaacaacctggccggcggcgtgctgcgcttctgcatggagctgcccctgctgcggcagattgacctggtgtcctgcaagattgacaaccagacagccaagctgctgaccagcagcttcaccagctgcccagccctggaggtgatcctgctgtcctggaacctgctgggagatgaagctgctgctgagctggcccaggtgctgccccagatgggccgcctgaagagggtggacctggagaagaaccagatcacagccctgggcgcctggctgctggccgagggcctggcccagggcagcagcatccaggtgatccggctgtggaacaaccccatcccctgtgacatggcccagcacctgaagagccaggagccccggctggactttgccttctttgacaaccagccccaggccccctggggcacctag

SEQ ID NO: 40368 - DNA, 2553 bp, Artificial Sequence
  Description of Artificial Sequence: Synthetic coding sequence
atggccagccccaaggtgaacaaggacaccctgacccagtatgtgaccctgcacagccgctgggtgcagaggaccaaggcccggctgggcctgagtgaccacctgcccaccttcctggccggcctggccagctgcacctgccggcccttcctgagccacctggcccagggcaatgaagactgtgtgggcgccaagcaggccgctgtggtgcaggtgctgaagaagctggccaccaggaagctgaccggccccaaggtggtggagctgtgccactgtgtggatgagacccaggagcctgagctggccagcctgacagcccagagcctgccctaccagctgcccttccacaacttccccctgacctgcacagacctggccaccctgaccaacatcctggagcaccgggaggcccccatccacctggactttgatggctgccccctggagccccactgcccagaggccctggtgggctgcggccagatcgagaacctgtccttcaagagcaggaaatgtggagatgcctttgctgaggccctgagccgcagcctgcccaccatgggccgcctgcagatgctgggcctggccggcagcaagatcacagcccggggcatcagccacctggtgaaggccctgcccctgtgcccccagctgaaggaggtgtccttccgggacaaccagctgagtgaccaggtggtgctgaacatcgtggaggtgctgccccacctgccccggctgaggaagctggacctgagcagcaacagcatctgtgtgtccaccctgctgtgcctggcccgggtggccgtgacctgccccaccgtgaggatgctgcaggcccgggaggccgacctgatcttcctgctgagccccccaacagagaccacagctgagctgcagagggccccagacctgcaggagagtgatggccagaggaagggggcccagagccgcagcctgaccctgcggctgcagaagtgccagctgcaggtgcatgatgctgaggccctgattgccctgctgcaggagggcccccacctggaggaggtggacctgagcggcaaccagctggaggatgagggctgccgcctgatggccgaggccgccagccagctgcacatcgccaggaagctggacctgagcaacaacggcctgtctgtggccggcgtgcactgtgtgctgcgggctgtgtctgcctgctggaccctggccgagctgcacatcagcctgcagcacaagacagtcatcttcatgtttgcccaggagcctgaggagcagaagggcccccaggagcgggccgccttcctggacagcctgatgctgcagatgcccagcgagctgcccctgagcagcaggaggatgaggctgacccactgcggcctgcaggagaagcacctggagcagctgtgcaaggccctgggcggcagctgccacctgggccacctgcacctggacttctctggaaatgccctgggagatgagggcgccgcccggctggcccagctgctgcccggcctgggcgccctgcagagcctgaacctgtctgaaaatggcctgagcctggatgctgtgctgggcctggtgcgctgcttcagcaccctgcagtggctgttccggctggacatcagctttgagagccagcacatcctgctgcggggggacaagaccagcagcctgtctgagtgccccctggagccccccagcctgacccggctgtgtgccaccctgaaggactgccccggccccctggagctgcagctgagctgtgagttcctgagtgaccagagcctggagaccctgctggactgcctgccccagctgccccagctgagcctgctgcagctgagccagacaggcctgagccccaagagccccttcctgctggccaacaccctgagcctgtgcccccgggtgaagaaggtggacctgcggagcctgcaccacgccaccctgcacttccgcagcaatgaggaggaggagggcgtgtgctgcggcttcaccggctgcagcctgagccaggagcacgtggagagcctgtgctggctgctgagcaagtgcaaggacctgagccaggtggacctgagcgccaacctgctgggggacagcggcctgcgctgcctgctggagtgcctgccccaggtgcccatcagcggcctgctggacctgagccacaacagcatcagccaggagagcgccctgtacctgctggagaccctgcccagctgcccccgggtgcgggaggcctctgtgaacctgggcagcgagcagagcttccgcatccacttcagccgggaggaccaggccggcaagaccctgcggctgtctgaatgttccttccggcctgagcacgtgtcccggctggccaccggcctgagcaagagcctgcagctgacagagctgaccctgacccagtgctgcctgggccagaagcagctggccatcctgctgagcctggtgggccggcctgctggcctcttcagcctgcgggacagcaccaggcacacagagaagctgtccttccccaccctggaggcctgtgccctgggcttcaagtag

SEQ ID NO: 40369 - DNA, 4656 bp, Artificial Sequence
  Description of Artificial Sequence: Synthetic coding sequence
atggaccctgtgggcctgcagctgggcaacaagaacctgtggagctgcctggtgcggctgctgaccaaggaccctgagtggctgaatgccaagatgaagttcttcctgcccaacacagacctggacagcagaaatgagaccctggaccctgagcagagggtcatcctgcagctgaacaagctgcacgtgcagggcagtgacacctggcagagcttcatccactgtgtgtgcatgcagctggaggtgcccctggacctggaggtgctgctgctgagcaccttcggctatgatgatggcttcaccagccagctgggcgctgagggcaagagccagcctgagagccagctgcaccacggcctgaagaggccccaccagagctgtggcagcagccccaggaggaagcagtgcaagaagcagcagctggagctggccaagaagtacctgcagctgctgcggaccagcgcccagcagcgctaccgcagccagatccctggcagcggccagccccacgccttccaccaggtgtatgtgccccccatcctgcggcgggccacagccagcctggacaccccagagggcgccatcatgggagatgtgaaggtggaggatggagcagatgtgtccatcagtgacctcttcaacaccagggtgaacaagggcccccgggtgacagtgctgctgggcaaggccggcatgggcaagaccaccctggcccaccggctgtgccagaagtgggccgagggccacctgaactgcttccaggccctcttcctgtttgagttccggcagctgaacctgatcacccgcttcctgacccccagcgagctgctgtttgacctgtacctgagccctgagagtgaccatgacaccgtcttccagtacctggagaagaatgctgaccaggtgctgctgatctttgatggcctggatgaggccctgcagcccatgggcccagatggccctggccctgtgctgaccctcttcagccacctgtgcaatggcaccctgctgcccggctgccgggtgatggccaccagcaggcctgggaagctgcctgcctgcctgcctgctgaggccgccatggtgcacatgctgggctttgatggcccccgggtggaggagtatgtgaaccacttcttcagcgcccagcccagccgggagggcgccctggtggagctgcagaccaacggccgcctgcggagcctgtgtgctgtgcctgccctgtgccaggtggcctgcctgtgcctgcaccacctgctgcctgaccacgcccctggccagagcgtggccctgctgcccaacatgacccagctgtacatgcagatggtgctggccctgagccccccaggccacctgcccaccagcagcctgctggacctgggggaggtggccctgcggggcctggagaccgggaaggtgatcttctacgccaaggacatcgccccacccctgattgcctttggagccacccacagcctgctgaccagcttctgtgtgtgcaccggccctggccaccagcagacaggctacgccttcacccacctgagcctgcaggagttcctggccgccctgcacctgatggccagccccaaggtgaacaaggacaccctgacccagtatgtgaccctgcacagccgctgggtgcagaggaccaaggcccggctgggcctgagtgaccacctgcccaccttcctggccggcctggccagctgcacctgccggcccttcctgagccacctggcccagggcaatgaagactgtgtgggcgccaagcaggccgctgtggtgcaggtgctgaagaagctggccaccaggaagctgaccggccccaaggtggtggagctgtgccactgtgtggatgagacccaggagcctgagctggccagcctgacagcccagagcctgccctaccagctgcccttccacaacttccccctgacctgcacagacctggccaccctgaccaacatcctggagcaccgggaggcccccatccacctggactttgatggctgccccctggagccccactgcccagaggccctggtgggctgcggccagatcgagaacctgtccttcaagagcaggaaatgtggagatgcctttgctgaggccctgagccgcagcctgcccaccatgggccgcctgcagatgctgggcctggccggcagcaagatcacagcccggggcatcagccacctggtgaaggccctgcccctgtgcccccagctgaaggaggtgtccttccgggacaaccagctgagtgaccaggtggtgctgaacatcgtggaggtgctgccccacctgccccggctgaggaagctggacctgagcagcaacagcatctgtgtgtccaccctgctgtgcctggcccgggtggccgtgacctgccccaccgtgaggatgctgcaggcccgggaggccgacctgatcttcctgctgagccccccaacagagaccacagctgagctgcagagggccccagacctgcaggagagtgatggccagaggaagggggcccagagccgcagcctgaccctgcggctgcagaagtgccagctgcaggtgcatgatgctgaggccctgattgccctgctgcaggagggcccccacctggaggaggtggacctgagcggcaaccagctggaggatgagggctgccgcctgatggccgaggccgccagccagctgcacatcgccaggaagctggacctgagcaacaacggcctgtctgtggccggcgtgcactgtgtgctgcgggctgtgtctgcctgctggaccctggccgagctgcacatcagcctgcagcacaagacagtcatcttcatgtttgcccaggagcctgaggagcagaagggcccccaggagcgggccgccttcctggacagcctgatgctgcagatgcccagcgagctgcccctgagcagcaggaggatgaggctgacccactgcggcctgcaggagaagcacctggagcagctgtgcaaggccctgggcggcagctgccacctgggccacctgcacctggacttctctggaaatgccctgggagatgagggcgccgcccggctggcccagctgctgcccggcctgggcgccctgcagagcctgaacctgtctgaaaatggcctgagcctggatgctgtgctgggcctggtgcgctgcttcagcaccctgcagtggctgttccggctggacatcagctttgagagccagcacatcctgctgcggggggacaagaccagccgggacatgtgggccaccggcagcctgcctgacttccctgctgctgccaagttcctgggcttccggcagcgctgcatccccaggagcctgtgcctgtctgagtgccccctggagccccccagcctgacccggctgtgtgccaccctgaaggactgccccggccccctggagctgcagctgagctgtgagttcctgagtgaccagagcctggagaccctgctggactgcctgccccagctgccccagctgagcctgctgcagctgagccagacaggcctgagccccaagagccccttcctgctggccaacaccctgagcctgtgcccccgggtgaagaaggtggacctgcggagcctgcaccacgccaccctgcacttccgcagcaatgaggaggaggagggcgtgtgctgcggccgcttcaccggctgcagcctgagccaggagcacgtggagagcctgtgctggctgctgagcaagtgcaaggacctgagccaggtggacctgagcgccaacctgctgggggacagcggcctgcgctgcctgctggagtgcctgccccaggtgcccatcagcggcctgctggacctgagccacaacagcatcagccaggagagcgccctgtacctgctggagaccctgcccagctgcccccgggtgcgggaggcctctgtgaacctgggcagcgagcagagcttccgcatccacttcagccgggaggaccaggccggcaagaccctgcggctgtctgagtgcagcttccggcctgagcacgtgtcccggctggccaccggcctgagcaagagcctgcagctgacagagctgaccctgacccagtgctgcctgggccagaagcagctggccatcctgctgagcctggtgggccggcctgctggcctcttcagcctgcgggtgcaggagccctgggccgaccgggcccgggtgctgagcctgctggaggtgtgtgcccaggccagcggctctgtgacagagatcagcatcagcgagacccagcagcagctgtgtgtgcagctggagttcccccggcaggaggagaaccctgaggccgtggccctgcggctggcccactgtgacctgggcgcccaccacagcctgctggtgggccagctgatggagacctgtgcccggctgcagcagctgagcctgagccaggtgaacctgtgtgaagatgatgatgccagcagcctgctgctgcagagcctgctgctgagcctgtctgagctgaagaccttccgcatccagagcagccaggaccccggccgcctgctgcctgacctgctgccctttgacccccaccaggccgacctgcagctgtgtgagcaccggggcccccggcccccaggcatctggagcggccccctgccccccctgggcggggccggcctggtgtag

SEQ ID NO: 40370 - DNA, 60 bp, Artificial Sequence
  Description of Artificial Sequence: Synthetic coding sequence
atggaccctgtgggcctgcagctgggcaacaagaacctgtggagctgcctggtgaggtag

SEQ ID NO: 40371 - DNA, 225 bp, Artificial Sequence
  Description of Artificial Sequence: Synthetic coding sequence
atggaccctgtgggcctgcagctgggcaacaagaacctgtggagctgcctggtgcggctgctgaccaaggaccctgagtggctgaatgccaagatgaagttcttcctgcccaacacagacctggacagcagaaatgagaccctggaccctgagcagagggtcatcctgcagctgaacaagctgcacgtgcagggcagtgacacctggcagagcttcatccactag

SEQ ID NO: 40372 - DNA, 1968 bp, Artificial Sequence
  Description of Artificial Sequence: Synthetic coding sequence
atggccatggccaaggccaggaagccccgggaggccctgctgtgggccctgagtgacctggaggagaatgacttcaagaagctgaagttctacctgcgggacatgaccctgtctgagggccagccccccctggcccggggggagctggagggcctcatccctgtggacctggccgagctgctgatcagcaaatatggagagaaggaggccgtgaaggtggtgctgaagggcctgaaggtgatgaacctgctggagctggtggaccagctgagccacatctgcctgcatgactaccgggaggtgtaccgggagcacgtgcgctgcctggaggagtggcaggaggccggcgtgaatggccgctacaaccaggtgctgctggtggccaagcccagcagcgagagccctgagagcctggcctgccccttccctgagcaggagctggagagcgtgacagtggaggccctgtttgacagcggggagaagcccagcctggcccccagcctggtggtgctgcagggcagcgctggcaccgggaagaccaccctggccaggaagatggtgctggactgggccaccggcaccctgtacccaggccgctttgattatgtgttctacgtgtcctgcaaggaggtggtgctgctgctggagagcaagctggagcagctgctcttctggtgctgcggggacaaccaggcccctgtgacagagatcctgcggcagcctgagcggctgctcttcatcctggatggctttgatgagctgcagaggccctttgaggagaagctgaagaagaggggcctgagccccaaggagagcctgctgcacctgctgatcagaagacacaccctgcccacctgcagcctgctgatcaccacccggcccctggccctgaggaacctggagcccctgctgaagcaggcccggcacgtgcacatcctgggcttcagcgaggaggagcgggcccgctacttcagcagctacttcacagatgagaagcaggccgaccgggcctttgacatcgtgcagaagaatgacatcctgtacaaggcctgccaggtgcccggcatctgctgggtggtgtgctcctggctgcagggccagatggagcggggcaaggtggtgctggagaccccaagaaacagcacagacatcttcatggcctacgtgtccaccttcctgcccccagatgatgatggcggctgcagcgagctgagccgccaccgggtgctgcggagcctgtgcagcctggccgctgagggcatccagcaccagcgcttcctgtttgaggaggccgagctgaggaagcacaacctggatggcccccggctggccgccttcctgagcagcaatgactaccagctgggcctggccatcaagaagttctacagcttccgccacatctccttccaggacttcttccacgccatgagctacctggtgaaggaggaccagagccggctgggcaaggagagccggcgggaggtgcagaggctgctggaggtgaaggagcaggagggcaatgatgagatgaccctgaccatgcagttcctgctggacatcagcaagaaggacagcttcagcaacctggagctgaagttctgcttccgcatcagcccctgcctggcccaggacctgaagcacttcaaggagcagatggagagcatgaagcacaacagaacctgggacctggagttcagcctgtatgaggccaagatcaagaacctggtgaagggcatccagatgaacaacgtgtccttcaagatcaagcacagcaatgagaagaagagccagagccagaacctcttctctgtgaagagcagcctgagccacggccccaaggaggagcagaagtgccccagcgtgcacggccagaaggagggcaaggacaacattgctggcacccagaaggaggccagcacaggcaagggccggggcacagaggagacccccaagaacacctacatctag

SEQ ID NO: 40373 - DNA, 201 bp, Artificial Sequence
  Description of Artificial Sequence: Synthetic coding sequence
atggccatggccaaggccaggaagccccgggaggccctgctgtgggccctgagtgacctggaggagaatgacttcaagaagctgaagttctacctgcgggacatgaccctgtctgagggccagccccccctggcccggggggagctggagggcctcatccctgtggacctggccgagctgctgatcagcaaatatggatag

SEQ ID NO: 40374 - DNA, 2940 bp, Artificial Sequence
  Description of Artificial Sequence: Synthetic coding sequence
atggccgagagtgacagcacagactttgacctgctgtggtacctggagaacctgagtgacaaggagttccagagcttcaagaagtacctggccaggaagatcctggacttcaagctgccccagttccccctcatccagatgaccaaggaggagctggccaacgtgctgcccatctcctatgagggccagtacatctggaacatgctgttcagcatcttctccatgatgaggaaagaagacctgtgcaggaagatcatcggcagaagaaacagaaaccaggaggcctgcaaggctgtgatgaggaggaagttcatgctgcagtgggagagccacaccttcggcaagttccactacaagttcttcagagatgtgtccagtgatgtgttctacatcctgcagctggcctatgacagcaccagctactacagcgccaacaacctgaatgtgttcctgatgggagagcgggccagcggcaagaccatcgtcatcaacctggccgtgctgcgctggatcaagggggagatgtggcagaacatgatctcctatgtggtgcacctgacagcccacgagatcaaccagatgaccaacagcagcctggccgagctgattgccaaggactggccagatggccaggcccccatcgctgacatcctgagtgaccccaagaagctgctcttcatcctggaggacctggacaacatccgctttgagctgaatgtgaatgaaagtgccctgtgcagcaacagcacccagaaggtgcccatccctgtgctgctggtgtccctgctgaagaggaagatggcccctggctgctggttcctgatcagcagccggcccacccggggcaacaacgtgaagaccttcctgaaggaggtggactgctgcaccaccctgcagctgagcaatggcaagcgggagatctacttcaacagcttcttcaaggaccggcagagggccagcgctgccctgcagctggtgcatgaagatgagatcctggtgggcctgtgccgggtggccatcctgtgctggatcacctgcaccgtgctgaagaggcagatggacaagggccgggacttccagctgtgctgccagacccccacagacctgcacgcccacttcctggctgatgccctgaccagcgaggccggcctgacagccaaccagtaccacctgggcctgctgaagaggctgtgcctgctggccgccggcggcctcttcctgagcaccctgaacttctctggagaggacctgcgctgtgtgggcttcacagaagcagatgtgtctgtgctgcaggccgccaacatcctgctgcccagcaacacccacaaggaccgctacaagttcatccacctgaatgtgcaggagttctgcacagccatcgccttcctgatggctgtgcccaactacctgatccccagcggcagccgggagtacaaggagaagcgggagcagtacagcgacttcaaccaggtgttcaccttcatcttcggcctgctgaatgccaacagaaggaagatcctggagaccagctttggctaccagctgcccatggtggacagcttcaagtggtacagcgtgggctacatgaagcacctggaccgggaccctgagaagctgacccaccacatgcccctcttctactgcctgtatgaaaatcgggaggaggagtttgtgaagaccatcgtggatgccctgatggaggtgacagtgtacctgcagagcgacaaggacatgatggtgtccctgtactgcctggactactgctgccacctgcggaccctgaagctgtctgtgcagaggatcttccagaacaaggagcccctcatccggcccacagcccggctgtcctatgtgtccacagccagcggctttgaggacctgctgaaggccctggccaggaacagaagcctgacctacctgagcatcaactgcaccagcatcagcctgaacatgttcagcctgctgcatgacatcctgcacgagcccacctgccagatcagccacctgagcctgatgaagtgtgacctgcgggcctctgaatgtgaggagatcgccagcctgctgatcagcggcggcagcctgaggaagctgaccctgagcagcaaccccctgcggagtgatggcatgaacatcctgtgtgatgccctgctgcaccccaactgcaccctcatcagcctggtgctggtgttctgctgcctgacagagaactgctgcagcgccctgggccgggtgctgctcttcagccccaccctgcggcagctggacctgtgtgtgaaccggctgaagaactacggcgtgctgcacgtgaccttccccctgctcttccccacctgccagctggaggagctgcacctgagcggctgcttcttcagcagtgacatctgccagtacatcgccatcgtcatcgccaccaatgagaagctgcggagcctggagatcggcagcaacaagattgaagatgctggcatgcagctgctgtgtggcggcctgcggcaccccaactgcatgctggtgaacatcggcctggaggagtgcatgctgaccagcgcctgctgccgcagcctggcctctgtgctgaccaccaacaagaccctggagcggctgaacctgctgcagaaccacctgggcaatgatggagtggccaagctgctggagagcctcatcagcccagactgtgtgctgaaggtggtgggcctgcccctgaccggcctgaacacccagacccagcagctgctgatgacagtgaaggagaggaagcccagcctcatcttcctgtctgagacctggagcctgaaggagggccgggagattggagtgaccccagccagccagcccggcagcatcatccccaacagcaacctggactacatgttcttcaagttccccaggatgtctgctgccatgaggaccagcaacacagccagccggcagcccctgtag

SEQ ID NO: 40375 - DNA, 3102 bp, Artificial Sequence
  Description of Artificial Sequence: Synthetic coding sequence
atggccgagagtgacagcacagactttgacctgctgtggtacctggagaacctgagtgacaaggagttccagagcttcaagaagtacctggccaggaagatcctggacttcaagctgccccagttccccctcatccagatgaccaaggaggagctggccaacgtgctgcccatctcctatgagggccagtacatctggaacatgctgttcagcatcttctccatgatgaggaaagaagacctgtgcaggaagatcatcggcagaagaaacagaaaccaggaggcctgcaaggctgtgatgaggaggaagttcatgctgcagtgggagagccacaccttcggcaagttccactacaagttcttcagagatgtgtccagtgatgtgttctacatcctgcagctggcctatgacagcaccagctactacagcgccaacaacctgaatgtgttcctgatgggagagcgggccagcggcaagaccatcgtcatcaacctggccgtgctgcgctggatcaagggggagatgtggcagaacatgatctcctatgtggtgcacctgacagcccacgagatcaaccagatgaccaacagcagcctggccgagctgattgccaaggactggccagatggccaggcccccatcgctgacatcctgagtgaccccaagaagctgctcttcatcctggaggacctggacaacatccgctttgagctgaatgtgaatgaaagtgccctgtgcagcaacagcacccagaaggtgcccatccctgtgctgctggtgtccctgctgaagaggaagatggcccctggctgctggttcctgatcagcagccggcccacccggggcaacaacgtgaagaccttcctgaaggaggtggactgctgcaccaccctgcagctgagcaatggcaagcgggagatctacttcaacagcttcttcaaggaccggcagagggccagcgctgccctgcagctggtgcatgaagatgagatcctggtgggcctgtgccgggtggccatcctgtgctggatcacctgcaccgtgctgaagaggcagatggacaagggccgggacttccagctgtgctgccagacccccacagacctgcacgcccacttcctggctgatgccctgaccagcgaggccggcctgacagccaaccagtaccacctgggcctgctgaagaggctgtgcctgctggccgccggcggcctcttcctgagcaccctgaacttctctggagaggacctgcgctgtgtgggcttcacagaagcagatgtgtctgtgctgcaggccgccaacatcctgctgcccagcaacacccacaaggaccgctacaagttcatccacctgaatgtgcaggagttctgcacagccatcgccttcctgatggctgtgcccaactacctgatccccagcggcagccgggagtacaaggagaagcgggagcagtacagcgacttcaaccaggtgttcaccttcatcttcggcctgctgaatgccaacagaaggaagatcctggagaccagctttggctaccagctgcccatggtggacagcttcaagtggtacagcgtgggctacatgaagcacctggaccgggaccctgagaagctgacccaccacatgcccctcttctactgcctgtatgaaaatcgggaggaggagtttgtgaagaccatcgtggatgccctgatggaggtgacagtgtacctgcagagcgacaaggacatgatggtgtccctgtactgcctggactactgctgccacctgcggaccctgaagctgtctgtgcagaggatcttccagaacaaggagcccctcatccggcccacagccagccagatgaagagcctggtgtactggagggagatctgcagcctcttctacaccatggagagcctgcgggagctgcacatctttgacaatgacctgaatggcatcagcgagcgcatcctgagcaaggccctggagcacagcagctgcaagctgcggaccctgaagctgtcctatgtgtccacagccagcggctttgaggacctgctgaaggccctggccaggaacagaagcctgacctacctgagcatcaactgcaccagcatcagcctgaacatgttcagcctgctgcatgacatcctgcacgagcccacctgccagatcagccacctgagcctgatgaagtgtgacctgcgggcctctgaatgtgaggagatcgccagcctgctgatcagcggcggcagcctgaggaagctgaccctgagcagcaaccccctgcggagtgatggcatgaacatcctgtgtgatgccctgctgcaccccaactgcaccctcatcagcctggtgctggtgttctgctgcctgacagagaactgctgcagcgccctgggccgggtgctgctcttcagccccaccctgcggcagctggacctgtgtgtgaaccggctgaagaactacggcgtgctgcacgtgaccttccccctgctcttccccacctgccagctggaggagctgcacctgagcggctgcttcttcagcagtgacatctgccagtacatcgccatcgtcatcgccaccaatgagaagctgcggagcctggagatcggcagcaacaagattgaagatgctggcatgcagctgctgtgtggcggcctgcggcaccccaactgcatgctggtgaacatcggcctggaggagtgcatgctgaccagcgcctgctgccgcagcctggcctctgtgctgaccaccaacaagaccctggagcggctgaacctgctgcagaaccacctgggcaatgatggagtggccaagctgctggagagcctcatcagcccagactgtgtgctgaaggtggtgggcctgcccctgaccggcctgaacacccagacccagcagctgctgatgacagtgaaggagaggaagcccagcctcatcttcctgtctgagacctggagcctgaaggagggccgggagattggagtgaccccagccagccagcccggcagcatcatccccaacagcaacctggactacatgttcttcaagttccccaggatgtctgctgccatgaggaccagcaacacagccagccggcagcccctgtag

SEQ ID NO: 40376 - DNA, 3132 bp, Artificial Sequence
  Description of Artificial Sequence: Synthetic coding sequence
atgaacttcagcgtcatcacctgccccaacggcggcaccaaccagggcctgctgccctacctgatggccctggaccagtaccagctggaggagttcaagctgtgcctggagccccagcagctgatggacttctggagcgccccccagggccacttcccccgcatcccctgggccaacctgcgggctgctgaccccctgaacctgtccttcctgctggatgagcacttccccaagggccaggcctggaaggtggtgctgggcatcttccagaccatgaacctgaccagcctgtgtgagaaggtgcgggcagagatgaaggaaaatgtgcagacccaggagctgcaggaccccacccaggaggacctggagatgctggaggccgctgctggcaacatgcagacccagggctgccaggaccccaaccaggaggagctggatgagctggaggaggagactggaaatgtgcaggcccagggctgccaggaccccaaccaggaggagcctgagatgctggaggaggccgaccacaggaggaagtaccgggagaacatgaaggccgagctgctggagacctgggacaacatctcctggcccaaggaccacgtgtacatccggaacaccagcaaggatgagcacgaggagctgcagaggctgctggaccccaacagaacccgggcccaggcccagaccatcgtgctggtgggccgggccggcgtgggcaagaccaccctggccatgcaggccatgctgcactgggccaacggggtgctcttccagcagcgcttctcctatgtgttctacctgagctgccacaagatccgctacatgaaggagaccacctttgctgagctgatcagcctggactggccagactttgatgcccccatcgaggagttcatgagccagcctgagaagctgctcttcatcattgatggctttgaggagatcatcatcagcgagagccgctctgagagcctggatgatggcagcccctgcacagactggtaccaggagctgcctgtgaccaagatcctgcacagcctgctgaagaaggagctggtgcccctggccaccctgctgatcaccatcaagacctggtttgtgcgggacctgaaggccagcctggtgaacccctgctttgtgcagatcaccggcttcaccggagatgacctgcgggtgtacttcatgaggcactttgatgacagcagcgaggtggagaagatcctgcagcagctgaggaagaatgagaccctcttccacagctgcagcgcccccatggtgtgctggacagtgtgcagctgcctgaagcagcccaaggtgcgctactatgacctgcagagcatcacccagaccaccaccagcctgtatgcctacttcttcagcaacctcttcagcacagctgaggtggacctggctgatgacagctggccaggccagtggagggccctgtgcagcctggccatcgagggcctgtggagcatgaacttcaccttcaacaaggaggacacagaaattgagggcctggaggtgcccttcatcgacagcctgtatgagttcaacatcctgcagaagatcaatgactgtggcggctgcaccaccttcacccacctgtccttccaggagttctttgctgccatgagctttgtgctggaggagccccgggagttccccccccacagcaccaagccccaggagatgaagatgctgctgcagcacgtgctgctggacaaggaggcctactggacccctgtggtgctcttcttcttcggcctgctgaacaagaacatcgcccgggagctggaggacaccctgcactgcaagatcagcccccgggtgatggaggagctgctgaagtggggcgaggagctgggcaaggccgagagcgccagcctgcagttccacatcctgcggctcttccactgcctgcacgagagccaggaggaggacttcaccaagaagatgctgggccgcatctttgaggtggacctgaacatcctggaggatgaggagctgcaggccagcagcttctgcctgaagcactgcaagaggctgaacaagctgcggctgtctgtgagcagccacatcctggagcgggacctggagatcctggagaccagcaagtttgacagcaggatgcacgcctggaacagcatctgcagcaccctggtgaccaatgaaaacctgcacgagctggacctgagcaacagcaagctgcacgccagctctgtgaagggcctgtgcctggccctgaagaacccccgctgcaaggtgcagaagctgacctgcaagtctgtgaccccagagtgggtgctgcaggacctgatcatcgccctgcagggcaacagcaagctgacccacctgaacttcagcagcaacaagctgggcatgacagtgcccctcatcctgaaggccctgcggcacagcgcctgcaacctgaagtacctgtgcctggagaagtgcaacctgtctgctgccagctgccaggacctggccctcttcctgaccagcatccagcacgtgacccggctgtgcctgggcttcaaccggctgcaggatgatggcatcaagctgctgtgtgccgccctgacccaccccaagtgtgccctggagcggctggagctgtggttctgccagctggccgccccagcctgcaagcacctgagtgatgccctgctgcagaacagaagcctgacccacctgaacctgagcaagaacagcctgagagatgaaggagtgaagttcctgtgtgaggccctgggccgcccagatggcaacctgcagagcctgaacctgagcggctgcagcttcacccgggagggctgtggggagctggccaatgccctgagccacaaccacaacgtgaagatcctggacctgggagaaaatgacctgcaggatgatggagtgaagctgctgtgtgaggccctgaagccccaccgggccctgcacaccctgggcctggccaagtgcaacctgaccacagcctgctgccagcacctgttctctgtgctgagcagcagcaagagcctggtgaacctgaacctgctgggcaatgagctggacacagatggagtgaagatgctgtgcaaggccctgaagaagagcacctgccgcctgcagaagctgggctag

SEQ ID NO: 40377 - DNA, 3282 bp, Artificial Sequence
  Description of Artificial Sequence: Synthetic coding sequence
atggctgacagcagcagcagcagcttcttcccagactttggcctgctgctgtacctggaggagctgaacaaggaggagctgaacaccttcaagctgttcctgaaggagaccatggagcctgagcacggcctgaccccctggaatgaggtgaagaaggcccggcgggaggacctggccaacctgatgaagaagtactacccaggagagaaggcctggagcgtgtccctgaagatctttgggaagatgaacctgaaggacctgtgtgagcgggccaaggaggagatcaactggagcgcccagaccatcggcccagatgatgccaaggccggggagacccaggaggaccaggaggccgtgctgggagatggaacagagtacagaaaccgcatcaaggagaagttctgcatcacctgggacaagaagagcctggccggcaagccagaggacttccaccacggcattgctgagaaggacaggaagctgctggagcacctgtttgatgtggatgtgaagacaggagcccagccccagatcgtggtgctgcagggcgctgctggggtgggcaagaccaccctggtgaggaaggccatgctggactgggccgagggcagcctgtaccagcagcgcttcaagtatgtgttctacctgaatggccgggagatcaaccagctgaaggagaggagctttgcccagctgatcagcaaggactggcccagcacagagggccccatcgaggagatcatgtaccagcccagcagcctgctcttcatcatcgacagctttgatgagctgaactttgcctttgaggagcctgagtttgccctgtgtgaggactggacccaggagcaccctgtgtccttcctgatgagcagcctgctgaggaaggtgatgctgcctgaggccagcctgctggtgaccacccggctgaccaccagcaagaggctgaagcagctgctgaagaaccaccactacgtggagctgctgggcatgtctgaagatgcccgggaggagtacatctaccagttctttgaggacaagcgctgggccatgaaggtgttcagcagcctgaagagcaatgagatgctgttctccatgtgccaggtgcccctggtgtgctgggccgcctgcacctgcctgaagcagcagatggagaagggaggagatgtgaccctgacctgccagaccaccacagccctcttcacctgctacatcagcagcctcttcacccctgtggatggcggcagccccagcctgcccaaccaggcccagctgcggcggctgtgccaggtggccgccaagggcatctggaccatgacctacgtgttctaccgggagaacctgcggcggctgggcctgacccagagtgatgtgtcctccttcatggacagcaacatcatccagaaggatgctgaatatgagaactgctacgtgttcacccacctgcacgtgcaggagttctttgctgccatgttctacatgctgaagggctcctgggaggccggcaaccccagctgccagccctttgaggacctgaagagcctgctgcagagcaccagctacaaggacccccacctgacccagatgaagtgcttcctgtttggcctgctgaatgaagatagagtgaagcagctggagaggaccttcaactgcaagatgagcctgaagatcaagagcaagctgctgcagtgcatggaggtgctgggcaacagcgactacagccccagccagctgggcttcctggagctgttccactgcctgtatgagacccaggacaaggccttcatcagccaggccatgcgctgcttccccaaggtggccatcaacatctgtgagaagatccacctgctggtgtcctccttctgcctgaagcactgccgctgcctgcggaccatccggctgtctgtgacagtggtgtttgagaagaagatcctgaagaccagcctgcccaccaacacctgggatggagaccgcatcacccactgctggcaggacctgtgcagcgtgctgcacaccaatgagcacctgcgggagctggacctgtaccacagcaacctggacaagagcgccatgaacatcctgcaccacgagctgcggcaccccaactgcaagctgcagaagctgctgctgaagttcatcaccttcccagatggctgccaggacatcagcaccagcctcatccacaacaagaacctgatgcacctggacctgaagggcagtgacattggagacaacggggtgaagagcctgtgtgaggccctgaagcaccctgagtgcaagctgcagaccctgcggctggagagctgcaacctgactgtgttctgctgcctgaacatcagcaatgccctgatccgcagccagagcctcatcttcctgaacctgagcaccaacaacctgctggatgatggagtgcagctgctgtgtgaggccctgcggcaccccaagtgctacctggagcggctgagcctggagagctgtggcctgacagaggccggctgtgagtacctgagcctggccctgatcagcaacaagaggctgacccacctgtgcctggccgacaacgtgctgggagatggaggagtgaagctgatgtctgatgccctgcagcacgcccagtgcaccctgaagagcctggtgctgcggcgctgccacttcaccagcctgagcagcgagtacctgagcaccagcctgctgcacaacaagagcctgacccacctggacctgggcagcaactggctgcaggacaatggagtgaagctgctgtgtgatgtgttccgccaccccagctgcaacctgcaggacctggagctgatgggctgtgtgctgaccaatgcctgctgcctggacctggccagcgtcatcctgaacaaccccaacctgcggagcctggacctgggcaacaatgacctgcaggatgatggagtgaagatcctgtgtgatgccctgcgctaccccaactgcaacatccagaggctgggcctggagtactgcggcctgaccagcctgtgctgccaggacctgagcagcgccctgatctgcaacaagaggctcatcaagatgaacctgacccagaacaccctgggctatgagggcatcgtgaagctgtacaaggtgctgaagagccccaagtgcaagctgcaggtgctgggcctgtgcaaggaggcctttgatgaggaggcccagaagctgctggaggccgtgggcgtgagcaacccccacctgatcatcaagccagactgcaactaccacaatgaagaagatgtgtcctggtggtggtgcttctag

SEQ ID NO: 40378 - DNA, 2985 bp, Artificial Sequence
  Description of Artificial Sequence: Synthetic coding sequence
atggccgccagcttcttcagtgactttggcctgatgtggtacctggaggagctgaagaaggaggagttcaggaagttcaaggagcacctgaagcagatgaccctgcagctggagctgaagcagatcccctggacagaggtgaagaaggccagccgggaggagctggccaacctgctgatcaagcactatgaggagcagcaggcctggaacatcaccctgcgcatcttccagaagatggacaggaaggacctgtgcatgaaggtgatgagggagaggacaggctacaccaagacctaccaggcccacgccaagcagaagttcagccggctgtggagcagcaagtctgtgacagagatccacctgtactttgaggaggaggtgaagcaggaggagtgtgaccacctggaccggctgtttgcccccaaggaggccggcaagcagcccaggacagtcatcatccagggcccccagggcatcggcaagaccaccctgctgatgaagctgatgatggcctggagcgacaacaagatcttccgggaccgcttcctgtacaccttctacttctgctgccgggagctgcgggagctgccccccaccagcctggccgacctgatcagccgggagtggccagaccctgctgcccccatcacagaaattgtgtcccagcctgagcggctgctcttcgtcatcgacagctttgaggagctgcagggcggcctgaatgaaccagacagcgacctgtgtggggacctgatggagaagaggcctgtgcaggtgctgctgagcagcctgctgaggaagaagatgctgcctgaggccagcctgctgattgccatcaagcctgtgtgccccaaggagctgcgggaccaggtgaccatcagcgagatctaccagccccggggcttcaatgaaagtgaccggctggtgtacttctgctgcttcttcaaggaccccaagagggccatggaggccttcaacctggtgcgggagagcgagcagctgttcagcatctgccagatccccctgctgtgctggatcctgtgcaccagcctgaagcaggagatgcagaagggcaaggacctggccctgacctgccagagcaccacctctgtgtacagcagctttgtgttcaacctcttcaccccagagggcgctgagggccccaccccccagacccagcaccagctgaaggccctgtgcagcctggccgctgagggcatgtggacagacacctttgagttctgtgaagatgacctgcggagaaatggagtggtggatgctgacatcccagccctgctgggcaccaagatcctgctgaagtatggagagcgggagagcagctatgtgttcctgcacgtgtgcatccaggagttctgtgccgccctcttctacctgctgaagagccacctggaccacccccaccctgctgtgcgctgtgtgcaggagctgctggtggccaactttgagaaggcccggcgggcccactggatcttcctgggctgcttcctgaccggcctgctgaacaagaaggagcaggagaagctggatgccttcttcggcttccagctgagccaggagatcaagcagcagatccaccagtgcctgaagagcctgggggagcggggcaacccccagggccaggtggacagcctggccatcttctactgcctgtttgagatgcaggaccctgcctttgtgaagcaggccgtgaacctgctgcaggaggccaacttccacatcatcgacaacgtggacctggtggtgtctgcctactgcctgaagtactgcagcagcctgaggaagctgtgcttctctgtgcagaatgtgttcaagaaggaggatgagcacagcagcaccagtgactacagcctcatctgctggcaccacatctgcagcgtgctgaccaccagcggccacctgcgggagctgcaggtgcaggacagcaccctgtctgagagcacctttgtgacctggtgcaaccagctgcggcaccccagctgccgcctgcagaagctgggcatcaacaacgtgtccttcagcggccagagcgtgctgctgtttgaggtgctcttctaccagcctgacctgaagtacctgtccttcaccctgaccaagctgagcagagatgacatccgcagcctgtgtgatgccctgaactacccagctggaaatgtgaaggagctggccctggtgaactgccacctgagccccatcgactgtgaggtgctggccggcctgctgaccaacaacaagaagctgacctacctgaatgtgtcctgcaaccagctggacacaggagtgcccctgctgtgtgaggccctgtgcagcccagacacagtgctggtgtacctgatgctggccttctgccacctgtctgagcagtgctgtgagtacatcagcgagatgctgctgaggaacaagtctgtgcgctacctggacctgagcgccaacgtgctgaaggatgagggcctgaagaccctgtgtgaggccctgaagcacccagactgctgcctggacagcctgtgcctggtgaagtgcttcatcacagctgctggctgtgaggacctggccagcgccctgatcagcaaccagaacctgaagatcctgcagatcggctgcaatgaaattggagatgtgggcgtgcagctgctgtgccgggccctgacccacacagactgccgcctggagatcctgggcctggaggagtgtggcctgaccagcacctgctgcaaggacctggcctctgtgctgacctgcagcaagaccctgcagcagctgaacctgaccctgaacaccctggaccacactggagtggtggtgctgtgtgaggccctgcggcacccagaatgtgccctgcaggtgctgggcctgaggaagacagactttgatgaggagacccaggccctgctgacagctgaggaggagaggaaccccaacctgaccatcacagatgactgtgacaccatcaccagggtggagatctag

SEQ ID NO: 40379 - DNA, 2817 bp, Artificial Sequence
  Description of Artificial Sequence: Synthetic coding sequence
atggccgccagcttcttcagtgactttggcctgatgtggtacctggaggagctgaagaaggaggagttcaggaagttcaaggagcacctgaagcagatgaccctgcagctggagctgaagcagatcccctggacagaggtgaagaaggccagccgggaggagctggccaacctgctgatcaagcactatgaggagcagcaggcctggaacatcaccctgcgcatcttccagaagatggacaggaaggacctgtgcatgaaggtgatgagggagaggacaggctacaccaagacctaccaggcccacgccaagcagaagttcagccggctgtggagcagcaagtctgtgacagagatccacctgtactttgaggaggaggtgaagcaggaggagtgtgaccacctggaccggctgtttgcccccaaggaggccggcaagcagcccaggacagtcatcatccagggcccccagggcatcggcaagaccaccctgctgatgaagctgatgatggcctggagcgacaacaagatcttccgggaccgcttcctgtacaccttctacttctgctgccgggagctgcgggagctgccccccaccagcctggccgacctgatcagccgggagtggccagaccctgctgcccccatcacagaaattgtgtcccagcctgagcggctgctcttcgtcatcgacagctttgaggagctgcagggcggcctgaatgaaccagacagcgacctgtgtggggacctgatggagaagaggcctgtgcaggtgctgctgagcagcctgctgaggaagaagatgctgcctgaggccagcctgctgattgccatcaagcctgtgtgccccaaggagctgcgggaccaggtgaccatcagcgagatctaccagccccggggcttcaatgaaagtgaccggctggtgtacttctgctgcttcttcaaggaccccaagagggccatggaggccttcaacctggtgcgggagagcgagcagctgttcagcatctgccagatccccctgctgtgctggatcctgtgcaccagcctgaagcaggagatgcagaagggcaaggacctggccctgacctgccagagcaccacctctgtgtacagcagctttgtgttcaacctcttcaccccagagggcgctgagggccccaccccccagacccagcaccagctgaaggccctgtgcagcctggccgctgagggcatgtggacagacacctttgagttctgtgaagatgacctgcggagaaatggagtggtggatgctgacatcccagccctgctgggcaccaagatcctgctgaagtatggagagcgggagagcagctatgtgttcctgcacgtgtgcatccaggagttctgtgccgccctcttctacctgctgaagagccacctggaccacccccaccctgctgtgcgctgtgtgcaggagctgctggtggccaactttgagaaggcccggcgggcccactggatcttcctgggctgcttcctgaccggcctgctgaacaagaaggagcaggagaagctggatgccttcttcggcttccagctgagccaggagatcaagcagcagatccaccagtgcctgaagagcctgggggagcggggcaacccccagggccaggtggacagcctggccatcttctactgcctgtttgagatgcaggaccctgcctttgtgaagcaggccgtgaacctgctgcaggaggccaacttccacatcatcgacaacgtggacctggtggtgtctgcctactgcctgaagtactgcagcagcctgaggaagctgtgcttctctgtgcagaatgtgttcaagaaggaggatgagcacagcagcaccagtgactacagcctcatctgctggcaccacatctgcagcgtgctgaccaccagcggccacctgcgggagctgcaggtgcaggacagcaccctgtctgagagcacctttgtgacctggtgcaaccagctgcggcaccccagctgccgcctgcagaagctgggcatcaacaacgtgtccttcagcggccagagcgtgctgctgtttgaggtgctcttctaccagcctgacctgaagtacctgtccttcaccctgaccaagctgagcagagatgacatccgcagcctgtgtgatgccctgaactacccagctggaaatgtgaaggagctggccctggccttctgccacctgtctgagcagtgctgtgagtacatcagcgagatgctgctgaggaacaagtctgtgcgctacctggacctgagcgccaacgtgctgaaggatgagggcctgaagaccctgtgtgaggccctgaagcacccagactgctgcctggacagcctgtgcctggtgaagtgcttcatcacagctgctggctgtgaggacctggccagcgccctgatcagcaaccagaacctgaagatcctgcagatcggctgcaatgaaattggagatgtgggcgtgcagctgctgtgccgggccctgacccacacagactgccgcctggagatcctgggcctggaggagtgtggcctgaccagcacctgctgcaaggacctggcctctgtgctgacctgcagcaagaccctgcagcagctgaacctgaccctgaacaccctggaccacactggagtggtggtgctgtgtgaggccctgcggcacccagaatgtgccctgcaggtgctgggcctgaggaagacagactttgatgaggagacccaggccctgctgacagctgaggaggagaggaaccccaacctgaccatcacagatgactgtgacaccatcaccagggtggagatctag

SEQ ID NO: 40380 - DNA, 3114 bp, Artificial Sequence; identical to SEQ ID NO: 40359
  Description of Artificial Sequence: Synthetic coding sequence

SEQ ID NO: 40381 - DNA, 2943 bp, Artificial Sequence; identical to SEQ ID NO: 40341
  Description of Artificial Sequence: Synthetic coding sequence

SEQ ID NO: 40382 - DNA, 2019 bp, Artificial Sequence
  Description of Artificial Sequence: Synthetic coding sequence
atgaccagcccccagctggagtggaccctgcagaccctgctggagcagctgaatgaagatgagctgaagagcttcaagagcctgctgtgggccttccccctggaggatgtgctgcagaagaccccctggagcgaggtggaggaggctgatggcaagaagctggccgagatcctggtgaacaccagcagcgagaactggatcagaaatgccaccgtgaacatcctggaggagatgaacctgacagagctgtgcaagatggccaaggccgagatgatggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagatgtctgtgttccaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacgccctggagaaggaggagggagaagatagagatggccacgcctgggacattggagatgtgcagaagctgctgagcggggaggagcggctgaagaacccagacctgatccaggtgggccacttcctgtttggcctggccaatgagaagagggccaaggagctggaggccaccttcggctgcaggatgagcccagacatcaagcaggagctgctgcagtgcaaggcccacctgcacgccaacaagcccctgtctgtgacagacctgaaggaggtgctgggctgcctgtatgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtcttcctggagaactacatggactttgagctggacattgaatttgagcgctgcacctacctgaccatccccaactgggcccggcaggacctgcggagcctgcggctgtggacagacttctgcagcctcttcagcagcaacagcaacctgaagttcctggaggtgaagcagagcttcctgagtgacagctctgtgcgcatcctgtgtgaccacgtgaccaggagcacctgccacctgcagaaggtggagatcaagaatgtgaccccagacacagcctacagagacttctgcctggccttcatcggcaagaagaccctgacccacctgaccctggccggccacatcgagtgggagaggaccatgatgctgatgctgtgtgacctgctgaggaaccacaagtgcaacctgcagtacctgcggctgggcggccactgtgccaccccagagcagtgggccgagttcttctacgtgctgaaggccaaccagagcctgaagcacctgcggctgagcgccaacgtgctgctggatgagggcgccatgctgctgtacaagaccatgacccggcccaagcacttcctgcagatgctgagcctggagaactgccgcctgacagaggccagctgcaaggacctggccgctgtgctggtggtgtccaagaagctgacccacctgtgcctggccaagaaccccatcggggacaccggggtgaagttcctgtgtgagggcctgagctacccagactgcaagctgcagccccacaagccaggcctggagtaccagcctgacagctcctggatcgtggacagcctgagcggcatccgggagagcaagctgtag

SEQ ID NO: 40383 - DNA, 3198 bp, Artificial Sequence; identical to SEQ ID NO: 40343
  Description of Artificial Sequence: Synthetic coding sequence

SEQ ID NO: 40384 - DNA, 3030 bp, Artificial Sequence; identical to SEQ ID NO: 40342
  Description of Artificial Sequence: Synthetic coding sequence

SEQ ID NO: 40385 - DNA, 828 bp, Artificial Sequence
  Description of Artificial Sequence: Synthetic coding sequence
atggaggaggtgcgggagggccacgccctgggcggcggcatggaggctgatggccctgccagcctgcaggagctgccccccagccccaggagccccagccccccacccagccccccacccctgcccagcccccccagcctgcccagccctgctgcccctgaggcccctgagctgcctgagcccgcccagcccagcgaggcccacgcccggcagctgctgctggaggagtggggccccctgagcggcggcctggagctgccccagaggctgacctggaagctgctgctgctgcggcggcccctgtacagaaacctgctgcggagccccaaccctgagggcatcaacatctatgagcccgcccccccaacaggccccacccagaggcccctggagaccctgggcaacttccggggctggtacatcagaacagagaagctgcagcagaaccagagctggacagtgaagcagcagtgtgtggacctgctggccgagggcctgtgggaggagctgctggatgatgagcagcctgccatcaccgtgatggactggtttgaggacagccggctggatgcctgtgtgtatgagctgcacgtgtggctgctggccgctgacagaagaacagtgattgcccagcaccacgtggcccccaggaccagcggccggggccccccaggccgctgggtgcaggtgagccacgtgttccgccactacggccctggggtgcgcttcatccacttcctgcacaaggccaagaacaggatggagcccggcggcctgcggaggaccagggtgacagacagctctgtgtctgtgcagctgcgggagtag

SEQ ID NO: 40386 - DNA, 1413 bp, Artificial Sequence
  Description of Artificial Sequence: Synthetic coding sequence
atgggcctgtatgctgctgctgctggggtgctggccggcgtggagagccggcagggcagcatcaagggcctggtgtacagcagcaacttccagaatgtgaagcagctgtatgccctggtgtgtgagacccagcgctacagcgctgtgctggatgctgtgattgccagcgctggcctgctgcgggcagagaagaagctgcggccccacctggccaaggtgctggtgtatgagctgctgctgggcaagggcttccggggcggcggcggccgctggaaggccctgctgggccgccaccaggcccggctgaaggccgagctggcccggctgaaggtgcaccggggcgtgtccagaaatgaagacctgctggaggtgggcagccggcccggccctgccagccagctgcccaggtttgtgcgggtgaacaccctgaagacctgcagtgatgatgtggtggactacttcaagaggcagggcttctcctaccagggccgggccagcagcctggatgacctgcgggccctgaagggcaagcacttcctgctggaccccctgatgcctgagctgctggtgtttcctgcccagacagacctgcacgagcaccccctgtacagagctggccacctgatcctgcaggaccgggccagctgcctgcctgccatgctgctggaccccccacctggcagccacgtgattgatgcctgtgccgcccctggcaacaagaccagccacctggccgccctgctgaagaaccagggcaagatctttgcctttgacctggatgccaagaggctggcctccatggccaccctgctggcccgggccggcgtgtcctgctgtgagctggccgaggaggacttcctggccgtgagccccagcgacccccgctaccacgaggtgcactacatcctgctggaccccagctgcagcggcagcggcatgcccagccggcagctggaggagcctggagctggcacccccagccctgtgcggctgcacgccctggccggcttccagcagagggccctgtgccacgccctgaccttccccagcctgcagaggctggtgtacagcacctgcagcctgtgccaggaggagaatgaagatgtggtgagagatgccctgcagcagaaccctggggccttccggctggccccagccctgcctgcctggccccaccggggcctgagcaccttccctggagctgagcactgcctgcgggccagccctgagaccaccctgagcagcggcttctttgtggccgtcatcgagcgggtggaggtgcccagcctgaccggccagagcatcagcaccaggacccacacccagcccagccccaaggagaaggaggagacagccaagagccgcagccgctgcctgcacacagccctgcacatcgccgaggcccctggatag

SEQ ID NO: 40387 - DNA, 1176 bp, Artificial Sequence
  Description of Artificial Sequence: Synthetic coding sequence
atgggcctgtatgctgctgctgctggggtgctggccggcgtggagagccggcagggcagcatcaagggcctggtgtacagcagcaacttccagaatgtgaagcagctgtatgccctggtgtgtgagacccagcgctacagcgctgtgctggatgctgtgattgccagcgctggcctgctgcgggcagagaagaagctgcggccccacctggccaaggtgcaccggggcgtgtccagaaatgaagacctgctggaggtgggcagccggcccggccctgccagccagctgcccaggtttgtgcgggtgaacaccctgaagacctgcagtgatgatgtggtggactacttcaagaggcagggcttctcctaccagggccgggccagcagcctggatgacctgcgggccctgaagggcaagcacttcctgctggaccccctgatgcctgagctgctggtgtttcctgcccagacagacctgcacgagcaccccctgtacagagctggccacctgatcctgcaggaccgggccagctgcctgcctgccatgctgctggaccccccacctggcagccacgtgattgatgcctgtgccgcccctggcaacaagaccagccacctggccgccctgctgaagaaccagggcaagatctttgcctttgacctggatgccaagaggctggcctccatggccaccctgctggcccgggccggcgtgtcctgctgtgagctggccgaggaggacttcctggccgtgagccccagcgacccccgctaccacgaggtgcactacatcctgctggaccccagctgcagcggcagcggcatgcccagccggcagctggaggagcctggagctggcacccccagccctgtgcggctgcacgccctggccggcttccagcagagggccctgtgccacgccctgaccttccccagcctgcagaggctggtgtacagcacctgcagcctgtgccaggaggagaatgaagatgtggtgagagatgccctgcagcagaaccctggggccttccggctggccccagccctgcctgcctggccccaccggggcctgagcaccttccctggagctgagcactgcctgcgggccagccctgagaccaccctgagcagcggcttctttgtggccgtcatcgagcgggtggaggtgcccaggtag

SEQ ID NO: 40388 - DNA, 1023 bp, Artificial Sequence
  Description of Artificial Sequence: Synthetic coding sequence
atgctgacccagctgaaggccaagtctgagggcaagctggccaagcagatctgcaaggtggtgctggaccactttgagaagcagtacagcaaggagctgggagatgcctggaacacagtgcgggagatcctgaccagccccagctgctggcagtatgctgtgctgctgaaccgcttcaactacccctttgagctggagaaggacctgcacctgaagggctaccacaccctgagccagggcagcctgcccaactaccccaagtctgtgaagtgctacctgagcaggaccccaggccgcatccccagcgagcggcaccagatcggcaacctgaagaagtactacctgctgaatgctgccagcctgctgcctgtgctggccctggagctgagagatggagagaaggtgctggacctgtgtgccgcccctgggggcaagagcatcgccctgctgcagtgtgcctgccccggctacctgcactgcaatgaatatgacagcctgcggctgcgctggctgcggcagaccctggagagcttcatcccccagcccctcatcaacgtcatcaaggtgtctgagctggatggcaggaagatgggagatgcccagcctgagatgtttgacaaggtgctggtggatgccccctgcagcaatgaccgctcctggctgttcagcagtgacagccagaaggccagctgccgcatcagccagaggaggaacctgcccctgctgcagatcgagctgctgcggagcgccatcaaggccctgcggcctgggggcatcctggtgtacagcacctgcaccctgagcaaggccgagaaccaggacgtcatcagcgagatcctgaacagccacggcaacatcatgcccatggacatcaagggcatcgcccggacctgcagccatgacttcacctttgcccccaccggccaggagtgtggcctgctggtgatcccagacaagggcaaggcctggggccccatgtatgtggccaagctgaagaagtcctggagcacaggcaagtggtag

SEQ ID NO: 40389 - DNA, 1155 bp, Artificial Sequence
  Description of Artificial Sequence: Synthetic coding sequence
atggccgccctgaccctgcggggcgtgcgggagctgctgaagagggtggacctggccaccgtgcccaggaggcaccgctacaagaagaagtgggccgccacagagcccaagtttcctgctgtgcggctggccctgcagaactttgacatgacctacagcgtgcagtttggagacctgtggcccagcatccgggtgtccctgctgtctgagcagaagtatggagccctggtgaacaactttgctgcctgggaccacgtgtctgccaagctggagcagctgagcgccaaggactttgtgaatgaggccatcagccactgggagctgcagagcgagggcggccagagcgctgcccccagccctgcctcctgggcctgcagccccaacctgcgctgcttcacctttgacagaggagacatcagccgcttccccccagcccggcccggcagcctgggcgtgatggagtactacctgatggatgctgccagcctgctgcctgtgctggccctgggcctgcagcccggggacatcgtgctggacctgtgtgccgcccctgggggcaagaccctggccctgctgcagacaggctgctgcaggaacctggccgccaatgacctgagccccagccgcatcgcccggctgcagaagatcctgcacagctatgtgcctgaggagatcagagatggcaaccaggtgcgggtgacctcctgggatggcaggaagtggggcgagctggagggggacacctatgacagagtgctggtggatgtgccctgcaccacagacagacacagcctgcacgaggaggagaacaacatcttcaagaggagcaggaagaaggagcggcagatcctgcctgtgctgcaggtgcagctgctggccgccggcctgctggccaccaagccaggcggccacgtggtgtacagcacctgcagcctgagccacctgcagaatgaatatgtggtgcagggcgccatcgagctgctggccaaccagtacagcatccaggtgcaggtggaggacctgacccacttcagaagagtcttcatggacaccttctgcttcttcagcagctgccaggtgggggagctggtgatccccaacctgatggccaactttggccccatgtacttctgcaagatgaggcggctgacctag

SEQ ID NO: 40390 - DNA, 1008 bp, Artificial Sequence
  Description of Artificial Sequence: Synthetic coding sequence
atgacctacagcgtgcagtttggagacctgtggcccagcatccgggtgtccctgctgtctgagcagaagtacggggccctggtgaacaactttgctgcctgggaccacgtgtctgccaagctggagcagctgagcgccaaggactttgtgaatgaggccatcagccactgggagctgcagagcgagggcggccagagcgctgcccccagccctgcctcctgggcctgcagccccaacctgcgctgcttcacctttgacagaggagacatcagccgcttccccccagcccggcccggcagcctgggcgtgatggagtactacctgatggatgctgccagcctgctgcctgtgctggccctgggcctgcagcccggggacatcgtgctggacctgtgtgccgcccctgggggcaagaccctggccctgctgcagacaggctgctgcaggaacctggccgccaatgacctgagccccagcagaattgcccggctgcagaagatcctgcacagctatgtgcctgaggagatcagagatggcaaccaggtgcgggtgacctcctgggatggcaggaagtggggcgagctggagggggacacctatgacagagtgctggtggatgtgccctgcaccacagacagacacagcctgcacgaggaggagaacaacatcttcaagaggagcaggaagaaggagcggcagatcctgcctgtgctgcaggtgcagctgctggccgccggcctgctggccaccaagccaggcggccacgtggtgtacagcacctgcagcctgagccacctgcagaatgaatatgtggtgcagggcgccatcgagctgctggccaaccagtacagcatccaggtgcaggtggaggacctgacccacttccggcgggtcttcatggacaccttctgcttcttcagcagctgccaggtgggggagctggtgatccccaacctgatggccaactttggccccatgtacttctgcaagatgaggcggctgacctag

SEQ ID NO: 40391 - DNA, 1008 bp, Artificial Sequence; identical to SEQ ID NO: 40390
  Description of Artificial Sequence: Synthetic coding sequence

SEQ ID NO: 40392 - DNA, 1290 bp, Artificial Sequence
  Description of Artificial Sequence: Synthetic coding sequence
atgggcctgtatgctgctgctgctggggtgctggccggcgtggagagccggcagggcagcatcaagggcctggtgtacagcagcaacttccagaatgtgaagcagctgtatgccctggtgtgtgagacccagcgctacagcgctgtgctggatgctgtgattgccagcgctggcctgctgcgggcagagaagaagctgcggccccacctggccaaggtgctggtgtatgagctgctgctgggcaagggcttccggggcggcggcggccgctggaaggccctgctgggccgccaccaggcccggctgaaggccgagctggcccggctgaaggtgcaccggggcgtgtccagaaatgaagacctgctggaggtgggcagccggcccggccctgccagccagctgcccaggtttgtgcgggtgaacaccctgaagacctgcagtgatgatgtggtggactacttcaagaggcagggcttctcctaccagggccgggccagcagcctggatgacctgcgggccctgaagggcaagcacttcctgctggaccccctgatgcctgagctgctggtgtttcctgcccagacagacctgcacgagcaccccctgtacagagctggccacctgatcctgcaggaccgggccagctgcctgcctgccatgctgctggaccccccacctggcagccacgtgattgatgcctgtgccgcccctggcaacaagaccagccacctggccgccctgctgaagaaccagggcaagatctttgcctttgacctggatgccaagaggctggcctccatggccaccctgctggcccgggccggcgtgtcctgctgtgagctggccgaggaggacttcctggccgtgagccccagcgacccccgctaccacgaggtgcactacatcctgctggaccccagctgcagcggcagcggcatgcccagccggcagctggaggagcctggagctggcacccccagccctgtgcggctgcacgccctggccggcttccagcagagggccctgtgccacgccctgaccttccccagcctgcagaggctggtgtacagcacctgcagcctgtgccaggaggagaatgaagatgtggtgagagatgccctgcagcagaaccctggggccttccggctggccccagccctgcctgcctggccccaccggggcctgagcaccttccctggagctgagcactgcctgcgggccagccctgagaccaccctgagcagcggcttctttgtggccgtcatcgagcgggtggaggtgcccaggtag

SEQ ID NO: 40393 - DNA, 1401 bp, Artificial Sequence
  Description of Artificial Sequence: Synthetic coding sequence
atgggcctgtatgctgctgctgctggggtgctggccggcgtggagagccggcagggcagcatcaagggcctggtgtacagcagcaacttccagaatgtgaagcagctgtatgccctggtgtgtgagacccagcgctacagcgctgtgctggatgctgtgattgccagcgctggcctgctgcgggcagagaagaagctgcggccccacctggccaaggtgctggtgtatgagctgctgctgggcaagggcttccggggcggcggcggccgctggaaggccctgctgggccgccaccaggcccggctgaaggccgagctggcccggctgaaggtgcaccggggcgtgtccagaaatgaagacctgctggaggtgggcagccggcccggccctgccagccagctgcccaggtttgtgcgggtgaacaccctgaagacctgcagtgatgatgtggtggactacttcaagaggcagggcttctcctaccagggccgggccagcagcctggatgacctgcgggccctgaagggcaagcacttcctgctggaccccctgatgcctgagctgctggtgtttcctgcccagacagacctgcacgagcaccccctgtacagagctggccacctgatcctgcaggaccgggccagctgcctgcctgccatgctgctggaccccccacctggcagccacgtgattgatgcctgtgccgcccctggcaacaagaccagccacctggccgccctgctgaagaaccagggcaagatctttgcctttgacctggatgccaagaggctggcctccatggccaccctgctggcccgggccggcgtgtcctgctgtgagctggccgaggaggacttcctggccgtgagccccagcgacccccgctaccacgaggtgcactacatcctgctggaccccagctgcagcggcagcggcatgcccagccggcagctggaggagcctggagctggcacccccagccctgtgcggctgcacgccctggccggcttccagcagagggccctgtgccacgccctgaccttccccagcctgcagaggctggtgtacagcacctgcagcctgtgccaggaggagaatgaagatgtggtgagagatgccctgcagcagaaccctggggccttccggctggccccagccctgcctgcctggccccaccggggcctgagcaccttccctggagctgagcactgcctgcgggccagccctgagaccaccctgagcagcggcttctttgtggccgtcatcgagcgggtggaggtgcccagcagcgccagccaggccaaggccagcgcccctgagaggacccccagccctgcccccaagaggaagaagaggcagcagagagctgctgctggggcctgcaccccaccctgcacctag

SEQ ID NO: 40394 - DNA, 1410 bp, Artificial Sequence
  Description of Artificial Sequence: Synthetic coding sequence
atgagcatcttccccaagatcagcctgcggcctgaggtggagaactacctgaaggagggcttcatgaacaaggagatcgtgacagccctgggcaagcaggaggccgagaggaagtttgagaccctgctgaagcacctgagccaccccccatccttcaccaccgtgcgggtgaacacccacctggcctctgtgcagcacgtgaagaacctgctgctggatgagctgcagaagcagttcaacggcctgtctgtgcccatcctgcagcacccagacctgcaggatgtgctgctgatccctgtgattggccccaggaagaacatcaagaagcagcagtgtgaggccatcgtgggcgcccagtgtggaaatgctgtgctgcggggggcccacgtgtatgcccctggcatcgtgtctgccagccagttcatgaaggctggagatgtgatctctgtgtacagcgacatcaagggcaagtgcaagaagggggccaaggagtttgatggcaccaaggtgttcctgggcaatggcatcagcgagctgagcaggaaggagatcttcagcggcctgcctgagctgaagggcatgggcatccgcatgacagagcctgtgtacctgagccccagctttgacagcgtgctgccccgctacctgttcctgcagaacctgcccagcgccctggtgagccacgtgctgaacccccagcccggggagaagatcctggacctgtgtgccgcccctgggggcaagaccacccacatcgccgccctgatgcatgaccagggcgaggtgattgccctggacaagatcttcaacaaggtggagaagatcaagcagaatgccctgctgctgggcctgaacagcatccgggccttctgctttgatggcaccaaggctgtgaagctggacatggtggaggacacagaaggagagccccccttcctgcctgagagctttgaccgcatcctgctggatgccccctgcagcggcatgggccagaggcccaacatggcctgcacctggagcgtgaaggaggtggccagctaccagcccctgcagaggaagctgttcaccgctgctgtgcagctgctgaagccagagggcgtgctggtgtacagcacctgcaccatcaccctggctgaaaatgaggagcaggtggcctgggccctgaccaagttcccctgcctgcagctgcagccccaggagccccagattggaggagagggcatgagaggagctggcctgagctgtgagcagctgaagcagctgcagagatttgaccccagcgctgtgcccctgcctgacacagacatggacagcctgcgggaggcccggcgggaggacatgctgcggctggccaacaaggacagcatcggcttcttcatcgccaagtttgtgaagtgcaagagcacctag

SEQ ID NO: 40395 - DNA, 2157 bp, Artificial Sequence
  Description of Artificial Sequence: Synthetic coding sequence
atgctgaacagcactggagagctggagttcagcaatgaggaggaccctgagatcatcagccagctgaccagcctgcccctgagcggcggcaagagcagcgctggggtgcctgagaagacaggctacccagattctgtgtatgtgatggccgccaacatcttccagggcatcagaattgagaagagcgcccagaaggtgctgatcaagtatggaaatgagcccctgcggagcctgtctgagagcgaggaccagagcttccagaggctgtcctatgagctggccttcagcgccctgaagtaccaggacatcctggagaccatcctgattgacagctgcatcttccccagcaccaccatcccagaccacctgagcagcctcatcatcgtgatgctgtatgacttccaggacaggaagttccagaccagggtgctgagtgacaatgaggagcccatcagcgaggtgcaggaggtggagaacctgctgaacagcttcaagatcaagctggccgccgccctggcccgctgccgcatcaagcatgatgccctgagcatctaccacatcctgcctgagaccgtgaggaagcaggagctgcgggccagcaccctgcccctgtatgcctggatcaacacctgcaagatcagccctgaggaggtgtacaacaacctgaagaggcggggctacaacaaggtgaagtctgtgctgcacattgatgacaaggtgtttgctgtggaccagcactgctatgatgtgctgatcttccccagccacctgaagaatgacctgatcaacatcgacctcttcaaggactacaagctgatcttccaggacaagagccgcagcctggccgtgcacagcgtgaaggccctgctgaacatggatgatgatgtgctgatggtgaacacaggctcctggtacacagtgagccacatgagcatcctgaccaacaacaacaccagcaaggtgtttgtgtgtggggtgcagagccaggccaaggaccctgacctgaagaccctcttcaccaagattggctgcaagaacatcgagatcctgcacgagaagttcatcaacatcgagagcaaggaccaccggctgcagaaggtgaaggtgatcctgctgctgccccgctgcagcggcctgggcgtgagcaaccctgtggagttcatcctgaatgaacatgaggacacagagttcctgaaggaccacagccagggcggcatctctgtggacaagctgcacgtgctggcccagcagcagtatgagcagctgacccacgccatgaagttcaccaaggcccaggccgtggtgtactgcacctgcagcgtcttcccagaagaaaatgaggccgtggtgaagaaggccctggagttccaggacctgggcaacaagggccagccctaccgcctgagcccccctgtgctgcccctgtgcagcctgaaggagatccagctgagcacagacaagttcttcaggatggagcccagcgagatcaccaacggctgcttcctgagcatcctgacccgggagcgggaccccagcgagaccgtgtctgtgaatgatgtgctggcccgggctgctgccaagggcctgctggatggcatcgagctgggcaagagcagcaagcgggagaagaagaagaagaagagcaagaccagcctgaccaagggggccaccacagacaatggcatccagatgaagattgctgagttcctgaaccgggagaccaaggccagcgccaacctgtctgaaacagtgaccaagccacccctgccccagaagaacacagcccaggtgggcgccagcagccagaccaggaagcccaacaagctggccccccaccctgctgtgcctgcctttgtgaagaacacctgccccagccggccccgggagcggcagacccacttcctgcggcccaggcctgaggacaggatggtggccctgaagcccatcaagatcgtgctgccccctgtgttcatgcccttcagcagcccccagggcatccgcagcaggatgcccacccagcacctgtactgccgctgggtggcccccaaggccctggtgcccacctgcctgcccacccacagcctgagcaggaaggaggagaagcccaaggatgacacccccagcagcctgctgcggcccccccggcgctggctgtag

SEQ ID NO: 40396 - DNA, 711 bp, Artificial Sequence
  Description of Artificial Sequence: Synthetic coding sequence
atgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcctgcagggcttcaccggccagtactgtgacagcctgtatgtgccctgtgcccccagcccctgtgtgaatggaggcacctgccggcagacaggagacttcacctttgagtgcaactgcctgcctgagaccgtgagaagaggaacagagctgtgggagcgggaccgggaggtgtggaatggcaaggagcatgatgaaaattag

SEQ ID NO: 40397 - DNA, 345 bp, Artificial Sequence
  Description of Artificial Sequence: Synthetic coding sequence
atgagccaggccgagctgagcacctgcagcgccccccagacccagaggatcttccaggaggccgtgaggaagggcaacacccaggagctgcagagcctgctgcagaacatgaccaactgtgagttcaacgtgaacagctttggacctgagggccagacagccctgcaccagagcgtgattgatggcaacctggagctggtgaagctgctggtgaagtttggagctgacatccggctggccaacagagatggctggagcgccctgcacatcgccgcctttggaggccaccaggacatcgtgctgtacctgatcaccaaggccaagtatgctgccagcggccgctag

SEQ ID NO: 40398 - DNA, 423 bp, Artificial Sequence
  Description of Artificial Sequence: Synthetic coding sequence
atgctgaccatcatgtgtggcttccagatgcagagccacctggccgccggggacatgaagaggctgggctatgactttgaccacctgctgagccctgccctgcccatcagcacctctgtggcccgggagggccccagcctcatcaccctgcgggccaccagagatgctgaatgtgccctgagcagcggggccggccagggcgccggccgcggggagaagaccccagccagccccaccaaccagcaccctggcctggaggagctgcagcaggccgctgaccgggagttccacccccagcctgacagcagaaattctgaggtgcaggaccgggccagctgccgctgggagcccggcatggtgggcgccgccagcagcgctgctggggagagcgtgtgtgtgcagggctgccgggtggcctgctag

SEQ ID NO: 40399 - DNA, 1602 bp, Artificial Sequence
  Description of Artificial Sequence: Synthetic coding sequence
atgatcagcagcagctctgtgcacagcaggaccttcaacaccagcaatgccctgggccctgtgtgcaagcacaagaagcccctgtctgctgccaaggcctgcatcagcgagatcctgcccagcaagttcaagccccggctgagcgcccccagcgccctgctgcaggagcagaagagcatcctgctgcccagcgagaaggcccagagctgtgagaacctgtgtgtgtctggcagcctgaatgacagcaagaggggcctgcccctgcaggtgggcggcagcattgagaacctgctgatgaggagccggcgggactatgacagcaagagcagcagcaccatgagcctgcaggagtacagcaccagcggcagaagaccctgccccctgagcaggaaggccggcatgcagttcaccatgctgtacagagacatgcaccagatcaacagaagtggcctcttcctgggcagcatcagcagcagcagctctgtgcgggacctggccagccactttgagaagagcagcctggccctgagcagaggagagctgggccccagccaggagggcagcgagcacatccccaagcacacagtgagcagccgcatcacagcctttgagcagctgatccagaggagccgctccatgcccagcctggacctgagcggccgcctgagcaagagccccacccctgtgctgagccggggcagcctgaccagcgcccggtctgctgagagcctgctggagagcaccaagctgcaccccaaggagatggatggcatgaacagcagtggagtgtatgccagccccacctgcagcaacatggcccaccacgccctgtccttccggggcctggtgcccagcgagcccctgagcacctgcagtgatgatgtggaccgctgcagcaacatcagcacagacagccgggagggcagcggcggctctgtgcacggggacttccccaagcaccggctgaacaagtgcaagggcacctgcccagccagctacacccgcttcaccaccatcaggaagcatgagcagcagcagaccagccggcagcctgagtggaggctggatgcccggggggacaagagcaccctgctgaggaacatctacctgatgagccccctgcccttccggctgaagaagcccctgcaccaccacccccggcagcccagccctggggacagcagcggcctgctggtgggccagaagccagacctgcccagccagccccaccaggaccagccccccagcggcggcaagcctgtggtgcccacccggctgagcagccgccacaccatggcccggctgagccgcagcagcgagcccagccaggagcggcccacagccctggaggactacccccgggccatcaacaacggcaacagcgtgccctacagcgaccacagcctggacaggaacaacaacccccagagcgagctggcccccagccggggcggcggcatcctgtgtgtgtgcctggtgtccccagcccggcccagcaccctgctggccctgagcaggcctcccctgtgcccctggtgcagcttcagcggcctgagctttgtgttctgcctcttctgcctggccatcaaccacggcagctag

SEQ ID NO: 40400 - DNA, 4533 bp, Artificial Sequence
  Description of Artificial Sequence: Synthetic coding sequence
atggccaccagggtggaggtgggcagcatcacccccctgacagctgtgcccggcctgggggagatgggcaaggaggagaccctgaccaggacctacttcctgcaggccggggaggccagcggggcccccccagcccgcatcctggaggccaagagccccctgcggagccctgcccggctgctgcccctgccccggctggcccccaagcccttcagcaaggagcaggatgtgaagagccctgtgcccagcctgcggcccagcagcacaggccccagccccagcggcggcctgtctgaggagcctgctgccaaggacctggacaacaggatgcctggcctggtgggccaggaggtgggcagcggggagggccccaggaccagcagccccctcttcaacaaggctgtgttcctgcggcccagcagcagcaccatgatcctgtttgagaccaccaagagcggccctgccctgggcaaggctgtgtctgagggcgctgaggaggccaagctgggcgtgtctggcagcaggcctgaggtggccgccaagccagccctgcccacccagaagccagctggcaccctgcccaggtctgcccccctgagccaggacaccaagccccctgtgccccaggaggaggccggccaggaccacccccccagcaaggccagctctgtggaggacacagcccggcccctggtggagccccggccccggctgaagaggaggcctgtgtctgccatcttcacagagagcatccagccccagaagccaggccctggagctgctgccaccgtgggcaaggtgccccccaccccacctgagaagacctgggtgaggaagccccggcccctgtccatggacctgacagccaggtttgagaacaaggaggccctgctgaggaaggtggctgatgagggcagcggccccacagctggggacatggccggcctggagcggcccagggctgccagcaagctggaccgggactgcctggtgaaggccgaggcccccctgcatgaccctgacctggacttcctggaggtggccaagaagatccgggagaggaaggagaagatgctgagcaagccagagatgggcagcccccgggccctggtgggcggcagcagtggagtgacccccagcaatgaccagagcccctgggaggagaaggccaagctggaccctgagcctgagaaggctgctgagagccccagcccccggctgggccggggcctggagctggccgaggtgaagagccgggtggctgatggagaggccgctgctggaggagagtgggccagccgccgctctgtgaggaagtgcatcagcctcttccgggaggacagcaccctggccctggccgtgggcagcgagagccccctggccaccccagccagccccagcgctgcccctgagcctgagaagggcgtggtgtctgtgcaggagcgcatccggggctggacagctgagagcagcgaggccaagccagaggtgagaagaaggaccttccaggcccggcccctgtctgctgacctgaccaagctgttcagcagcagcgccagcagcaatgaggtgaagtatgagaagtctgctgagctgtctggagagttccccaaggagccccgggagaagcagaaggagggccacagcctggatggagcctgcatccccaggagcccctggaagccaggcaccctgcgggacaagagccggcagacagagcagaaggtgagcagcaaccaggaccctgacagctgccggggcggcagctctgtggaggccccctgccccagtgatgtgaccccagaagatgacaggagcttccagacagtgtgggccaccgtgtttgagcaccacgtggagcggcacacagtggccgaccagagcggccgctgcctgagcaccaccccacctggggacatggcccacgcccgggtgtctgagccccggcccaggcctgagatgggctcctggctgggccgggaccccccagacatgaccaagctgaagaaggagaacagccggggctttgacaaccctgagacagagaagctgggccccaccaccctgctgaatggagagctgcggccctaccacacccccctgcgggacaagtaccccctgtctgagaaccacaacaacaacaccttcctgaagcacctggagaacccccccaccagccagagaattgagcccaggtatgacatcgtgcatgctgtgggggagcgggtgcacagcgaggccatcagccctgcccctgaggagaaggctgtgaccctgcggagcctgcgctcctggctgagcctgaaggaccggcagctgagccaggaggtgaccccagctgacctggagtgtggcctggagggccaggccggctctgtgcagagggccagcctcatctgggaggcccggggcatgcctgaggccagcggccccaagtttggaggcaactgccccttccccaagtggacaggaggagctgtggtgagcagccacaaggccaccgtggccgtgtctgaggagcactgtgcccctggggccacctctgtgcgggccatcaaggccgccatctgggagagccagcacgagggccctgagggcgcccggagcaagccaggagtgggcgcccggggccccccccagggctgccccctggaccccctgagccgggccaccaacggccccagcgacagccaggcccggacccacccagatgcctttgctgtgcagaagggccccttcatcgtggccgcccgggagggggaccccggccctgcccaggtgccccagcctgctgtgaggatgaggaaggccggggccatggaccagaggatggaccgctggaggaggaggaccctgcccccaaatgtgaagtttgacaccttcagcagcctggtgcctgaggacagcccccacgtgggccacagaagaacagattatgtgagccccacagccagcgccctgaggaagccccagctgagccactacagagtggagacccaggaggtgaaccctggggccagccgggaccagaccagccctgctgtgaagcagggcagccctgtggagcccaaggccaccttctttgctgtgacctaccagatccccaacacccagaaggccaagggcgtggtgctgagcggggctgagagcctgctggagcacagcaggaagatcaccccacccagcagcccccacagcctgaccagcaccctggtgtccctgggccacgaggaggccctggagatggccggcagcaagaactggatgaagggccgggagcatgaaaatgccagcatcctgaagaccctgaagcccacagaccggcccagcagcctgggcgcctggagcctggaccccttcaacggccgcatcattgatgtggatgccctgtggagccaccggggctctgaagatggcccccggccccagagcaactggaaggagagcgccaacaagatgagccccagcggcggggccccccagaccacccccaccctgcggagccggcccaaggacctgcctgtgcggaggaagacagatgtgatcagtgacaccttccctgggaagatcagagatggctaccgcagctctgtgctggacattgatgccctgatggccgagtaccaggagctgagcctgaaggtgcctggagaggcccaggagcggcgcagccccaccgtggagcccagcaccctgccccgggagaggcctgtgcagctgggcggcgtggagcagaggagaagaagcctgaaggagatgccagacaccggcggcctgtggaagccagccagcagcgctgagatcaaccacagcttcaccccaggcctgggcaagcagctggccgagaccctggagacagccatgggcaccaagagcagcccccccttctgggccctgccccccagcgcccccagcgagcgctacccaggcggcagccccatcccagctgaccccaggaagaagacaggctttgctgaagatgacaggaaggcctttgccagcaagcaccacgtggccaagtgccagaactacctggccgagagcaagcccagcggccgggaggaccccggcagcggcgtgcgggtgagccccaagagccccccaacagaccagaagaagggcacccccaggaagagcacaggccgcggggaggaggacagcgtggcccagtggggagaccacccccgggactgtggccgggtgcccctggacatcaagagggcctacagcgagaagggccccccagccaacatccgggagggcctgagcatcatgcatgaggcccgggagcggcggcgggagcagcccaagggccggcccagcctgactggagagaacctggaggccaagatgggcccctgctggtgggagagcggcaccggggacagccacaaggtgctgccccgggacctggagaaggaggatgccccccaggagaaggagcggcccctgcagcaggtgtcccctgtggcctctgtgccctggaggagccacagcttctgcaaggaccggcgcagcggcccctttgtgtag

SEQ ID NO: 40401 - DNA, 390 bp, Artificial Sequence
  Description of Artificial Sequence: Synthetic coding sequence
tgaatttctgcctactttgccaccggcagctccatgacctaccacttccaggagcactacaccctgtctgagaacagcagcagcctggtgagcagcctgcacagagatgtgaccctgacccgggagatgatcaccctgtccttccgcaccaccaggacccccagcctgctgctgtatgtgagcagcttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgatcccccagatgcagaagagcaactag

SEQ ID NO: 40402 - DNA, 543 bp, Artificial Sequence
  Description of Artificial Sequence: Synthetic coding sequence
tgaagagatgtgaccctgacccgggagatgatcaccctgtccttccgcaccaccaggacccccagcctgctgctgtatgtgtcctccttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcgccaagaagcaggtgatcctgagcagcggcacagagttcaatgctgtgaagagcctcatcctgggcaaggtgctgggccgcagcggccctgtggatgaaggagagcccctggtgaatgctgacagaagagacagcgctgtgattggaggagtgattgctgtggagatcttcatcctgctgtgcatcacagccatcgccatccgcatctaccagcagaggaagctgaggaaagaaaatgaaagcaaggtgtccaagaaggaggagtgctag

SEQ ID NO: 40403 - DNA, 873 bp, Artificial Sequence
  Description of Artificial Sequence: Synthetic coding sequence
tgaatttctgcctactttgccaccggcagctccatgacctaccacttccaggagcactacaccctgtctgagaacagcagcagcctggtgagcagcctgcacagagatgtgaccctgacccgggagatgatcaccctgtccttccgcaccaccaggacccccagcctgctgctgtatgtgagcagcttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcgccaagaagcaggtgatcctgagcagcggcacagagttcaatgctgtgaagagcctcatcctgggcaaggtgctggaggccgccggggctgaccctgacaccaggagagctgccaccagcggcttcaccggctgcctgtctgctgtgcgcttcggctgtgccgcccccctgaaggccgccctgcggcccagcggccccagccgggtgacagtgcggggccacgtggcccccatggcccgctgtgccgccggggccgccagcggcagccctgcccgggagctggccccccggctggccggcggggccggccgcagcggccctgtggatgaaggagagcccctggtgaatgctgacagaagagacagcgctgtgattggaggagtgattgctgtggagatcttcatcctgctgtgcatcacagccatcgccatccgcatctaccagcagaggaagctgaggaaagaaaatgaaagcaaggtgtccaagaaggaggagtgctag

SEQ ID NO: 40404 - DNA, 273 bp, Artificial Sequence
  Description of Artificial Sequence: Synthetic coding sequence
atgtggcactacatcggggctgctgaatgtccctacctgcagctgccccgctgccggggcagcagcacccgctactggcacaagaagagccggggccgcctgacctggccctggctgctgatgagccagctgcggacctgccacatcaacagccccttccccctggccgtgacctgtggggtgaagttcagcgaggccgctgtgcctgtgcacctgagcggctgtgtgcagaagatgaacatctgcctgcagctgcagttcagcaatgactag

SEQ ID NO: 40405 - DNA, 312 bp, Artificial Sequence
  Description of Artificial Sequence: Synthetic coding sequence
atgcccctggagaagtttgtggacatggagttcctggaccagatgatcctgcggggcacctgcctggaggccgacctgtgcccccagtacaccaacagccccttcaatgcccacacagaccagatcacccagacccacctgcccccccagcacctggacagcagccacagcacccacacctgcctgcctgtgcaccgccacatccagaggcacacagacaagcaccacagcaagaagatgttccccaggacccacggccaccccaacccccgcatcatccggctgagccagagacatgtgtgcacagcctag

SEQ ID NO: 40406 - DNA, 186 bp, Artificial Sequence
  Description of Artificial Sequence: Synthetic coding sequence
atggaggccagcctgggcggccctgagcccaatggagtcatcaatgaggaggccaaggccggggccaccgggaagaggcggggccgggccccagccaatggaggccgggccagcggggagaacagagccttccctgtgctgcagctgcccggcaactggcactgcagaagacggcagggctgctag

SEQ ID NO: 40407 - DNA, 342 bp, Artificial Sequence
  Description of Artificial Sequence: Synthetic coding sequence
atgggcagccccttctactgcaatggaggctactggctgcagaggacagagtgctggaggaccatgaatgagttccacttccgcagcgcccagctggccgtgcccggccggcagccccaggagctgttccgccgccaccgggccaccagcgcctggagcagcagaagaagaagtgccctggtggtgggcaccatcggccctggccacggccgcctgcaggaccccagctgcaccaagctgcccagccccccagcctggttccccttcttcatgaacagatccatgggccacagccaggtgggcatgcacgtgttccacaggatgggcaccaccagcagctag

SEQ ID NO: 40408 - DNA, 780 bp, Artificial Sequence
  Description of Artificial Sequence: Synthetic coding sequence
atgaccatcaacatgctgaatgtgtttggaaatgaagattttgactgccacggggacctgaagacagaccagctgaagatggacatcctgatcaagaagctgaagcagaagtttgatgacctgacagctgagaaggaggccctgagcagcaaatgtgtgaacctggccaaggacaaccaggtgctgcagcaggagttcctgtccatgaagaaggtgcagcagcagtgtgagaagctggaggaggacaagaagatgctgaaggaggagatcctgaacctgaagacccacatggagaacaacagagtggagctgagcaagctgcaggagtacaagctggagctggatgagaaggccatgcaggccgtggagaagctggaggagatccacctgcaggagcaggcccagtatgagaagcagctggagcagctgagcaaggacaacatggccagcctgaacaagaaggagctgaccctgaaggatgtggagtgcaagttcagcgagatgaagacagcctatgaggaggtgaccacagagctggaggagtacaaggaggcctttgctgctgccctgaaggccaacaacagcatgagcaagaagctgaccaagagcaacaagaagattgctgtgatctccatgaagctgctgatggagaaggagcagatgaagtacttcctgagcgccctgcccacccggcgggaccctgagagcccctgtgtggagaacctgaccagcatcggcctgaacaggaagtacatcccccagacccccatccgcatctag

SEQ ID NO: 40409 - DNA, 519 bp, Artificial Sequence
  Description of Artificial Sequence: Synthetic coding sequence
tgatacaagaagctgctggagatgaccatcaacatgctgaatgtgtttggaaatgaagattttgactgccacggggacctgaagacagaccagctgaagatggacatcctgatcaagaagctgaagcagaaggagcaggcccagtatgagaagcagctggagcagctgagcaaggacaacatggccagcctgaacaagaaggagctgaccctgaaggatgtggagtgcaagttcagcgagatgaagacagcctatgaggaggtgaccacagagctggaggagtacaaggaggcctttgctgctgccctgaaggccaacaacagcatgagcaagaagctgaccaagagcaacaagaagattgctgtgatctccatgaagctgctgatggagaaggagcagatgaagtacttcctgagcgccctgcccacccggcgggaccctgagagcccctgtgtggagaacctgaccagcatcggcctgaacaggaagtacatcccccagacccccatccgcatctag

SEQ ID NO: 40410 - DNA, 1602 bp, Artificial Sequence
  Description of Artificial Sequence: Synthetic coding sequence
atgagccagaccagcctgaagcagaagaagaatgaacctggcatgaggagcagcaaggagagcctggaggccgagaagaggaaggagagtgacaagacaggagtgcggctgagcaaccagggcagccaggagagcagcctgaggaagacagacagccggggctacctggtgcgcagccagtggagccgcatcagccgcagccccagcaccaaggcccccagcattgatgagcccaggagcaggaacaccagcgccaaggtggagctgcccagcagcagcaccagcagcaggacccccagcaccagccccagcctgcatgacagcagccccccacccctgagcggccagcccagcctgcagcccccagccagcccccagctgcccaggagcctggacagcaggcctcccaccccacctgagccagaccccggcagccgccgcagcaccaagatgcaggagaaccctgaggcctgggcccagggcatcgtgcgggagatccggcagacccgggacagccagcccctggagtacagcaggaccagccccacagagtggaagagcagcagccagaggcggggcatctacccagccagcacccagctggacaggaacagcctgtctgagcagcagcagcagcagagagaagatgaagatgattatgaggccgcctactgggcctccatgaggagcttctatgagaagaaccccagctgcagccggccctggccacccaagcccaagaatgccatcaccatcgccctgagcagctgtgccctcttcaacatggtggatggcaggaagatctatgagcaggagggcctggagaagtacatggagtaccagctgaccaatgaaaatgtcatcctgaccccaggccctgccttccgctttgtgaaggccctgcagtatgtgaatgcccggctgcgggacctgtacccagatgagcaggacctgtttgatattgtgctgatgaccaacaaccacgcccaggtgggcgtgcggctcatcaacagcgtgaaccactacggcctgctgattgaccgcttctgcctgaccggcggcaaggaccccatcggctacctgaaggcctacctgaccaacctgtacatcgctgctgacagcgagaaggtgcaggaggccatccaggagggcatcgccagcgccaccatgtttgatggagccaaggacatggcctactgtgacacccagctgcgggtggcctttgatggagatgctgtgctcttcagtgatgaaagtgagcacttcaccaaggagcacggcctggacaagttcttccagtatgacaccctgtgtgagagcaagcccctggcccaggaggagccccggctggatgtgctgatcaacaatgccggcatcttccagtgcccctacatgaagacagaagatggctttgagatgcagtttggagtgaaccacctgggccacttcctgctgaccaacctgctgctgggcctgctgaagagcagcgcccccagcagaattgtggtggtgagcagcaagctgtacaagtatggagacatcaactttgatgacctgaacagcgagcagagctacaacaagagcttctgctacagcaggtag

SEQ ID NO: 40411 - DNA, 1809 bp, Artificial Sequence
  Description of Artificial Sequence: Synthetic coding sequence
atgagccagaccagcctgaagcagaagaagaatgaacctggcatgaggagcagcaaggagagcctggaggccgagaagaggaaggagagtgacaagacaggagtgcggctgagcaaccagatgagaagagctgtgaaccccaaccacagcctgcgctgctgccccttccagggccacagcagctgccgccgctgcctgtgtgccgctgagggcacagccctgggcccctgccacaccatccgcatctacatccacatgtgcctgctgtgggagcagggccagcagatcaccatgatgaggggcagccaggagagcagcctgaggaagacagacagccggggctacctggtgcgcagccagtggagccgcatcagccgcagccccagcaccaaggcccccagcattgatgagcccaggagcaggaacaccagcgccaagctgcccagcagcagcaccagcagcaggacccccagcaccagccccagcctgcatgacagcagccccccacccctgagcggccagcccagcctgcagcccccagccagcccccagctgcccaggagcctggacagcaggcctcccaccccacctgagccagaccccggcagccgccgcagcaccaagatgcaggagaaccctgaggcctgggcccagggcatcgtgcgggagatccggcagacccgggacagccagcccctggagtacagcaggaccagccccacagagtggaagagcagcagccagaggcggggcatctacccagccagcacccagctggacaggaacagcctgtctgagcagcagcagcagcagagagaagatgaagatgattatgaggccgcctactgggcctccatgaggagcttctatgagaagaaccccagctgcagccggccctggccacccaagcccaagaatgccatcaccatcgccctgagcagctgtgccctcttcaacatggtggatggcaggaagatctatgagcaggagggcctggagaagtacatggagtaccagctgaccaatgaaaatgtcatcctgaccccaggccctgccttccgctttgtgaaggccctgcagtatgtgaatgcccggctgcgggacctgtacccagatgagcaggacctgtttgatattgtgctgatgaccaacaaccacgcccaggtgggcgtgcggctcatcaacagcgtgaaccactacggcctgctgattgaccgcttctgcctgaccggcggcaaggaccccatcggctacctgaaggcctacctgaccaacctgtacatcgctgctgacagcgagaaggtgcaggaggccatccaggagggcatcgccagcgccaccatgtttgatggagccaaggacatggcctactgtgacacccagctgcgggtggcctttgatggagatgctgtgctcttcagtgatgaaagtgagcacttcaccaaggagcacggcctggacaagttcttccagtatgacaccctgtgtgagagcaagcccctggcccagggccccctgaagggcttcctggaggacctgggccgcctgcagaagaagttctacgccaagaatgaaaggctgctgtgccccatccgcacctacctggtgacagcccggtctgctgccagcagcggggcccgggtgctgaagaccctgcggcgctggggcctggagattgatgaggccctcttcctggccggggcccccaagagccccatcctggtgaagatccggccccacatcttctttgatgaccacatgttccacatcgagggcgcccagaggaagagcctgggctggatgtcctag

SEQ ID NO: 40412 - DNA, 1887 bp, Artificial Sequence
  Description of Artificial Sequence: Synthetic coding sequence
atggagagcctggtgtttgcccggcgcagcggccccaccccatctgctgctgagctggcccggcccctggccgagggcctcatcaagagccccaagcccctgatgaagaagcaggccgtgaagaggcaccaccacaagcacaacctgcggcacagatatgagttcctggagaccctgggcaagggcacctacggcaaggtgaagaaggcccgggagagcagcggccgcctggtggccatcaagagcatcaggaaggacaagatcaaggatgagcaggacctgatgcacatccggcgggagattgagatcatgagcagcctgaaccacccccacatcatcgccatccacgaggtgtttgagaacagcagcaagatcgtgattgtgatggagtatgccagcagaggagacctgtatgactacatcagcgagcggcagcagctgtctgagcgggaggcccggcacttcttccggcagatcgtgtctgctgtgcactactgccaccagaacagagtggtgcaccgggacctgaagctggagaacatcctgctggatgccaacggcaacatcaagattgctgactttggcctgagcaacctgtaccaccagggcaagttcctgcagaccttctgtggcagccccctgtatgccagccctgagatcgtgaatggcaagccctacacaggccctgaggtggacagctggagcctgggcgtgctgctgtacatcctggtgcacggcaccatgccctttgatggccatgaccacaagatcctggtgaagcagatcagcaatggagcctaccgggagccccccaagcccagtgatgcctgtggcctcatccgctggctgctgatggtgaaccccacccggcgggccaccctggaggatgtggccagccactggtgggtgaactggggctacgccaccagggtgggggagcaggaggcccctcatgagggcggccaccctggcagtgacagcgcccgggcctccatggctgactggctgcggcgcagcagccggcccctgctggagaatggagccaaggtgtgcagcttcttcaagcagcacgcccctgggggcggcagcaccaccccaggcctggagcggcagcacagcctgaagaagagcaggaaagaaaatgacatggcccagagcctgcacagcgacacagcagatgacacagcccacaggcctgggaagagcaacctgaagctgcccaagggcatcctgaagaagaaggtgtctgccagcgctgagggcgtgcaggaggaccccccagagctgagccccatcccagccagccctggccaggccgcccccctgctgcccaagaagggcatcctgaagaagccccggcagcgggagagcggctactacagcagccctgagcccagcgagagcggggagctgctggatgctggagatgtgtttgtgtctggggaccccaaggagcagaagccaccccaggccagcggcctgctgctgcacaggaagggcatcctgaagctgaatggcaagttcagccagacagccctggagctggccgcccccaccaccttcggcagcctggatgagctggccccaccccggcccctggcccgggccagccggcccagcggggctgtgtctgaagattccatcctgagcagcgagagctttgaccagctggacctgcctgagcggctgcctgagccccccctgcggggctgtgtgtctgtggacaacctgaccggcctggaggagcccccatctgagggccctggcagctgcctgcggcgctggaggcaggaccccctgggggacagctgcttcagcctgacagactgccaggaggtgacagccacctaccggcaggccctgcgggtgtgcagcaagctgacctag

SEQ ID NO: 40413 - DNA, 462 bp, Artificial Sequence
  Description of Artificial Sequence: Synthetic coding sequence
atgagcaaggacctgaagatcctgtgcaaggaccctgccctggagctgagctgctacagagaccaccagttcagcggcaggaagttccagcaggagaagctgctgaaggagagcagcaccctgaacatgggcaacctgtccttctacaccacagaggagaagatccacgagctgttcagcagaagtgacatccggaacatcttcatgggcctggacaagatcaagaagacagcctgtggcttctgctttgtggagtgccacaacagagcagatgctgaaaatgccatgaggttcctgaccggcacctgcctggatgagtggatcatctgcacagactgggatgtgggcttccgggagggccagcagtatggccggggcaagagcggcggccaggtgagagatgagttccgggaggacttccacagcggccggggcggcttcggccggcagacccagatctag

SEQ ID NO: 40414 - DNA, 831 bp, Artificial Sequence
  Description of Artificial Sequence: Synthetic coding sequence
atgcccaagacctgccagtgctacgtgggcaccaagaccaccaaccccagcgcctggcccagccgggagatgaagaagaagaagctgcccagcgacagcggggacctggaggccctggagggcaaggacaaggagaaggagagcacagtgcacatcgagacccaccagaacaccagcaagaatgtggccgctgtgcagcccatgaagaggggccagaagagcaagatgaagaagatgaaggagaagtacaaggaccaggatgaagaagatcgggagctgatcatgaagctgctgggcagcgctggcagcaacaaggaggagaagggcaagaagggcaagaagggcaagaccaaggatgagcctgtgaagaagcagccccagaagccccggggcggccagagggtgtctgacaacatcaagaaggagacccccttcctggaggtgatcacccatgagctgcaggactttgctgtggatgacccccatgatgacaaggaggagcaggacctggaccagcagggcaatgaggagaacctgtttgacagcctgaccggccagccccacccagaagatgtgctgctgtttgccatccccatctgtgccccctacaccaccatgaccaactacaagtacaaggtgaagctgaccccaggagtgcagaagaagggcaaggccgccaagacagccctgaacagcttcatgcacagcaaggaggccacagcccgggagaaggacctcttccgctctgtgaaggacacagacctgagcaggaacatccctgggaaggtgaaggtgtctgcccccaacctgctgaatgtgaagaggaagtag

SEQ ID NO: 40415 - DNA, 2349 bp, Artificial Sequence
  Description of Artificial Sequence: Synthetic coding sequence
atggacagccgggtgatgagcaagtggatgaagaacctgaagctgaagggctacatcatccagaagcgggagatcaagcccagcctggaggccgacaagcctgtggaggacatcctgacctatgaggagttccaccccttcctgttcagccagcacagccagtgcccctacatcgagtttgagagctttgacaaggctgtggatgagttctacagcaagattgagggccagaagattgacctgaaggccctgcagcaggagaagcaggccctgaagaagctggacaacgtgaggaaggaccacgagaaccggctggaggccctgcagcaggcccaggagattgacaagctgaagggggagctgattgagatgaacctgcagatcgtggaccgggccatccaggtggtgcgcagcgccctggccaaccagattgactggacagaaattggcctcatcgtgaaggaggcccaggcccagggcgaccctgtggccagcgccatcaaggagctgaagctgcagaccaaccacgtgaccatgctgctgaggaacccctacctgctgtctgaggaggaggatgatgatgtggatggagatgtgaatgtggagaagaatgaaacagagccccccaagggcaagaagaagaagcagaagaacaagcagctgcagaagccccagaagaacaagcccctgctggtggatgtggacctgagcctgagcgcctatgccaatgccaagaagtactatgaccacaagagatatgctgccaagaagacccagaagacagtggaggccgctgagaaggccttcaagtctgctgagaagaagaccaagcagaccctgaaggaggtgcagacagtgaccagcatccagaaggccaggaaggtgtactggtttgagaagttcctgtggttcatcagcagcgagaactacctgatcattggaggccgggaccagcagcagaatgagatcatcgtgaagcgctacctgaccccagagggggacatctacgtgcatgctgacctgcacggggccaccagctgtgtgatcaagaaccccactggagagcccatcccccccaggaccctgacagaagctggcaccatggccctgtgctacagcgctgcctgggatgcccgggtcatcaccagcgcctggtgggtgtaccaccaccaggtgtccaagacagcccccaccggggagtacctgaccaccggcagcttcatgatccggggcaagaagaacttcctgcccccatcctacctgatgatgggcttctccttcctgttcaaggtggatgagagctgtgtgtggaggcaccagggcgagaggaaggtgcgggtgcaggatgaggacatggagaccctggccagctgcaccagcgagctgatcagcgaggagatggagcagctggatggaggagacaccagcagtgatgaggacaaggaggagcacgagacccctgtggaggtggagctgatgacccaggtggaccaggaggacatcaccctgcagagcggcagagatgagctgaatgaggagctgatccaggaggagagcagtgaagatgaaggagaatatgaggaggtgaggaaggaccaggacagcgtgggggagatgaaggatgaaggagaggagaccctgaactacccagacaccaccatcgacctgagccacctgcagccccagaggagcatccagaagctggccagcaaggaggagagcagcaacagcagtgacagcaagagccagagcagaagacacctgagcgccaaggagcggcgggagatgaagaagaagaagctgcccagcgacagcggggacctggaggccctggagggcaaggacaaggagaaggagagcacagtgcacatcgagacccaccagaacaccagcaagaatgtggccgctgtgcagcccatgaagaggggccagaagagcaagatgaagaagatgaaggagaagtacaaggaccaggatgaagaagatcgggagctgatcatgaagctgctgggcagcgctggcagcaacaaggaggagaagggcaagaagggcaagaagggcaagaccaaggatgagcctgtgaagaagcagccccagaagccccggggcggccagagggtgtctgacaacatcaagaaggagacccccttcctggaggtgatcacccatgagctgcaggactttgctgtggatgacccccatgatgacaaggaggagcaggacctggaccagcagggcaatgaggagaacctgtttgacagcctgaccggccagccccacccagaagatgtgctgctgtttgccatccccatctgtgccccctacaccaccatgaccaactacaagtag

SEQ ID NO: 40416 - DNA, 3105 bp, Artificial Sequence
  Description of Artificial Sequence: Synthetic coding sequence
atgaagagccgcttcagcaccatcgacctgcgggctgtgctggccgagctgaatgccagcctgctgggcatgagggtgaacaacgtgtatgatgtggacaacaagacctacctgatccggctgcagaagccagacttcaaggccaccctgctgctggagagcggcatccgcatccacaccacagaatttgagtggcccaagaacatgatgcccagcagctttgccatgaagggcaacatcgtgctgacagattatgaatatgtgatcctgaacatcctgcgcttcagaacagatgaagcagatgatgtgaagtttgctgtgcgggagcgctaccccctggaccacgcccgggctgctgagcccctgctgaccctggagcggctgacagaaattgtggccagcgcccccaagggggagctgctgaagagggtgctgaaccccctgctgccctacggccctgccctgattgagcactgcctgctggagaatggcttctctggaaatgtgaaggtggatgagaagctggagaccaaggacatcgagaaggtgctggtgtccctgcagaaggccgaggactacatgaagaccaccagcaacttcagcggcaagggctacatcatccagaagcgggagatcaagcccagcctggaggccgacaagcctgtggaggacatcctgacctatgaggagttccaccccttcctgttcagccagcacagccagtgcccctacattgaatttgagagctttgacaaggctgtggatgagttctacagcaagattgagggccagaagattgacctgaaggccctgcagcaggagaagcaggccctgaagaagctggacaacgtgaggaaggaccatgaaaatcggctggaggccctgcagcaggcccaggagattgacaagctgaagggggagctgattgagatgaacctgcagatcgtggaccgggccatccaggtggtgcgcagcgccctggccaaccagattgactggacagagatcggcctgattgtgaaggaggcccaggcccagggcgaccctgtggccagcgccatcaaggagctgaagctgcagaccaaccacgtgaccatgctgctgaggaacccctacctgctgtctgaggaggaggatgatgatgtggatggagatgtgaatgtggagaagaatgaaacagagccccccaagggcaagaagaagaagcagaagaacaagcagctgcagaagccccagaagaacaagcccctgctggtggatgtggacctgagcctgagcgcctatgccaatgccaagaagtactatgaccacaagagatatgctgccaagaagacccagaagacagtggaggccgctgagaaggccttcaagtctgctgagaagaagaccaagcagaccctgaaggaggtgcagacagtgaccagcatccagaaggccaggaaggtgtactggtttgagaagttcctgtggttcatcagcagcgagaactacctgatcatcggcggccgggaccagcagcagaatgagatcatcgtgaagcgctacctgacccctggggacatctacgtgcatgctgacctgcacggggccaccagctgtgtgatcaagaaccccactggagagcccatcccccccaggaccctgacagaagctggcaccatggccctgtgctacagcgctgcctgggatgcccgggtcatcaccagcgcctggtgggtgtaccaccaccaggtgtccaagacagcccccaccggggagtacctgaccaccggcagcttcatgatccggggcaagaagaacttcctgcccccatcctacctgatgatgggcttctccttcctgttcaaggtggatgagagctgtgtgtggaggcaccagggcgagaggaaggtgcgggtgcaggatgaggacatggagaccctggccagctgcaccagcgagctgatcagcgaggagatggagcagctggatggaggagacaccagcagtgatgaggacaaggaggagcacgagacccctgtggaggtggagctgatgacccaggtggaccaggaggacatcaccctgcagagcggcagagatgagctgaatgaggagctgatccaggaggagagcagtgaagatgaaggagaatatgaggaggtgaggaaggaccaggacagcgtgggggagatgaaggatgaaggagaggagaccctgaactacccagacaccaccatcgacctgagccacctgcagccccagaggagcatccagaagctggccagcaaggaggagagcagcaacagcagtgacagcaagagccagagcagaagacacctgagcgccaaggagcggcgggagatgaagaagaagaagctgcccagcgacagcggggacctggaggccctggagggcaaggacaaggagaaggagagcacagtgcacatcgagacccaccagaacaccagcaagaatgtggccgctgtgcagcccatgaagaggggccagaagagcaagatgaagaagatgaaggagaagtacaaggaccaggatgaagaagatcgggagctgatcatgaagctgctgggcagcgctggcagcaacaaggaggagaagggcaagaagggcaagaagggcaagaccaaggatgagcctgtgaagaagcagccccagaagccccggggcggccagagggtgtctgacaacatcaagaaggagacccccttcctggaggtgatcacccatgagctgcaggactttgctgtggatgacccccatgatgacaaggaggagcaggacctggaccagcagggcaatgaggagaacctgtttgacagcctgaccggccagccccacccagaagatgtgctgctgtttgccatccccatctgtgccccctacaccaccatgaccaactacaagtacaaggtgaagctgaccccaggagtgcagaagaagggcaaggccgccaagacagccctgaacagcttcatgcacagcaaggaggccacagcccgggagaaggacctcttccgctctgtgaaggacacagacctgagcaggaacatccctgggaaggtgaaggtgtctgcccccaacctgctgaatgtgaagaggaagtag

SEQ ID NO: 40417 - DNA, 3168 bp, Artificial Sequence
  Description of Artificial Sequence: Synthetic coding sequence
atgaagagccgcttcagcaccatcgacctgcgggctgtgctggccgagctgaatgccagcctgctgggcatgagggtgaacaacgtgtatgatgtggacaacaagacctacctgatccggctgcagaagccagacttcaaggccaccctgctgctggagagcggcatccgcatccacaccacagaatttgagtggcccaagaacatgatgcccagcagctttgccatgaagtgcaggaagcacctgaagagccggcggctggtgtctgccaagcagctgggcgtggaccgcatcgtggacttccagtttggaagtgatgaggccgcctaccacctgatcatcgagctgtatgaccggggcaacatcgtgctgacagattatgaatatgtgatcctgaacatcctgcgcttcagaacagatgaagcagatgatgtgaagtttgctgtgcgggagcgctaccccctggaccacgcccgggctgctgagcccctgctgaccctggagcggctgacagaaattgtggccagcgcccccaagggggagctgctgaagagggtgctgaaccccctgctgccctacggccctgccctgattgagcactgcctgctggagaatggcttctctggaaatgtgaaggtggatgagaagctggagaccaaggacatcgagaaggtgctggtgtccctgcagaaggccgaggactacatgaagaccaccagcaacttcagcggcaagggctacatcatccagaagcgggagatcaagcccagcctggaggccgacaagcctgtggaggacatcctgacctatgaggagttccaccccttcctgttcagccagcacagccagtgcccctacattgaatttgagagctttgacaaggctgtggatgagttctacagcaagattgagggccagaagattgacctgaaggccctgcagcaggagaagcaggccctgaagaagctggacaacgtgaggaaggaccatgaaaatcggctggaggccctgcagcaggcccaggagattgacaagctgaagggggagctgattgagatgaacctgcagatcgtggaccgggccatccaggtggtgcgcagcgccctggccaaccagattgactggacagagatcggcctgattgtgaaggaggcccaggcccagggcgaccctgtggccagcgccatcaaggagctgaagctgcagaccaaccacgtgaccatgctgctgaggaacccctacctgctgtctgaggaggaggatgatgatgtggatggagatgtgaatgtggagaagaatgaaacagagccccccaagggcaagaagaagaagcagaagaacaagcagctgcagaagccccagaagaacaagcccctgctggtggatgtggacctgagcctgagcgcctatgccaatgccaagaagtactatgaccacaagagatatgctgccaagaagacccagaagacagtggaggccgctgagaaggccttcaagtctgctgagaagaagaccaagcagaccctgaaggaggtgcagacagtgaccagcatccagaaggccaggaaggtgtactggtttgagaagttcctgtggttcatcagcagcgagaactacctgatcatcggcggccgggaccagcagcagaatgagatcatcgtgaagcgctacctgaccccaggagagcccatcccccccaggaccctgacagaggccggcaccatggccctgtgctacagcgctgcctgggatgcccgggtcatcaccagcgcctggtgggtgtaccaccaccaggtgtccaagacagcccccactggagagtacctgaccaccggcagcttcatgatccggggcaagaagaacttcctgccccccagctacctgatgatgggcttctccttcctgttcaaggtggatgagagctgtgtgtggaggcaccagggcgagaggaaggtgcgggtgcaggatgaggacatggagaccctggccagctgcaccagcgagctgatcagcgaggagatggagcagctggatggaggagacaccagcagtgatgaggacaaggaggagcacgagacccctgtggaggtggagctgatgacccaggtggaccaggaggacatcaccctgcagagcggcagagatgagctgaatgaggagctgatccaggaggagagcagtgaagatgaaggagaatatgaggaggtgaggaaggaccaggacagcgtgggggagatgaaggatgaaggagaggagaccctgaactacccagacaccaccatcgacctgagccacctgcagccccagaggagcatccagaagctggccagcaaggaggagagcagcaacagcagtgacagcaagagccagagccgccgccacctgagcgccaaggagcggcgggagatgaagaagaagaagctgcccagcgacagcggggacctggaggccctggagggcaaggacaaggagaaggagagcacagtgcacatcgagacccaccagaacaccagcaagaatgtggccgctgtgcagcccatgaagaggggccagaagagcaagatgaagaagatgaaggagaagtacaaggaccaggatgaggaggaccgggagctgatcatgaagctgctgggcagcgctggcagcaacaaggaggagaagggcaagaagggcaagaagggcaagaccaaggatgagcctgtgaagaagcagccccagaagccccggggcggccagagggtgtctgacaacatcaagaaggagacccccttcctggaggtgatcacccatgagctgcaggactttgctgtggatgacccccatgatgacaaggaggagcaggacctggaccagcagggcaatgaggagaacctgtttgacagcctgaccggccagccccacccagaagatgtgctgctgtttgccatccccatctgtgccccctacaccaccatgaccaactacaagtacaaggtgaagctgaccccaggagtgcagaagaagggcaaggccgccaagacagccctgaacagcttcatgcacagcaaggaggccacagcccgggagaaggacctcttccgctctgtgaaggacacagacctgagcaggaacatccctgggaaggtgaaggtgtctgcccccaacctgctgaatgtgaagaggaagtag

SEQ ID NO: 40418 - DNA, 1383 bp, Artificial Sequence
  Description of Artificial Sequence: Synthetic coding sequence
atggccttccagacccaggccggggcccagatccccatcgagcggctggccagcgagcgggccatcaccgtgaaggtgcccaacaacagcgactgggccgcccggggccacaggagcagcgccaacagcgtggtggtgcagccccaggcctctgtgggcgctgtggtgaccctggacagcagcaacccagctgctgtgctgcacctgcagctgaactacaccctgctggatggccgctacctgtctgaggagcctgagccctacctggccgtgtacctgcacagcgagccccggcccaatgagcacaactgcagcgccagccgccgcatccggcctgagagcctgcagggcgctgaccaccggccctacaccttcttcatcagccctggcacccgggaccctgtgggcagctaccgcctgaacctgagcagccacttccggctgagcgccctggaggtgtctgtgggcctgtacaccagcctgtgccagtacttcagcgaggaggatgtggtgtggaggacagagggcctgctgcccctggaggagaccagcccccggcaggccgtgtgcctgaccaggcacctgacagccttcggggccagcctgtttgtgccccccagccacgtgcgctttgtgtttcctgagcccacagcagatgtgaactacatcgtgatgctgacctgtgctgtgtgcctggtgacctacatggtgatggccgccatcctgcacaagctggaccagctggatgccagccggggccgggccatccccttctgtggccagaggggccgcttcaagtatgagagcagcagccggcaggccggggccggggcccaggtgccccggcccacctgggccagctgctgcatgggctggacagctggggccgccaccggcacctggatggccacagagcccagcacagccacagcctggaccagcagcggcagcccccccaggacagcctgggtggcctgtggccgctcagaatgtggcaccaccaagggcagcgccctgcccggcagctgcagcaccagcagcagcggcacctgccgccgccacacagcccccagctcctggagcatgacaggcttccgctggaggagaagacccaccggggcctggtggaggcggcgctgctggccccgggtgacccagccctgctgtgccagcggggcctgctggtggctgagctgcagcgctgccagcctgaccagcaccagcggcagcccctacggcaccggccgcctggtggccgtgtccctggccagccggggccccccagctgccttcagcagcagcgccagctcctgggcccccaccccctgtggcaccggcctgctggtgaccctgcccacagcccggggcatgtgccctggatag

SEQ ID NO: 40419 - DNA, 1332 bp, Artificial Sequence
  Description of Artificial Sequence: Synthetic coding sequence
atgaggctgcgcttctggctgctgatctggctgctgctgggcttcatcagccaccagcccacccctgtgatcaacagcctggccgtgtaccgccaccgggagacagactttggagtgggcgtgcgggaccaccctggccagcacggcaagacccccagcccccagaagctggacaacctgatcatcatcatcatcggcttcctgcggcgggacaccttcaccatcctcttctgcaccagctacctgtgtgtgtccttcctgaagaccatcttctggagcagaaatggacatgatggcagcacagatgtgcagcagagggcctggaggagcaacagaagccggcagaagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaacagacatgacaagatcaatggcaagaggaagacagccaggaagcagaagatgttccagagggcccaggagctgcggaggagagctgaggactaccacaagtgcaagatcccccccagcgccaggaagcccctgtgcaactgggtgaggatggctgctgctgagcaccgccacagcagcggcctgccctgctggccctacctgacagctgaggccctgaagaacaggatgggccggcagcccccaccacccacccagcagcacagcatcacagacaacagcctgagcctgaagaccccacctgagtgcctgctgcaccccctgcccccatctgtggatgacaacatcaaggagtgccccctggcccccctgcccccatctgtggatgacaacctgaaggagtacctgctggtgcccctgccccccagccccctgccccccagcgtggatgacaacctgaaggactgcctgtttgtgcccctgccccccagccccctgcccccatctgtggatgacaacctgaagaccccacccctggccacccaggaggccgaggccgagaagccacccaagcccaagcgctggagggtggatgaggtggagcagagccccaagcccaagagaagaagagcagatgaggtggagcagagccccaagcccaagaggcagcgggaggccgaggcccagcagctgcccaagcccaagagaagaaggctgagcaagctgcggaccaggcactgcacccaggcctgggccatccgcatcaacccctgggtggagaagaagaagaagatcaagaagcagaacaagacccacgcccccaagaccaactag

SEQ ID NO: 40420 - DNA, 1983 bp, Artificial Sequence
  Description of Artificial Sequence: Synthetic coding sequence
atgttccagagggcccaggagctgcggcggcgggcagaggactaccacaagtgcaagatccccccatctgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtctgctgacccccctgccccccagcgcagatgacaacctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgccctgcccagcgccccacccagcgcagatgacaacctgaagaccagggctgagtgcctgctgcaccccctgcccccatctgcagatgacaacctgaagacccccagcgagcggcagctgacccccctgccccccagcgccccacccagcgcagatgacaacatcaagaccccagccttccacccccagaggatgatcagccgccacctgcccagcgtgagcagcctgcccttccacccccagctgcacccccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgctgtctgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 40421 - DNA, 3189 bp, Artificial Sequence
  Description of Artificial Sequence: Synthetic coding sequence
atgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcccctgccccccagcgccccacccagcgcagatgacaacatcaagaccccagctgagcggctgcggggccccctgcccccatctgcagatgacaacctgaagacccccagcgagcggcacatcatgcccttccccagcgcagatgacaacatcaacaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcagccgccacctgcccagcgtgagcagcctgcccttccacccccagctgcacccccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgctgtctgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 40422 - DNA, 2547 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacccccagcagatgatcatcagccgccacctgcccagcgtgtgtggcggccgcttccacccccagcccatgatcatcagccgccacctgcccagcgtgagcagcctgcccttccacccccagctgcacccccagcagatgatcatcagccgccacctgctgtctgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 40423 - DNA, 2949 bp, Artificial Sequence
  Description of Artificial Sequence: Synthetic coding sequence
atgttccagagggcccaggagctgcggcggcgggcagaggactaccacaagtgcaagatccccccatctgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtctgctgacccccctgccccccagcgcagatgacaacctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgccctgcccagcgccccacccagcgcagatgacaacctgaagaccagggctgagtgcctgctgcaccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagaggaggacccccctgcccccatctgcccctccttctgcagatgacaacatcaagaccccagctgagcggctgcggggccccctgccccccagcgcagatgacaacctgaagaccccatctgagcggcacatcatgcccccacccagcgcagatgacaacatcaacaccccagctgagcggctgcggggccccctgcccccatctgcagatgacaacctgaagacccccagcgagcggcagctgacccccctgccccccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagatcccagctgagcggctgcgcatccccctgcccccatctgcagatgacaacctgaagacccccagcgagcggcagctgacccccctgccccccagcgccccacccagcgcagatgacaacatcaagaccccaggcttccaccctgagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 40424 - DNA, 1263 bp, Artificial Sequence
  Description of Artificial Sequence: Synthetic coding sequence
atggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 40425 - DNA, 462 bp, Artificial Sequence
  Description of Artificial Sequence: Synthetic coding sequence
atggctgctgtggagcaccgccacagcagcggcctgccctactggccctacctgacagctgagaccctgaagaacaggatgggccaccagcccccaccacccacccagcagcacagcatcatcgacaacagcctgagcctgaagaccccatctgaatgtgtgctgtaccccctgcccccatctgcagatgacaacctgaagaccccaccagaatgtctgctgacccccctgccccccagcgccctgcccagcgcagatgacaacctgaagaccccagctgagtgcctgctgtaccccctgcccccatctgcagatgacaacctgaagaccccaccagaatgtctgctgacccccctgccccccagcgccccacccagcgcagatgacaacctgaagaccccaccagaatgtgtgtgcagcctgcccttccacccccagaggatgatcatcagcaggaactag

SEQ ID NO: 40426 - DNA, 528 bp, Artificial Sequence
  Description of Artificial Sequence: Synthetic coding sequence
atgaaggtgaccaccaaggtgaacagacatgacaagatcaacgggaagaggaagacagccaaggagcacctgaggaagctgtccatgaaggagcgggagcaccgggaggaggagcggcaggtgtctgaggccgaggagaatggcaagctggacatgaaggagatccacacctacatggagatgttccagagggcccaggccctgcggcggcgggcagaggactactaccgctgcaagatcaccccatctgccaggaagcccctgtgcaacagagtgtccctgctggtgttcctggccttcggccacagcctgcccggccaggacatggacaccttcttcagcctgcggctgtgtgcccaggccctgcagcgggagatggccgagaggaaggccgcctacaagcaccacagccccatccctgtgggcaactgtgtggcccagaagcacctgcacccccaccctgtgggcccccccagcaacatcctgtctgtgcggggctctgtgtttgtgattgccaacggcccctag

SEQ ID NO: 40427 - DNA, 1062 bp, Artificial Sequence
  Description of Artificial Sequence: Synthetic coding sequence
atgaggctgcgcttctggctgctgatctggctgctgctgggcttcatcagccaccagcccacccctgtgtccttcctgaagaccatcttctggagcagaaatggacatgatggctccatggatgtgcagcagagggcctggaggagcaacagaagccggcagaagggcctgcggagcatctgcatgcacaccaagaagagggtgagcagcttccggggcaacaagattggcctgaaggatgtgatcaccctgcggagacatgtggagaccaaggtgcgggccaagatcaggaagaggaaggtgaccaccaagatcaacagacatgacaagatcaacgggaagaggaagacagccaggaagcagaagatgttccagagggcccaggagctgcggcggcgggcagaggactaccacaagtgcaagatccccccatctgccaggaagcccctgtgcaactgggtgaggatggctgctgctgagcaccgccacagcagcggcctgccctactggctgtacctgacagctgagaccctgaagaacaggatgggccggcagcccccaccacccacccagcagcacagcatcacagacaacagcctgagcctgaagaccccaccagaatgtctgctgacccccctgccccccagcgtggatgacaacatcaaggaatgtcccctggcccccctgccccccagccccctgcccccatctgtggatgacaacctgaaggagtgcctgtttgtgcccctgccccccagccccctgccccccagcgtggatgacaacctgaaggaatgtctgtttgtgcccctgccccccagccccctgcccccatctgtggatgacaacctgaagaccccacccctggccacccaggaggccgaggtggagaagccacccaagcccaagcgctggagggtggatgaggtggagcagagccccaagcccaagaggcagcgggaggccgaggcccagcagctgcccaagcccaagagaagaaggctgagcaagctgcggaccaggcactgcacccaggcctgggccatccgcatcaacccctag

SEQ ID NO: 40428 - DNA, 294 bp, Artificial Sequence
  Description of Artificial Sequence: Synthetic coding sequence
atggaggccccagctgagcgggccctgccccggctgcaggccctggcccggcccccaccacccatctcctatgaggaggagctgtatgactgcctggactactactacctgcgggacttccctgcctgtggggccggccgcagcaaaggaagaacaagaagagagcaggccctgcggaccaactggccagcccctgggggccacgagaggaaggtggcccagaagctgctgaatggccagaggaagaggcggcagaggcagctgcaccccaagatgaggacccggctgacctag

SEQ ID NO: 40429 - DNA, 1845 bp, Artificial Sequence
  Description of Artificial Sequence: Synthetic coding sequence
atgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcagatgtag

SEQ ID NO: 40430 - DNA, 1845 bp, Artificial Sequence; identical to SEQ ID NO: 40429
  Description of Artificial Sequence: Synthetic coding sequence

SEQ ID NO: 40431 - DNA, 1845 bp, Artificial Sequence; identical to SEQ ID NO: 40429
  Description of Artificial Sequence: Synthetic coding sequence

SEQ ID NO: 40432 - DNA, 1209 bp, Artificial Sequence
  Description of Artificial Sequence: Synthetic coding sequence
atgccccacagcgctgggggcacagctggggtgggcctggaggccgctgagcccacagccctgctgaccagggctgagcccccatctgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttccgccgcagcgtcatcaagggggcccactacatctgccacagcggcggccactgccccatggacacctacatgaggaggaagtgccaggagtgccgcctgaggaagtgccggcaggccggcatgagagaagaatgtgtgctgtctgaggagcagatccggctgaagaagctgaagaggcaggaggaggagcaggcccacgccaccagcctgcccccccgggccagcagccccccccagatcctgccccagctgagccctgagcagctgggcatgattgagaagctggtggccgcccagcagcagtgcaacagaagaagcttcagtgaccggctgcgggtgaccccctggcccatggccccagacccccacagccgggaggcccggcagcagagatttgcccacttcacagagctggccatcgtgtctgtgcaggagatcgtggactttgccaagcagctgcccggcttcctgcagctgagccgggaggaccagatcgccctgctgaagaccagcgccatcgaggtgatgctgctggagaccagccgccgctacaaccctggcagcgagagcatcaccttcctgaaggacttctcctacaacagagaagattttgccaaggccggcctgcaggtggagttcatcaaccccatctttgagttcagccgggccatgaatgagctgcagctgaatgatgctgagtttgccctgctgattgccatcagcatcttctctgctgaccggcccaacgtgcaggaccagctgcaggtggagcggctgcagcacacctacgtggaggccctgcacgcctacgtgtccatccaccacccccatgaccggctgatgttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 40433 - DNA, 1164 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttcagaagaagtgtcatcaagggggcccactacatctgccacagcggcggccactgccccatggacacctacatgaggaggaagtgccaggagtgccgcctgaggaaatgtcggcaggccggcatgagggaggagtgtgtgctgtctgaggagcagatccggctgaagaagctgaagaggcaggaggaggagcaggcccacgccaccagcctgcccccccgggccagcagccccccccagatcctgccccagctgagccctgagcagctgggcatgattgagaagctggtggccgcccagcagcagtgcaacagaagaagcttcagtgaccggctgcgggtgacagtgatgctgctggagaccagccgccgctacaaccctggcagcgagagcatcaccttcctgaaggacttctcctacaaccgggaggactttgccaaggccggcctgcaggtggagttcatcaaccccatctttgagttcagccgggccatgaatgagctgcagctgaatgatgctgagtttgccctgctgattgccatcagcatcttctctgctgaccggcccaacgtgcaggaccagctgcaggtggagcggctgcagcacacctacgtggaggccctgcacgcctacgtgtccatccaccacccccatgaccggctgatgttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 40434 - DNA, 1164 bp, Artificial Sequence; identical to SEQ ID NO: 40433
  Description of Artificial Sequence: Synthetic coding sequence

SEQ ID NO: 40435 - DNA, 609 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttcagaagaagtgtcatcaagggggcccactacatctgccacagcggcggccactgccccatggacacctacatgaggaggaagtgccaggagtgccgcctgaggaaatgtcggcaggccggcatgagggaggagtgtgtgctgtctgaggagcagatccggctgaagaagctgaagaggcaggaggaggagcaggcccacgccaccagcctgcccccccgggccagcagccccccccagatctag

SEQ ID NO: 40436 - DNA, 207 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgacctag

SEQ ID NO: 40437 - DNA, 1344 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttcagaagaagtgtcatcaagggggcccactacatctgccacagcggcggccactgccccatggacacctacatgaggaggaagtgccaggagtgccgcctgaggaaatgtcggcaggccggcatgagggaggagtgtgtgctgtctgaggagcagatccggctgaagaagctgaagaggcaggaggaggagcaggcccacgccaccagcctgcccccccgggccagcagccccccccagatcctgccccagctgagccctgagcagctgggcatgattgagaagctggtggccgcccagcagcagtgcaacagaagaagcttcagtgaccggctgcgggtgaccccctggcccatggccccagacccccacagccgggaggcccggcagcagagatttgcccacttcacagagctggccatcgtgtctgtgcaggagatcgtggactttgccaagcagctgcccggcttcctgcagctgagccgggaggaccagatcgccctgctgaagaccagcgccatcgaggtgatgctgctggagaccagccgccgctacaaccctggcagcgagagcatcaccttcctgaaggacttctcctacaaccgggaggactttgccaaggccggcctgcaggtggagttcatcaaccccatctttgagttcagccgggccatgaatgagctgcagctgaatgatgctgagtttgccctgctgattgccatcagcatcttctctgctgaccggcccaacgtgcaggaccagctgcaggtggagcggctgcagcacacctacgtggaggccctgcacgcctacgtgtccatccaccacccccatgaccggctgatgttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 40438 - DNA, 585 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttcagaagaagtgtcatcaagggggcccactacatctgccacagcggcggccactgccccatggacacctacatgaggaggaagtgccaggagtgccgcctgaggaaatgtcggcaggccggcatgagggaggagtgtgtgctgtctgaggagcagatccggctgaagaagctgaagaggcaggaggaggagcaggcccacgccaccagcctgcccccatag

SEQ ID NO: 40439 - DNA, 618 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacagagatccggccccagaagaggaagaagggccctgcccccaagatgctgggcaatgagctgtgcagcgtgtgtggggacaaggccagcggcttccactacaacgtgctgagctgtgagggctgcaagggcttcttcagaagaagtgtcatcaagggggcccactacatctgccacagcggcggccactgccccatggacacctacatgaggaggaagtgccaggagtgccgcctgaggaaatgtcggcaggccggcatgagggaggagtgtgtgctgtctgaggagcagatccggctgaagaagctgaagaggcaggaggaggagcaggcccacgccaccagcctgcccccccgggccagcagccccccccagatcctgccccagtag

SEQ ID NO: 40440 - DNA, 234 bp, Artificial Sequence
  Description of Artificial Sequence: Synthetic coding sequence
atgagcctgtggctgggcgcccctgtgcctgacatccccccagacagcgctgtggagctgtggaagccaggggcccaggatgccagcagccaggcccagggcggcagcagctgcatcctgcgggaggaggccaggatgccccacagcgctgggggcacagctggggtgggcctggaggccgctgagcccacagccctgctgaccagggctgagccccccagcgagcccacctag

SEQ ID NO: 40441 - DNA, 1344 bp, Artificial Sequence; identical to SEQ ID NO: 40437
  Description of Artificial Sequence: Synthetic coding sequence

SEQ ID NO: 40442 - DNA, 1881 bp, Artificial Sequence
  Description of Artificial Sequence: Synthetic coding sequence
atgtgcagcaccctgaagaagtgtggcacctacagaacagaggtggctgaatgtcatgaccacggcagcaccttccagggcaggaagaagggcggcagcagcttccgggacaactttgacaagaggagctgccactatgagcacggcggctatgagcggccccccagccactgccaggagaatgatggctctgtggagatgagagatgtgcacaaggaccagcagctgcggcacaccccctacagcatccgctgtgaaagaaggatgaagtggcacagtgaagatgagatccgcatcaccacctggaggaacaggaagcccccagagaggaagatgagccagaacacccaggacggctacaccaggaactggttcaaggtgaccatcccctacggcatcaagtatgacaaggcctggctgatgaacagcatccagagccactgcagcgaccgcttcacccctgtggacttccactacgtgaggaacagagcctgcttctttgtgcaggatgccagcgctgccagcgccctgaaggatgtgtcctacaagatctatgatgatgagaaccagaagatctgcatctttgtgaaccacagcacagccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcattgaaagaaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagtactacagcatctatgattctggggaccggcagggcctgctgggcgcctaccatgatgaggcctgcttcagcctggccatcccctttgaccccaaggacagcgcccccagcagcctgtgcaagtactttgaggacagcaggaacatgaagaccctgaaggacccctacctgaagggggagctgctgcggaggaccaagagggacatcgtggacagcctgagcgccctgcccaagacccagcacgacctgagcagcatcctggtggatgtgtggtgccagacagagaggatgctgtgcttctctgtgaatggagtcttcaaggaggtggagggccagagccagggctctgtgctggccttcaccaggaccttcatcgccaccccaggcagcagcagcagcctgtgcatcgtgaatgatgagctgtttgtgagagatgccagcccccaggagacccagagcgccttcagcatccctgtgtccaccctgagcagcagcagcgagcccagcctgagccaggagcagcaggagatggtgcaggccttcagcgcccagagcggcatgaagctggagtggagccagaagtgcctgcaggacaatgagtggaactacacccgggccggccaggccttcaccatgctgcagacagagggcaagatcccagctgaggccttcaagcagatctcctag

SEQ ID NO: 40443 - DNA, 1881 bp, Artificial Sequence; identical to SEQ ID NO: 40442
  Description of Artificial Sequence: Synthetic coding sequence

SEQ ID NO: 40444 - DNA, 471 bp, Artificial Sequence
  Description of Artificial Sequence: Synthetic coding sequence
atggtggacatcctgggggagcggcacctggtgacctgcaagggggccaccgtggaggccgaggccgccctgcagaacaaggtggtggccctgtactttgctgctgcccgctgtgcccccagccgggacttcacccccctgctgtgtgacttctacacagccctggtggccgaggcccggcggcctgccccctttgaggtggtgtttgtgtctgcagatggcagcagccaggagatgctggacttcatgagggagctgcatggagcctggctggccctgcccttccatgacccctacagacatgagctgaggaagcgctacaacgtgacagccatccccaagctggtgattgtgaagcagaatggagaggtgatcaccaacaagggcaggaagcagatccgggagcggggcctggcctgcttccaggactgggtggaggccgctgacatcttccagaacttctctgtgtag

SEQ ID NO: 40445 - DNA, 408 bp, Artificial Sequence
  Description of Artificial Sequence: Synthetic coding sequence
atggtggacatcctgggggagcggcacctggtgacctgcaagggggccaccgtggaggccgaggccgccctgcagaacaaggtggtggccctgtactttgctgctgcccgctgtgcccccagccgggacttcacccccctgctgtgtgacttctacacagccctggtggccgaggcccggcggcctgccccctttgaggtggtgtttgtgtctgcagatggcagcagccaggagatgctggacttcatgagggagctgcatggagcctggctggccctgcccttccatgacccctaccggcagaggagcctggccctgctgccccggctggagtgcagcggggtcatcctggcccactgcaacctgtgcctgctgggcagcagtgacagcctggccctggccagctag

SEQ ID NO: 40446 - DNA, 687 bp, Artificial Sequence
  Description of Artificial Sequence: Synthetic coding sequence
atggcccggcacgtgttcctgaccggccccccaggagtgggcaagaccaccctcatccacaaggccagcgaggtgctgaagagcagtggagtgcctgtggatggcttctacacagaggaggtgcggcagggcggccgccgcatcggctttgatgtggtgaccctgagcggcacccggggccccctgagccgggtgggcctggagcccccacctgggaagagagaatgtcgggtgggccagtatgtggtggacctgaccagctttgagcagctggccctgcctgtgctgagaaatgctgactgcagcagcggccctggccagagggtgtgtgtgattgatgaaattggcaagatggagctgttcagccagctgttcatccaggccgtgcggcagaccctgagcaccccaggcaccatcatcctgggcaccatccctgtgcccaagggcaagcccctggccctggtggaggagatccggaacaggaaggatgtgaaggtgttcaacagcccctactgtgtgattgaggaccagagcaagttcagcagctgtgtgtcccagagcaccctgacagagcccggctggaggcagaagctgctgcagagcctgctgaacagcgagtggaagaagagggcccctgtggtgcccacctctgtgagcccccccttctacctgcgctggatcccctag

SEQ ID NO: 40447 - DNA, 573 bp, Artificial Sequence
  Description of Artificial Sequence: Synthetic coding sequence
atggcccggcacgtgttcctgaccggccccccaggagtgggcaagaccaccctcatccacaaggccagcgaggtgctgaagagcagtggagtgcctgtggatggcttctacacagaggaggtgcggcagggcggccgccgcatcggctttgatgtggtgaccctgagcggcacccggggccccctgagccgggtgggcctggagcccccacctgggaagagagaatgtcgggtgggccagtatgtggtggacctgaccagctttgagcagctggccctgcctgtgctgagaaatgctgactgcagcagcggccctggccagagggtgtgtgtgattgatgaaattggcaagatggagctgttcagccagctgttcatccaggccgtgcggcagaccctgagcaccccaggcaccatcatcctgggcaccatccctgtgcccaagggcaagcccctggccctggtggaggagatccggaacaggaaggatgtgaaggtgttcaacgtgaccaaggagaacagaaaccacctgctgcctgacatcgtgacctgtgtgcagagcagcaggaagtag

SEQ ID NO: 40448 - DNA, 324 bp, Artificial Sequence
  Description of Artificial Sequence: Synthetic coding sequence
atgatggagggcctgggggagcacagcacagctggggagatgggccccctgctgggcgctgtggccgccacagccagcccccagagcctgatggagtacagcagtgatgctgacttcatcgagagcctgcccctggtggtgaagtacagagtgtacaccctgaagaagctgcaggccaagtgtgctgtgctggaggccaagtacctgcgggagttccacagcgtggagaggaagtttgccaccatctacggccccctgctggagaagaggcggcagatcaccaatgccctgtatgagcccaccaaggaggagtgtgaaagatag

SEQ ID NO: 40449 - DNA, 3042 bp, Artificial Sequence
  Description of Artificial Sequence: Synthetic coding sequence
atgtgcagccaggaggccttccaggcccagaggagccagctggtggagctgctggtgtctggcagcctggagggctttgagagcgtgctggactggctgctgtcctgggaggtgctgtcctgggaggactatgagggcttccacctgctgggccagcccctgagccacctggcccggcggctgctggacacagtgtggaacaagggcacctgggcctgccagaagctgattgctgctgcccaggaggcccaggccgacagccagagccccaagctgcacggctgctgggacccccacagcctgcacccagcccgggacctgcagagccacaggcctgccatcgtgcggcggctgcacagccacgtggagaacatgctggacctggcctgggagcggggctttgtgtcccagtatgaatgtgatgagatccggctgcccatcttcacccccagccagagggcccggcggctgctggacctggccaccgtgaaggccaacggcctggccgccttcctgctgcagcacgtgcaggagctgcctgtgcccctggccctgcccctggaggccgccacctgcaagaagtacatggccaagctgcggaccaccgtgtctgcccagagccgcttcctgagcacctatgatggagctgagaccctgtgcctggaggacatctacacagaaaatgtgctggaggtgtgggcagatgtgggcatggccggccccccccagaagagccctgccaccctgggcctggaggagctgttcagcaccccaggccacctgaatgatgatgctgacacagtgctggtggtgggggaggccggcagcggcaagagcaccctgctgcagaggctgcacctgctgtgggccgccggccaggacttccaggagttcctgtttgtgttccccttcagctgccggcagctgcagtgcatggccaagcccctgtctgtgaggaccctgctgtttgagcactgctgctggccagatgtgggccaggaggacatcttccagctgctgctggaccacccagacagagtgctgctgacctttgatggctttgatgagttcaagttccgcttcacagaccgggagcggcactgcagccccacagaccccacctctgtgcagaccctgctcttcaacctgctgcagggcaacctgctgaagaatgccaggaaggtggtgaccagcaggcctgctgctgtgtctgccttcctgaggaagtacatcagaacagagttcaacctgaagggcttcagcgagcagggcatcgagctgtacctgaggaagaggcaccacgagcccggggtggccgacaggctcatccggctgctgcaggagaccagcgccctgcacggcctgtgccacctgcctgtgttctcctggatggtgtccaagtgccaccaggagctgctgctgcaggagggcggcagccccaagaccaccacagacatgtacctgctgatcctgcagcacttcctgctgcacgccaccccaccagattctgccagccagggcctgggccccagcctgctgcggggccgcctgcccaccctgctgcacctgggccgcctggccctgtggggcctgggcatgtgctgctacgtgttttctgcccagcagctgcaggccgcccaggtgtccccagatgacatcagcctgggcttcctggtgcgggccaagggcgtggtgcccggcagcacagcccccctggagttcctgcacatcaccttccagtgcttctttgctgccttctacctggccctgtctgcagatgtgcccccagccctgctgcggcacctgttcaactgtggccggcccggcaacagccccatggcccggctgctgcccaccatgtgcatccaggccagcgagggcaaggacagctctgtggccgccctgctgcagaaggccgagccccacaacctgcagatcacagctgccttcctggccggcctgctgagccgggagcactggggcctgctggccgagtgccagaccagcgagaaggccctgctgcggcggcaggcctgtgcccgctggtgcctggcccggagcctgaggaagcacttccacagcatccccccagctgcccctggagaggccaagtctgtgcacgccatgcctggcttcatctggctgatccgcagcctgtatgagatgcaggaggagcggctggccaggaaggccgcccggggcctgaatgtgggccacctgaagctgaccttctgcagcgtgggccccacagaatgtgccgccctggcctttgtgctgcagcacctgcggcggcctgtggccctgcagctggactacaacagcgtgggggacatcggcgtggagcagctgctgccctgcctgggcgtgtgcaaggccctgtacctgcgggacaacaacatcagtgaccggggcatctgcaagctgattgaatgtgccctgcactgtgagcagctgcagaagctggccctcttcaacaacaagctgacagatggctgtgcccacagcatggccaagctgctggcctgccggcagaacttcctggccctgcggctgggcaacaactacatcacagctgctggggcccaggtgctggccgagggcctgcggggcaacaccagcctgcagttcctgggcttctggggcaacagagtgggagatgagggcgcccaggccctggccgaggccctgggggaccaccagagcctgcgctggctgagcctggtgggcaacaacatcggctctgtgggcgcccaggccctggccctgatgctggccaagaatgtgatgctggaggagctgtgcctggaggagaaccacctgcaggatgagggcgtgtgcagcctggccgagggcctgaagaagaacagcagcctgaagatcctgaagctgagcaacaactgcatcacctacctgggcgctgaggccctgctgcaggccctggagagaaatgacaccatcctggaggtgtggctgcggggcaacaccttcagcctggaggaggtggacaagctgggctgccgggacacccggctgctgctgtag

SEQ ID NO: 40450 - DNA, 441 bp, Artificial Sequence
  Description of Artificial Sequence: Synthetic coding sequence
atgtgcagccaggaggccttccaggcccagaggagccagctggtggagctgctggtgtctggcagcctggagggctttgagagcgtgctggactggctgctgtcctgggaggtgctgtcctgggaggactatgagggcttccacctgctgggccagcccctgagccacctggcccggcggctgctggacacagtgtggaacaagggcacctgggcctgccagaagctgattgctgctgcccaggaggcccaggccgacagccagagccccaagctgcacggctgctgggacccccacagcctgcacccagcccgggacctgcagagccacaggcctgccatcgtgcggcggctgcacagccacgtggagaacatgctggacctggcctgggagcggggctttgtgtcccagtatgaatgtgatgagatccggctgccctag

SEQ ID NO: 40451 - DNA, 1752 bp, Artificial Sequence
  Description of Artificial Sequence: Synthetic coding sequence
atggaggtggccgccaactgcagcctgcgggtgaagaggcccctgctggaccccaggtttgagggctacaagctgagcctggagcccctgccctgctaccagctggagctggatgctgctgtggccgaggtgaagctgagagatgaccagtacaccctggagcacatgcacgccttcggcatgtacaactacctgcactgtgacagctggtaccaggacagcgtgtactacatcgacaccctgggccgcatcatgaacctgactgtgatgctggacacagccctgggcaagccccgggaggtgttccggctgcccacagacctgacagcctgtgacaaccggctgtgtgccagcatccacttcagcagcagcacctgggtgaccctgagtgatggcaccggccgcctgtatgtgattggaactggagagcggggcaacagcgccagcgagaagtgggagatcatgtttaatgaggagctgggggaccccttcatcatcatccacagcatcagcctgctgaatgctgaggagcacagcatcgccaccctgctgctgagaattgagaaggaggagctggacatgaagggcagcggcttctacgtgtccctggagtgggtgaccatcagcaagaagaaccaggacaacaagaagtatgagatcatcaagagggacatcctgcggggcaagtctgtgccccactatgctgccattgaaccagatggaaatggcctgatgattgtgtcctacaagagcctgacctttgtgcaggccggccaggacctggaggagaacatggatgaggacatcagcgagaagatcaaggagcccctgtactactggcagcagacagaagatgacctgactgtgaccatccggctgcctgaggacagcaccaaggaggacatccagatccagttcctgcctgaccacatcaacatcgtgctgaaggaccaccagttcctggagggcaagctgtacagcagcattgaccacgagagcagcacctggatcatcaaggagagcaacagcctggagatcagcctcatcaagaagaatgaaggcctgacctggccagagctggtgattggagacaagcagggcgagctgatccgggacagcgcccagtgtgccgccatcgccgagcggctgatgcacctgaccagcgaggagctgaaccccaacccagacaaggagaagccaccctgcaatgcccaggagctggaggagtgtgacatcttctttgaggagagcagcagcctgtgccgctttgatggcaacaccctgaagaccacccacgtggtgaacctgggcagcaaccagtacctgttcagcgtcatcgtggaccccaaggagatgccctgcttctgcctgcggcatgatgtggatgccctgctgtggcagccccacagcagcaagcaggatgacatgtgggagcacatcgccaccttcaatgccctgggctacgtgcaggccagcaagagggacaagaagttctttgcctgtgcccccaactacagctatgctgccctgtgtgagtgcctgcggcgggtcttcatctaccggcagcctgcccccatgagcacagtgctgtacaacaggaaggagggccggcaggtgggccaggtggccaagcagcaggtggccagcctggagaccaatgaccccatcctgggcttccaggccaccaatgaaaggctgtttgtgctgaccaccaagaacctcttcctgatcaaggtgaacacagagaactag

SEQ ID NO: 40452 - DNA, 1665 bp, Artificial Sequence
  Description of Artificial Sequence: Synthetic coding sequence
atgctgtacctgcagggctggagcatgcctgctgtggccgaggtgaagctgagagatgaccagtacaccctggagcacatgcacgccttcggcatgtacaactacctgcactgtgacagctggtaccaggacagcgtgtactacatcgacaccctgggccgcatcatgaacctgactgtgatgctggacacagccctgggcaagccccgggaggtgttccggctgcccacagacctgacagcctgtgacaaccggctgtgtgccagcatccacttcagcagcagcacctgggtgaccctgagtgatggcaccggccgcctgtatgtgattggcaccggggagcggggcaacagcgccagcgagaagtgggagatcatgtttaatgaggagctgggggaccccttcatcatcatccacagcatcagcctgctgaatgctgaggagcacagcatcgccaccctgctgctgcgcatcgagaaggaggagctggacatgaagggcagcggcttctacgtgtccctggagtgggtgaccatcagcaagaagaaccaggacaacaagaagtatgagatcatcaagagggacatcctgcggggcaagtctgtgccccactacgccgccatcgagccagatggaaatggcctgatgattgtgtcctacaagagcctgacctttgtgcaggccggccaggacctggaggagaacatggatgaggacatcagcgagaagatcaaggagcccctgtactactggcagcagacagaagatgacctgactgtgaccatccggctgcctgaggacagcaccaaggaggacatccagatccagttcctgcctgaccacatcaacatcgtgctgaaggaccaccagttcctggagggcaagctgtacagcagcattgaccacgagagcagcacctggatcatcaaggagagcaacagcctggagatcagcctcatcaagaagaatgaaggcctgacctggccagagctggtgattggagacaagcagggcgagctgatccgggacagcgcccagtgtgccgccatcgccgagcggctgatgcacctgaccagcgaggagctgaaccccaacccagacaaggagaagccaccctgcaatgcccaggagctggaggagtgtgacatcttctttgaggagagcagcagcctgtgccgctttgatggcaacaccctgaagaccacccacgtggtgaacctgggcagcaaccagtacctgttctctgtgattgtggaccccaaggagatgccctgcttctgcctgcggcatgatgtggatgccctgctgtggcagccccacagcagcaagcaggatgacatgtgggagcacatcgccaccttcaatgccctgggctacgtgcaggccagcaagagggacaagaagttctttgcctgtgcccccaactacagctatgctgccctgtgtgaatgtctgcggcgggtcttcatctaccggcagcctgcccccatgagcacagtgctgtacaacaggaaggagggccggcaggtgggccaggtggccaagcagcaggtggccagcctggagaccaatgaccccatcctgggcttccaggccaccaatgaaagactctttgtgctgaccaccaagaacctcttcctgatcaaggtgaacacagaaaattag

SEQ ID NO: 40453 - DNA, 474 bp, Artificial Sequence
  Description of Artificial Sequence: Synthetic coding sequence
atgtctgccccctttgaggagaggtctggagtggtgccctgtggcaccccctggggccagtggtaccagaccctggaggaggtgttcatcgaggtgcaggtgcccccaggcacccgggcccaggacatccagtgtggcctgcagagcagacatgtggccctgtctgtgggcggccgggagatcctgaagggcaagctgtttgacagcaccatcgcagatgagggcacctggaccctggaggacaggaagatggtgagaattgtgctgaccaagaccaagagagatgctgccaactgctggaccagcctgctggagagtgaatatgctgctgacccctgggtgcaggaccagatgcagaggaagctgaccctggagcgcttccagaaggagaaccctggctttgacttctctggagctgagatcagcggcaactacaccaagggcggccctgacttcagcaacctggagaagtag

SEQ ID NO: 40454 - DNA, 1086 bp, Artificial Sequence
  Description of Artificial Sequence: Synthetic coding sequence
atggagactggagctgctgagctgtatgaccaggccctgctgggcatcctgcagcacgtgggcaatgtgcaggacttcctgcgggtgctgtttggcttcctgtacaggaagacagacttctaccgcctgctgcggcaccccagcgacaggatgggcttccccccaggagctgcccaggccctggtgctgcaggtgttcaagacctttgaccacatggcccggcaggatgatgagaagaggcggcaggagctggaggagaagatccggaggaaggaggaggaggaggccaagacagtgtctgctgctgctgctgagaaggagcctgtgcctgtgcctgtgcaggagattgaaattgacagcaccacagagctggatggccaccaggaggtggagaaggtgcagcccccaggccctgtgaaggagatggcccacggcagccaggaggccgaggcccctggagctgtggccggggctgctgaggtgccccgggagccccccatcctgccccgcatccaggagcagttccagaagaacccagacagctacaatggagctgtgcgggagaactacacctggagccaggactacacagacctggaggtgcgggtgcctgtgcccaagcacgtggtgaagggcaagcaggtgtctgtggccctgagcagcagcagcatccgggtggccatgctggaggagaatggagagcgggtgctgatggagggcaagctgacccacaagatcaacacagagagcagcctgtggagcctggagcctggaaaatgtgtgctggtgaacctgagcaaggtgggggagtactggtggaatgccatcctggagggggaggagcccattgatattgacaagatcaacaaggagaggtccatggccaccgtggatgaggaggagcaggccgtgctggaccggctgacctttgactaccaccagaagctgcagggcaagccccagagccatgagctgaaggtgcatgagatgctgaagaagggctgggatgctgagggcagccccttccggggccagagatttgatcctgccatgttcaacatcagccctggagctgtgcagttctag

SEQ ID NO: 40455 - DNA, 495 bp, Artificial Sequence
  Description of Artificial Sequence: Synthetic coding sequence
atgaagtgcaagcccaaccagaccaggacctatgaccctgagggcttcaagaagagagctgcctgcctgtgcttccgctctgagcgggaggatgaggtgctgctggtgagcagcagccgctacccagaccgctggatcgtgcctgggggcggcatggagcctgaggaggagcccggcggcgctgctgtgcgggaggtgtatgaggaggccggcgtgaagggcaagctgggccgcctgctgggcgtgtttgagcagaaccaggaccccaagcacaggacctacgtgtatgtgctgactgtgacagagctgctggaggactgggaggacagcgtgtccattggaaggaagcgggagtggttcaaggtggaggatgccatcaaggtgctgcagtgccacaagcctgtgcatgctgagtacctggagaagctgaagctgggcggcagccccaccaatggaaacagcatggcccccagcagcccagacagcgacccctag

SEQ ID NO: 40456 - DNA, 495 bp, Artificial Sequence
  Description of Artificial Sequence: Synthetic coding sequence
atgacagccagcgcccagccccggggccggcggcctggggtgggcgtgggcgtggtggtgaccagctgcaagcacccccgctgtgtgctgctgggcaagaggaaaggatctgtgggcgccggcagcttccagctgcccggcggccacctggagtttggagagacctgggaggagtgtgcccagcgggagacctgggaggaggccgccctgcacctgaagaatgtgcactttgcctctgtggtgaacagcttcatcgagaaggagaactaccactacgtgaccatcctgatgaagggggaggtggatgtgacccatgattctgagcccaagaatgtggagcctgagaagaatgaatcctgggagtgggtgccctgggaggagctgccccccctggaccagctgttctggggcctgcgctgcctgaaggagcagggctatgaccccttcaaggaggacctgaaccacctggtgggctacaagggcaaccacctgtag

SEQ ID NO: 40457 - DNA, 987 bp, Artificial Sequence
  Description of Artificial Sequence: Synthetic coding sequence
atggccgaggtgcgggtgcagctgctgctgagccggcggcctgagagcgtgtcctttgcccggtctgtgtgtggcctgctgggcgccggccctggcctgggcacctggcccatccactgcagcctgaagaggggccgcctggtgctgagcagccggcccttccctggggccagcgcccggctgcccctgcagaggcctcccttctgcccctttgctgccctggaggagcggccccgggtgcctggagctgagctgcccacagaccggggcgtggacctgggcgtggccgtcatcctgcagagcagtgacaagacagtgctgctgacccggcgggcccggaccctgtctgtgagccccaacctgtgggtgcccccaggcggccacgtggagctggaggaggagctgctggatggcggcctgcgggagctgtgggaggagagcggcctgcacctgccccagggccagttctcctgggtgcccctgggcctgtgggagagcgcctacccaccccggctgtcctggggcctgcccaagtaccaccacatcgtgctgtacctgctggtgatcagccaggagagccagcagcagctgcaggcccgcatccagcccaaccccaatgaggtgtctgccctgatgtggctgaccccagatgtggccgctgctgtggccgctgctgaagatggaacagagaccccaggcctgctgccccaggacctgccccccagcgtgctggccgtggagctggaggaggatggccgggcccggcccctggtgctgcacatgagcaccctgctgaggatgatccccaccatggccgaggacaaggagcgggtgtccacaggcaccaagtttgccctgaagctgtggctgcagcacctgggccgcaccccaccaccctgcaagtctgctgcctacctggaccccggccctgccaaggaggagtggaacatggaccccctgccccccaaccagggcagcggcaagtag

SEQ ID NO: 40458 - DNA, 555 bp, Artificial Sequence
  Description of Artificial Sequence: Synthetic coding sequence
tgagctgtgatcctgcagagcagtgacaagacagtgctgctgacccggcgggcccggaccctgtctgtgagccccaacctgtgggtgcccccaggcggcctgcgggagctgtgggaggagagcggcctgcacctgccccagggccagttctcctgggtgcccctgggcctgtgggagagcgcctacccaccccggctgtcctggggcctgcccaagtaccaccacatcgtgctgtacctgctggtgatcagccaggagagccagcagcagctgcaggcccgcatccagcccaaccccaatgaggtgtctgccctgatgtggctgaccccagatgtggccgctgctgtggccgctgctgaagatggaacagagaccccaggcctgctgcccaggacccggggcggctggaagagccccaccagcggccctgcccacgtgcaccccccagcagatgaccccaaccacggccggggccagcgggagagccagcactggaaccaggtgtgcccccaggccctggccgccaccagcggccagaacacccccaccgtgtag

SEQ ID NO: 40459 - DNA, 972 bp, Artificial Sequence
  Description of Artificial Sequence: Synthetic coding sequence
atggccagcgagggcctggccggggccctggcctctgtgctggccggccagggcagctctgtgcacagctgtgacagcgccccagctggggagcccccagcccctgtgcggctgaggaagaatgtgtgctacgtggtgctggccgtgttcctgtctgagcaggatgaggtgctgctgatccaggaggccaagcgggagtgccggggctcctggtacctgcctgctggccgcatggagcccggggagaccatcgtggaggccctgcagcgggaggtgaaggaggaggccggcctgcactgtgagcctgagaccctgctgtctgtggaggagcggggccccagctgggtgcgctttgtgttcctggcccggcccactggaggcatcctgaagaccagcaaggaggctgatgctgagagcctgcaggccgcctggtaccccaggaccagcctgcccacccccctgcgggcccatgacatcctgcacctggtggagctggccgcccagtaccggcagcaggcccggcaccccctcatcctgccccaggagctgccctgtgacctggtgtgccagaggctggtggccaccttcaccagcgcccagacagtgtgggtgctggtgggcaccgtgggcatgccccacctgcctgtgacagcctgtggcctggaccccatggagcagaggggcggcatgaagatggctgtgctgcggctgctgcaggagtgcctgaccctgcaccacctggtggtggagatcaagggcctgctgggcctgcagcacctgggccgggaccacagtgatggcatctgcctgaatgtgctggtgacagtggccttccgcagccctggcatccaggatgagccccccaaggtgagaggagagaacttctcctggtggaaggtgatggaggaggacctgcagagccagctgctgcagaggctgcagggcagctctgtggtgcctgtgaacagatag

SEQ ID NO: 40460 - DNA, 180 bp, Artificial Sequence
  Description of Artificial Sequence: Synthetic coding sequence
atggccagcgagggcctggccggggccctggcctctgtgctggccggccagggcagctctgtgcacagctgtgacagcgccccagctggggagcccccagcccccagggctggctgcggccgcacctgtgccacctggtgctggccctgcagcagcgccagcaggatgcgctgctactag

SEQ ID NO: 40461 - DNA, 741 bp, Artificial Sequence
  Description of Artificial Sequence: Synthetic coding sequence
atggagcctggagagaccatcgtggaggccctgcagcgggaggtgaaggaggaggccggcctgcactgtgagcctgagaccctgctgtctgtggaggagcggggccccagctgggtgcgctttgtgttcctggcccggcccaccggcggcatcctgaagaccagcaaggaggctgatgctgagagcctgcaggccgcctggtaccccaggaccagcctgcccacccccctgcgggcccatgacatcctgcacctggtggagctggccgcccagtaccggcagcaggcccggcaccccctcatcctgccccaggagctgccctgtgacctggtgtgccagaggctggtggccaccttcaccagcgcccagacagtgtgggtgctggtgggcaccgtgggcatgccccacctgcctgtgacagcctgtggcctggaccccatggagcagagaggaggcatgaagatggctgtgctgcggctgctgcaggagtgcctgaccctgcaccacctggtggtggagatcaagggcctgctgggcctgcagcacctgggccgggaccacagtgatggcatctgcctgaatgtgctggtgacagtggccttccgcagccctggcatccaggatgagccccccaaggtgcggggggagaacttctcctggtggaaggtgatggaggaggacctgcagagccagctgctgcagaggctgcagggcagctctgtggtgcctgtgaacagatag

SEQ ID NO: 40462 - DNA, 1128 bp, Artificial Sequence
  Description of Artificial Sequence: Synthetic coding sequence
atgagcagcagcctgcggcccggccccagccgctggaggagagctgccagcatcgtgctggccgccggctggagcaggcctgagacagccaccccacccagccggcccccacctgctgagggcttccggctgctgctgctgcagaggagcccccaccagggcttcatgcctggggcccacgtgttttctggaggagtgctggatgctgctgacagatctgctgactggctgggcctgtttgccccccaccacggcccccccaggtttggcctgggccctgcccccttcagcaggacagccttccccagcctgcctgacacagatgaccacaagacagacaacacaggcaccctgcctgaagatgtggccttccgcatctgtgctgtgcgggaggcctttgaggaggccggcgtgctgctgctgcggcccaggaccagccccccaggccctgcccctggccctggcctggccctggagcccccacctggcctggcctcctggagggacagagtgcggcaggaccccaggcacttcctgcggctgtgtgcccacctggactgcaccccagacatctgggccctgcacaactggagcgcctggctgacccccttcctgcggggcaccaccaggagatttgacacagccttcttcctgtgctgcctgcgggagcccccacctgtgtacccagacctggccgaggtggtgggctaccagtggagcagccccagcgaggccacagagagcttcctgagcaaggagatctggctgcccccaccccagttctatgaggtgcggcggctggccaactttgccagcctgagtgacctgcacaagttctgcctgggccgggccctggagggcctggagcgctggctgcccatcatcctgctgacagcagatggcatggtgcacctgctgcctggagatgagctgtacctggaggacagcgacttcctggagaacctgatgagcacagagaagaagacagaggagatcatgaaggagggcaagcagttccaccgcatcgtgacctaccaccgccacctgtatgacatccacgtgacagtgcagcccaagtacaagcacgtgtaccccaagaacagcgtggtgaggaagagccacctgtag

SEQ ID NO: 40463 - DNA, 912 bp, Artificial Sequence
  Description of Artificial Sequence: Synthetic coding sequence
atggaccctgaggtgaccctgctgctgcagtgccctgggggcggcctgccccaggagcagatccaggccgagctgagccctgcccatgacagaagacccctgcctggaggagatgaggccatcacagccatctgggagacccggctgaaggcccagccctggctgtttgatgcccccaagttccggctgcacagcgccaccctggcccccatcggcagccggggcccccagctgctgctgcggctgggcctgaccagctacagagacttcctgggcaccaactggagcagcagcgctgcctggctgcggcagcagggcgccacagactggggagacacccaggcctacctggccgaccccctgggcgtgggcgccgccctggccacagcagatgacttcctggtgttcctgcggcgcagccggcaggtggccgaggcccctggcctggtggatgtgcctgggggccaccctgagccccaggccctgtgccctgggggcagcccccagcaccaggacctggccggccagctggtggtgcatgagctgttcagctctgtgctgcaggagatctgtgatgaggtgaacctgcccctgctgaccctgagccagcccctgctgctgggcatcgccagaaatgagaccagcgctggccgggccagcgctgagttctacgtgcagtgcagcctgaccagcgagcaggtgaggaagcactacctgagcggcggccctgaggcccacgagagcacaggcatcttctttgtggagacccagaatgtgcagaggctgctggagacagagatgtgggccgagctgtgccccagcgccaagggggccatcatcctgtacaacagagtgcagggcagccccaccggggccgccctgggcagccctgccctgctgccccccctgtag

SEQ ID NO: 40464 - DNA, 813 bp, Artificial Sequence
  Description of Artificial Sequence: Synthetic coding sequence
atggaccctgaggtgaccctgctgctgcagtgccctgggggcggcctgccccaggagcagatccaggccgagctgagccctgcccatgacagaagacccctgcctggaggagatgaggccatcacagccatctgggagacccggctgaaggcccagccctggctgtttgatgcccccaagttccggctgcacagcgccaccctggcccccatcggcagccggggcccccagctgctgctgcggctgggcctgaccagctacagagacttcctgggcaccaactggagcagcagcgctgcctggctgcggcagcagggcgccacagactggggagacacccaggcctacctggccgaccccctgggcgtgggcgccgccctggccacagcagatgacttcctggtgttcctgcggcgcagccggcaggtggccgaggcccctggcctggtggatgtgcctgggggccaccctgagccccaggtgaacctgcccctgctgaccctgagccagcccctgctgctgggcatcgccagaaatgagaccagcgctggccgggccagcgctgagttctacgtgcagtgcagcctgaccagcgagcaggtgaggaagcactacctgagcggcggccctgaggcccacgagagcacaggcatcttctttgtggagacccagaatgtgcagaggctgctggagacagagatgtgggccgagctgtgccccagcgccaagggggccatcatcctgtacaacagagtgcagggcagccccactggagctgccctgggcagccctgccctgctgccccccctgtag

SEQ ID NO: 40465 - DNA, 639 bp, Artificial Sequence
  Description of Artificial Sequence: Synthetic coding sequence
atggaccctgaggtgaccctgctgctgcagtgccctgggggcggcctgccccaggagcagatccaggccgagctgagccctgcccatgacagaagacccctgcctggaggagatgaggccatcacagccatctgggagacccggctgaaggcccagccctggctgtttgatgcccccaagttccggctgcacagcgccaccctggcccccatcggcagccggggcccccagctgctgctgcggctgggcctgaccagctacagagacttcctgggcaccaactggagcagcagcgctgcctggctgcggcagcagggcgccacagactggggagacacccaggcctacctggccgaccccctgggcgtgggcgccgccctggccacagcagatgacttcctggtgttcctgcggcgcagccggcaggtggccgaggcccctggcctggtggatgtgcctgggggccaccctgagccccaggtgcgcttccaggccggccacaaggaccctgacagcagccgggagctgcagctgagcaccctgcccatcctgcctgccctggtgagcagcctgaagggcaagctggcctggtacttcagcggcagcctgctgcgggctgtgcacctgcccccccactag

SEQ ID NO: 40466 - DNA, 375 bp, Artificial Sequence
  Description of Artificial Sequence: Synthetic coding sequence
atggaccctgaggtgaccctgctgctgcagtgccctgggggcggcctgccccaggagcagatccaggccgagctgagccctgcccatgacagaagacccctgcctggaggagatgaggccatcacagccatctgggagacccggctgaaggcccagccctggctgtttgatgcccccaagttccggctgcacagcgccaccctggcccccatcggcagccggggcccccagctgctgctgcggctgggcctgaccagctacagagacttcctgggcaccaactggagcagcagcgctgcctggctgcggcagcagggcgccacagactggggagacacccaggcctacctggccgaccccctgggcgtgggctag

SEQ ID NO: 40467 - DNA, 546 bp, Artificial Sequence
  Description of Artificial Sequence: Synthetic coding sequence
atgatgaagttcaagcccaaccagaccaggacctatgaccgggagggcttcaagaagagagctgcctgcctgtgcttccgctctgagcaggaggatgaggtgctgctggtgagcagcagccgctacccagaccagtggatcgtgcctgggggcggcatggagcctgaggaggagcctggaggagctgctgtgcgggaggtgtatgaggaggccggcgtgaagggcaagctgggccgcctgctgggcatctttgagcagaaccaggacaggaagcacaggacctacgtgtatgtgctgactgtgacagagatcctggaggactgggaggacagcgtgaacatcggcaggaagcgggagtggttcaaggtggaggatgccatcaaggtgctgcagtgccacaagcctgtgcacgccgagtacctggagaagctgaagctgggctgcagccctgccaacggcaacagcacagtgcccagcctgcctgacaacaatgccctgtttgtgacagctgcccagaccagcggcctgcccagctctgtgaggtag

SEQ ID NO: 40468 - DNA, 543 bp, Artificial Sequence
  Description of Artificial Sequence: Synthetic coding sequence
atgatgaagttcaagcccaaccagaccaggacctatgaccgggagggcttcaagaagagagctgcctgcctgtgcttccgctctgagcaggaggatgaggtgctgctggtgagcagcagccgctacccagaccagtggatcgtgcctgggggcggcatggagcctgaggaggagcctggaggagctgctgtgcgggaggtgtatgaggaggccggcgtgaagggcaagctgggccgcctgctgggcatctttgagaaccaggacaggaagcacaggacctacgtgtatgtgctgactgtgacagagatcctggaggactgggaggacagcgtgaacattggaaggaagcgggagtggttcaaggtggaggatgccatcaaggtgctgcagtgccacaagcctgtgcatgctgagtacctggagaagctgaagctgggctgcagccctgccaatggaaacagcacagtgcccagcctgcctgacaacaatgccctgtttgtgacagctgcccagaccagcggcctgcccagctctgtgaggtag

SEQ ID NO: 40469 - DNA, 390 bp, Artificial Sequence
  Description of Artificial Sequence: Synthetic coding sequence
atggagcctgaggaggagcctggaggagctgctgtgcgggaggtgtatgaggaggccggcgtgaagggcaagctgggccgcctgctgggcatctttgagcagaaccaggacaggaagcacaggacctacgtgtatgtgctgactgtgacagagatcctggaggactgggaggacagcgtgaacatcggcaggaagcgggagtggttcaaggtggaggatgccatcaaggtgctgcagtgccacaagcctgtgcacgccgagtacctggagaagctgaagctgggctgcagccctgccaacggcaacagcacagtgcccagcctgcctgacaacaatgccctgtttgtgacagctgcccagaccagcggcctgcccagctctgtgaggtag

SEQ ID NO: 40470 - DNA, 543 bp, Artificial Sequence
  Description of Artificial Sequence: Synthetic coding sequence
atggagagccaggagcccacagagagcagccagaatggcaagcagtacatcatcagcgaggagctgatcagcgagggcaagtgggtgaagctggagaagaccacctacatggaccccaccgggaagaccaggacctgggagagcgtgaagaggaccaccaggaaggagcagacagcagatggagtggccgtcatccctgtgctgcagaggaccctgcactatgaatgtattgtgctggtgaagcagttccggccccccatgggcggctactgcatcgagttccctgctggcctgattgatgatggagagaccccagaggccgccgccctgcgggagctggaggaggagaccggctacaagggggacattgctgaatgttctccagctgtgtgcatggaccccggcctgagcaactgcaccatccacatcgtgacagtgaccatcaatggagatgatgctgaaaatgcccggcccaagcccaagccaggagatggcggcatgttctgcaacagctggtggcccagcgtgtatgacctggtgtag

SEQ ID NO: 40471 - DNA, 699 bp, Artificial Sequence
  Description of Artificial Sequence: Synthetic coding sequence
atggagagccaggagcccacagagagcagccagaatggcaagcagtacatcatcagcgaggagctgatcagcgagggcaagtgggtgaagctggagaagaccacctacatggaccccaccgggaagaccaggaggaacaaggagaagaccaccaccctgctgatcctgcggacctgggagagcgtgaagaggaccaccaggaaggagcagacagcagatggagtggccgtcatccctgtgctgcagaggaccctgcactatgagtgcatcgtgctggtgaagcagttccggccccccatgggcggctactgcatcgagttccctgctggcctgattgatgatggagagaccccagaggccgccgccctgcgggagctggaggaggagaccggctacaagggggacattgctgagtgcagccctgctgtgtgcatggaccccggcctgagcaactgcaccatccacatcgtgacagtgaccatcaatggagatgatgctgaaaatgcccggcccaagcccaagccaggagatggagaatttgtggaggtgatcagcctgcccaagaatgacctgctgcagaggctggatgccctggtggccgaggagcacctgactgtggatgcccgggtgtacagctatgccctggccctgaagcacgccaatgccaagccctttgaggtgcccttcctgaagttctag

SEQ ID NO: 40472 - DNA, 561 bp, Artificial Sequence
  Description of Artificial Sequence: Synthetic coding sequence
atggagagccaggagcccacagagagcagccagaatggcaagcagtacatcatcagcgaggagctgatcagcgagggcaagtgggtgaagctggagaagaccacctacatggaccccaccgggaagaccaggacctgggagagcgtgaagaggaccaccaggaaggagcagacagcagatggagtggccgtcatccctgtgctgcagaggaccctgcactatgaatgtattgtgctggtgaagcagttccggccccccatgggcggctactgcatcgagttccctgctggcctgattgatgatggagagaccccagaggccgccgccctgcgggagctggaggaggagaccggctacaagggggacattgctgaatgttctccagctgtgtgcatggaccccggcctgagcaactgcaccatccacatcgtgacagtgaccatcaatggagatgatgctgaaaatgcccggcccaagcccaagccaggagatggagaatttgtggaggtgatcagcctgcccaagaatgacctgctgcagaggctggatgagaccctgtag

SEQ ID NO: 40473 - DNA, 297 bp, Artificial Sequence
  Description of Artificial Sequence: Synthetic coding sequence
atggagagccaggagcccacagagagcagccagaatggcaagcagtacatcatcagcgaggagctgatcagcgagggcaagtgggtgaagctggagaagaccacctacatggaccccaccgggaagaccaggacctgggagagcgtgaagaggaccaccaggaaggagcagacagcagatggccgcagcgccaacctcttccagcccttcaggaaggaggtgtccacctgtgacagagtggccgtcatccctgtgctgcagaggaccctgcactatgaatgtattgtgctggtgtag

SEQ ID NO: 40474 - DNA, 660 bp, Artificial Sequence
  Description of Artificial Sequence: Synthetic coding sequence
atggagagccaggagcccacagagagcagccagaatggcaagcagtacatcatcagcgaggagctgatcagcgagggcaagtgggtgaagctggagaagaccacctacatggaccccaccgggaagaccaggacctgggagagcgtgaagaggaccaccaggaaggagcagacagcagatggagtggccgtcatccctgtgctgcagaggaccctgcactatgaatgtattgtgctggtgaagcagttccggccccccatgggcggctactgcatcgagttccctgctggcctgattgatgatggagagaccccagaggccgccgccctgcgggagctggaggaggagaccggctacaagggggacattgctgaatgttctccagctgtgtgcatggaccccggcctgagcaactgcaccatccacatcgtgacagtgaccatcaatggagatgatgctgaaaatgcccggcccaagcccaagccaggagatggagaatttgtggaggtgatcagcctgcccaagaatgacctgctgcagaggctggatgccctggtggccgaggagcacctgactgtggatgcccgggtgtacagctatgccctggccctgaagcacgccaatgccaagccctttgaggtgcccttcctgaagttctag

SEQ ID NO: 40475 - DNA, 660 bp, Artificial Sequence; identical to SEQ ID NO: 40474
  Description of Artificial Sequence: Synthetic coding sequence

SEQ ID NO: 40476 - DNA, 717 bp, Artificial Sequence
  Description of Artificial Sequence: Synthetic coding sequence
atgagccggctgggcctgcctgaggagcctgtgaggaacagcctgctggatgatgccaaggcccggctgaggaaatatgacatcggcggcaagtacagccacctgccctacaacaagtacagcgtgctgctgcccctggtggccaaggagggcaagctgcacctgctcttcaccgtgcgctctgagaagctgcggcgggcccctggagaggtgtgcttccctgggggcaagagggaccccacagacatggatgatgctgccacagccctgcgggaggcccaggaggaggtgggcctgcggccccaccaggtggaggtggtgtgctgcctggtgccctgcctgattgacacagacaccctcatcaccccatttgtgggcctgattgaccacaacttccaggcccagcccaacccagctgaggtgaaggatgtgttcctggtgcccctggcctacttcctgcacccccaggtgcatgaccagcactacgtgacccggctgggccaccgcttcatcaaccacatctttgagtacaccaacccagaagatggagtgacctaccagatcaagggcatgacagccaacctggccgtgctggtggccttcatcatcctggagaagaagcccacctttgaggtgcagttcaacctgaatgatgtgctggccagcagcgaggagctgttcctgaaggtgcacaagaaggccaccagccggctgtag

SEQ ID NO: 40477 - DNA, 558 bp, Artificial Sequence
  Description of Artificial Sequence: Synthetic coding sequence
atgagccggctgggcctgcctgaggagcctgtgaggaacagcctgctggatgatgccaaggcccggctgaggaaatatgacatcggcggcaagtacagccacctgccctacaacaagtacagcgtgctgctgcccctggtggccaaggagggcaagctgcacctgctcttcaccgtgcgctctgagaagacagacaccctcatcaccccatttgtgggcctgattgaccacaacttccaggcccagcccaacccagctgaggtgaaggatgtgttcctggtgcccctggcctacttcctgcacccccaggtgcatgaccagcactacgtgacccggctgggccaccgcttcatcaaccacatctttgagtacaccaacccagaagatggagtgacctaccagatcaagggcatgacagccaacctggccgtgctggtggccttcatcatcctggagaagaagcccacctttgaggtgcagttcaacctgaatgatgtgctggccagcagcgaggagctgttcctgaaggtgcacaagaaggccaccagccggctgtag

SEQ ID NO: 40478 - DNA, 513 bp, Artificial Sequence
  Description of Artificial Sequence: Synthetic coding sequence
atgagccggctgggcctgcctgaggagcctgtgaggaacagcctgctggatgatgccaaggcccggctgaggaaatatgacatcggcggcaagtacagccacctgccctacaacaagtacagcgtgctgctgcccctggtggccaaggagggcaagctgcacctgctcttcaccgtgcgctctgagaagctgcggcgggcccctggagaggtgtgcttccctgggggcaagagggaccccacagacatggatgatgctgccacagccctgcgggaggcccaggaggaggtgggcctgcggccccaccaggtggaggtggtgtgctgcctggtgccctgcctgattgaccgctggggcagccgctacgtggatgaggccggcctggagctgctggccagcagtgacccccccaccagcgccagccagagcgctggcatcacagaccgctacatcgacaacagcatctgtggcttcaaccggccccagctgcccggccctgctgagagctgctag

SEQ ID NO: 40479 - DNA, 822 bp, Artificial Sequence
  Description of Artificial Sequence: Synthetic coding sequence
atgaggctgcccggggtgcccctggcccggcctgccctgctgctgctgctgcccctgctggcccccctgctgggcaccggggccccagctgagctgcgggtgcgggtgcggctgcctgatggccaggtgacagaggagagcctgcaggccgacagtgatgctgacagcatcagcctggagctgaggaagccagatggcaccctggtgtccttcaccgctgacttcaagaaggatgtgaaggtgttccgggccctgatcctgggggagctggagaagggccagagccagttccaggccctgtgctttgtgacccagctgcagcacaatgagatcatccccagcgaggccatggccaagctgcggcagaagaaccccagggctgtgcggcaggccgaggaggtgcggggcctggagcacctgcacatggatgtggccgtgaacttcagccagggcgccctgctgagcccccacctgcacaacgtgtgtgccgaggccgtggatgccatctacacccggcaggaggatgtgcgcttctggctggagcagggcgtggacagctctgtgtttgaggccctgcccaaggccagcgagcaggccgagctgccccgctgccggcaggtgggggaccacggcaagccctgtgtgtgccgctatggcctgagcctggcctggtacccctgcatgctgaagtactgccacagccgggaccggcccaccccctacaagtgtggcatccgcagctgccagaagagctacagctttgacttctacgtgccccagaggcagctgtgcctgtgggatgaggacccctacccaggatag

SEQ ID NO: 40480 - DNA, 2205 bp, Artificial Sequence
  Description of Artificial Sequence: Synthetic coding sequence
atgaggcctgctgtgctgggcagcccagaccgggcccccccagaagatgagggccctgtgatggtgaagctggaggacagcgaggaggagggggaggccgccctgtgggaccccggccctgaggccgcccggctgcgcttccgctgcttccgctatgaggaggccaccggcccccaggaggccctggcccagctgcgggagctgtgccggcagtggctgcggcctgaggtgcgcagcaaggagcagatgctggagctgctggtgctggagcagttcctgggcgccctgcccccagagatccaggcccgggtgcagggccagaggcctggcagccctgaggaggccgccgccctggtggatggcctgcggcgggagcccggcggcccccggcgctgggtgacagtgcaggtgcagggccaggaggtgctgtctgagaagatggagcccagcagcttccagcccctgcctgagacagagccccccaccccagagcccggccccaagaccccacccaggaccatgcaggagagccccctgggcctgcaggtgaaggaggagagcgaggtgacagaagattctgacttcctggagagcggccccctggccgccacccaggagagcgtgcccaccctgctgcctgaggaggcccagagatgtggcaccgtgctggaccagatcttcccccacagcaagacaggccctgagggccccagctggagggagcacccccgggccctgtggcatgaggaggccggcggcatcttcagccctggctttgccctgcagctgggcagcatctctgctggccctggctctgtgagcccccacctgcacgtgccctgggacctgggcatggccggcctgagcggccagatccagagccccagccgggagggcggctttgcccacgccctgctgctgcccagcgacctgcggtctgagcaggaccccacagatgaggacccctgccggggcgtgggccctgccctgatcaccacccgctggaggagcccccggggccgcagccggggccggcccagcactggaggaggagtggtgcggggcggccgctgtgatgtgtgtgggaaggtgttcagccagaggagcaacctgctgcggcaccagaagatccacactggagagcggccctttgtgtgcagtgaatgtggccgctccttcagccgcagcagccacctgctgcggcaccagctgacccacacagaggagcggccctttgtgtgtggggactgtggccagggctttgtgcgcagcgcccggctggaggagcacagaagagtgcacactggagagcagcccttccgctgtgccgagtgtggccagagcttccggcagaggagcaacctgctgcagcaccagaggatccacggggaccccccaggccctggggccaagcccccagcccctcctggggcccctgagcccccaggccccttcccctgcagtgaatgtcgggagagctttgcccggcgggctgtgctgctggagcaccaggccgtgcacactggagacaagagctttggctgtgtggagtgtggggagcgcttcggccgccgctctgtgctgctgcagcaccggcgggtgcacagcggggagcggccctttgcctgtgctgaatgtggccagagcttccggcagaggagcaacctgacccagcaccggcgcatccacactggagagcggccctttgcctgtgctgaatgtgggaaggccttccggcagaggcccaccctgacccagcacctgcgggtgcacactggagagaagccctttgcctgcccagaatgtggccagcgcttcagccagaggctgaagctgaccaggcaccagaggacccacactggagagaagccctaccactgtggagaatgtggcctgggcttcacccaggtgtcccggctgacagagcaccagaggatccacactggagagcggccctttgcctgcccagaatgtggccagagcttccggcagcacgccaacctgacccagcaccggcgcatccacactggagagcggccctatgcctgcccagaatgtgggaaggccttccggcagaggcccaccctgacccagcacctgcggacccaccggcgggagaagccctttgcctgccaggactgtggccgccgcttccaccagagcaccaagctgatccagcaccagagggtgcacagcgctgagtag

SEQ ID NO: 40481 - DNA, 135 bp, Artificial Sequence
  Description of Artificial Sequence: Synthetic coding sequence
atgggcatgtacccacccctgctgctgaagatctacctgagccgccacatcagcatcctcttctacctgaagatcctgtacaagagcggcatcatctggctgtcctggtacagcttcatcctgctggtgctgtag

SEQ ID NO: 40482 - DNA, 957 bp, Artificial Sequence
  Description of Artificial Sequence: Synthetic coding sequence
atggagcggggggaccagcccaagaggaccagaaatgaaaacatcttcaactgcctgtacaagaaccctgaggccaccttcaagctgatctgcttcccctggatgggcggcggcagcacccactttgccaagtggggccaggacacccatgacctgctggaggagacagccagccaccacgtggccaaggccggcctgaagctgcggcgcagcagtgaccccccagccagcgcctacccctgtgccggcgtgagccacagaagaagagagcccccctgcctggccaagatcctgggcctcttctggatcctgatcttcttcatgcacagcctgcggctgcccggccgggagagccgggtggaggagcccctggagaatgacatcagccagctggtggatgaggtggtgtgtgccctgcagcctgtgatccaggacaagccctttgccttcttcggccacagcatgggcagctacatcgccttcagaacagccctgggcctgaaggagaacaaccagcctgagcccctgcacctgttcctgagcagcgccacccctgtgcacagcaaggcctggcaccgcatccccaaggatgatgagctgtctgaggagcagatcagccactacctgatggagtttggaggcacccccaagcactttgctgaggccaaggagtttgtgaagcagtgcagccccatcatccgggctgacctgaacatcgtgcgcagctgcaccagcaatgtgcccagcaaggctgtgctgagctgtgacctgacctgctttgtgggcagcgaggacatcgccaaggacatggaggcctggaaggatgtgaccagcggaaatgccaagatctaccagctgcccggcggccacttctacctgctggaccctgccaatgagaagctgatcaagaactacatcatcaagtgcctggaggtgagcagcatcagcaacttctag

SEQ ID NO: 40483 - DNA, 414 bp, Artificial Sequence
  Description of Artificial Sequence: Synthetic coding sequence
atggagcggggggaccagcccaagaggacccggcaggccaccccctgtgccaccaggctcttcctgcacccccggggcagtgacaccctgcccctgaatgaaaacatcttcaactgcctgtacaagaaccctgaggccaccttcaagctgatctgcttcccctggatgggcggcggcagcacccactttgccaagtggggccaggacacccatgacctgctggaggtgcacagcctgcggctgcccggccgggagagccgggtggaggagcccctggagaatgacatcagccagctggtggatgaggtggtgtgtgccctgcagcctgtgatccaggacaagccctttgccttcttcggccaccgctacctgatctctgtgctgaaggacttccggggcgtgagcagcatctag

SEQ ID NO: 40484 - DNA, 798 bp, Artificial Sequence
  Description of Artificial Sequence: Synthetic coding sequence
atggagcggggggaccagcccaagaggaccagaaatgaaaacatcttcaactgcctgtacaagaaccctgaggccaccttcaagctgatctgcttcccctggatgggcggcggcagcacccactttgccaagtggggccaggacacccatgacctgctggaggtgcacagcctgcggctgcccggccgggagagccgggtggaggagcccctggagaatgacatcagccagctggtggatgaggtggtgtgtgccctgcagcccgtcatccaggacaagccctttgccttcttcggccacagcatgggcagctacatcgccttcagaacagccctgggcctgaaggagaacaaccagcctgagcccctgcacctgttcctgagcagcgccacccctgtgcacagcaaggcctggcaccgcatccccaaggatgatgagctgtctgaggagcagatcagccactacctgatggagtttggaggcacccccaagcactttgctgaggccaaggagtttgtgaagcagtgcagccccatcatccgggctgacctgaacatcgtgcgcagctgcaccagcaatgtgcccagcaaggctgtgctgagctgtgacctgacctgctttgtgggctctgaagatattgccaaggacatggaggcctggaaggatgtgaccagcggaaatgccaagatctaccagctgcccggcggccacttctacctgctggaccctgccaatgagaagctgatcaagaactacatcatcaagtgcctggaggtgagcagcatcagcaacttctag

SEQ ID NO: 40485 - DNA, 291 bp, Artificial Sequence
  Description of Artificial Sequence: Synthetic coding sequence
atggagcggggggaccagcccaagaggaccagaaatgaaaacatcttcaactgcctgtacaagaaccctgaggccaccttcaagctgatctgcttcccctggatgggcggcggcagcacccactttgccaagtggggccaggacacccatgacctgctggaggagacagccagccaccacgtggccaaggccggcctgaagctgcggcgcagcagtgaccccccagccagcgcctacccctgtgccggcgtgagccacagaagaagagagcccccctgcctggccaagtag

SEQ ID NO: 40486 - DNA, 432 bp, Artificial Sequence
  Description of Artificial Sequence: Synthetic coding sequence
atggagcggggggaccagcccaagaggaccagaaatgaaaacatcttcaactgcctgtacaagaaccctgaggccaccttcaagctgatctgcttcccctggatgggcggcggcagcacccactttgccaagtggggccaggacacccatgacctgctggaggtgcacagcctgcggctgcccggccgggagagccgggtggaggagcccctggagaatgacatcagccagctggtggatgaggtggtgtgtgccctgcagcccgtcatccaggacaagccctttgccttcttcggccacagcatgggcagctacatcgccttcagaacagccctgggcctgaaggagaacaaccagcctgagcccctgcacctgttcctgagcagcgccacccctgtgcacagcaaggcctggcaccgcatccccaagtag

SEQ ID NO: 40487 - DNA, 546 bp, Artificial Sequence
  Description of Artificial Sequence: Synthetic coding sequence
atggagcggggggaccagcccaagaggaccagaaatgaaaacatcttcaactgcctgtacaagaaccctgaggccaccttcaagctgatctgcttcccctggatgggcggcggcagcacccactttgccaagtggggccaggacacccatgacctgctggaggtgcacagcctgcggctgcccggccgggagagccgggtggaggagcccctggagaatgacatcagccagctggtggatgaggtggtgtgtgccctgcagcccgtcatccaggacaagccctttgccttcttcggccacagcatgggcagctacatcgccttcagaacagccctgggcctgaaggagaacaaccagcctgagcccctgcacctgttcctgagcagcgccacccctgtgcacagcaaggcctggcaccgcatccccaaggatgatgagctgtctgaggagcagatcagccactacctgatggagtttggaggcacccccaagcactttgctgaggccaaggagtttgtgaagcagtgcagccccatcatcagatag

SEQ ID NO: 40488 - DNA, 957 bp, Artificial Sequence
  Description of Artificial Sequence: Synthetic coding sequence
atggctgctgctgccctgcccccccggcccctgctgctgctgcccctggtgctgctgctgagcggccggcccaccagggctgacagcaaggtgtttggagacctggaccaggtgaggatgaccagcgagggcagtgactgccgctgcaagtgcatcatgaggcccctgagcaaggatgcctgcagccgggtgcgcagcggccgggcccgggtggaggacttctacacagtggagaccgtgagcagcggcacagactgccgctgcagctgcacagccccacccagcagcctgaacccctgtgaaaatgagtggaagatggagaagctgaagaagcaggcccctgagctgctgaagagcatcaaggccaacctgagcagagaaaatgaggtggtgaaggacagcgtgcgccacctgtctgagcagctgcggcactatgagaaccacagcgccatcatgctgggcatcaagaaggagctgagccggctgggcctgcagctgctgcagaaggatgctgctgctgccccagccaccccagccaccggcaccggcagcaaggcccaggacacagcccggggcaagggcaaggacatcagcaaatatggctctgtgcagaagagctttgctgaccggggcctgcccaagccacccaaggagaagctgctgcaggtggagaagctgaggaaggagagcggcaagggcagcttcctgcagcccacagccaagccccgggccctggcccagcagcaggccgtcatccggggcttcacctactacaaggccggcaagcaggaggtgacagaggccgtggccgacaacaccctgcagggcacctcctggctggagcagctgccccccaaggtggagggccgcagcaacagcgctgagcccaacagcgctgagcaggatgaggccgagcccaggagcagcgagcgggtggacctggccagcggcacctag

SEQ ID NO: 40489 - DNA, 987 bp, Artificial Sequence
  Description of Artificial Sequence: Synthetic coding sequence
atgaagctgtggatggagagccacctgattgtgcctgagacccggcccagccccaggatgatgagcaaccagaccctggtgacagagttcatcctgcagggcttcagcgagcaccctgagtacagagtcttcctgttcagctgcttcctgttcctgtacagcggggccctgactggaaatgtgctgatcaccctggccatcaccttcaaccctggcctgcacgcccccatgtacttcttcctgctgaacctggccaccatggacatcatctgcaccagcagcatcatgcccaaggccctggccagcctggtgtctgaggagagcagcatctcctatggaggctgcatggcccagctgtacttcctgacctgggccgccagcagcgagctgctgctgctgactgtgatggcctatgacagatatgctgccatctgccaccccctgcactacagctccatgatgagcaaggtgttctgcagcggcctggccacagctgtgtggctgctgtgtgctgtgaacacagccatccacacaggcctgatgctgcggctggacttctgtggccccaacgtcatcatccacttcttctgtgaggtgccccccctgctgctgctgagctgcagcagcacctacgtgaatggagtgatgattgtgctggctgatgccttctacggcatcgtgaacttcctgatgaccatcgccagctatggcttcatcgtgagcagcatcctgaaggtgaagacagcctggggccggcagaaggccttcagcacctgcagcagccacctgactgtggtgtgcatgtactacacagctgtgttctacgcctacatcagccctgtgtctggctacagcgctgggaagagcaagctggccggcctgctgtacacagtgctgagccccaccctgaaccccctcatctacaccctgaggaacaaggaggtgaaggccgccctgaggaagctgttccccttcttcagaaattag

SEQ ID NO: 40490 - DNA, 903 bp, Artificial Sequence
  Description of Artificial Sequence: Synthetic coding sequence
atgggccagaaccagaccagcatcagtgacttcctgctgctgggcctgcccatccagcctgagcagcagaacctgtgctacgccctcttcctggccatgtacctgaccaccctgctgggcaacctgctgatcatcgtgctgatccggctggacagccacctgcacacccctgtgtacctgttcctgagcaacctgtccttcagtgacctgtgcttcagctctgtgaccatgcccaagctgctgcagaacatgcagaaccaggaccccagcatcccctatgctgactgcctgacccagatgtacttcttcctgtacttcagtgacctggagagcttcctgctggtggccatggcctatgaccgctacgtggccatctgcttccccatgcactacacagccatcatgagccccatgctgtgcctgtctgtggtggccctgtcctgggtgctgaccaccttccacgccatgctgcacaccctgctgatggcccggctgtgcttctgtgccgacaacgtcatcccccacttcttctgtgacatgtctgccctgctgaagctggcctgcagcgacaccagggtgaatgagtgggtgatcttcatcatgggcggcctcatcctggtgatccccttcctgctgatcctgggcagctatgcccgcatcgtgagcagcatcctgaaggtgcccagcagcaagggcatctgcaaggccttcagcacctgtggcagccacctgtctgtggtgtccctcttctatggaacagtgattggcctgtacctgtgccccagcgccaacagcagcaccctgaaggacacagtgatggccatgatgtacacagtggtgacccccatgctgacccccttcatctacagcctgaggaacagagacatgaagggggccctgtag

SEQ ID NO: 40491 - DNA, 948 bp, Artificial Sequence
  Description of Artificial Sequence: Synthetic coding sequence
atggagatcgtgtccactggaaatgagaccatcacagaatttgtgctgctgggcttctatgacatccctgagctgcacttcctgttcttcatcgtgttcaccgctgtgtatgtgttcatcatcatcggcaacatgctgatcatcgtggccgtggtgagcagccagaggctgcacaagcccatgtacatcttcctggccaacctgtccttcctggacatcctgtacaccagcgctgtgatgcccaagatgctggagggcttcctgcaggaggccaccatctctgtggccggctgcctgctgcagttcttcatcttcggcagcctggccacagctgagtgcctgctgctggccgtgatggcctatgaccgctacctggccatctgctaccccctgcactaccccctgctgatgggcccccggcgctacatgggcctggtggtgaccacctggctgagcggctttgtggtggatggcctggtggtggccctggtgacccagctgcgcttctgtggccccaaccacatcgaccagttctactgtgacttcatgctgtttgtgggcctggcctgcagcgacccccgggtggcccaggtgaccaccctcatcctgagcgtcttctgcctgaccatccccttcggcctcatcctgaccagctatgcccgcatcgtggtggccgtgctgcgggtgcctgctggggccagcagaagaagagccttcagcacctgcagcagccacctggccgtggtgaccaccttctacggcaccctgatgatcttctacgtggcccccagcgctgtgcacagccagctgctgagcaaggtgttcagcctgctgtacacagtggtgacccccctcttcaaccctgtgatctacaccatgaggaacaaggaggtgcaccaggccctgaggaagatcctgtgcatcaagcagacagagaccctggactag

SEQ ID NO: 40492 - DNA, 948 bp, Artificial Sequence; identical to SEQ ID NO: 40491
  Description of Artificial Sequence: Synthetic coding sequence

SEQ ID NO: 40493 - DNA, 948 bp, Artificial Sequence; identical to SEQ ID NO: 40491
  Description of Artificial Sequence: Synthetic coding sequence

SEQ ID NO: 40494 - DNA, 924 bp, Artificial Sequence
  Description of Artificial Sequence: Synthetic coding sequence
atgctgaacaccacctctgtgacagagttcctgctgctgggcgtgacagacatccaggagctgcagcccttcctgtttgtggtgttcctgaccatctacttcatctctgtgactggaaatggagctgtgctgatgatcgtcatcagtgacccccggctgcacagcctgatgtacttcttcctgggcaacctgagctacctggacatctgctacagcacagtgaccctgcccaagatgctgcagaacttcctgagcacccacaaggccatctccttcctgggctgcatcagccagctgcacttcttccacttcctgggcagcacagagagcatgctgtttgctgtgatggcctttgacctgtctgtggccatctgcaagcccctgcgctacaccgtcatcatgaacccccagctgtgcacccagatggccatcaccatctgggtgattggcttcttccacgccctgctgcacagcgtgatgaccagccggctgaacttctgtggcagcaaccgcatccaccacttcctgtgtgacatcaagcccctgctgaagctggcctgtggcaacacagagctgaaccagtggctgctgagcacagtgacaggcaccatcgccatgggccccttcttcctgaccctgctgagctacttctacatcatcacctacctgttcttcaagaccaggagctgcagcatgctgtgcaaggccctgagcacctgtgccagccacttcatggtggtgatcctcttctacgcccctgtgctcttcacctacatccacccagccctggagagcttcatggaccaggaccgcatcgtggccatcatgtacacagtggtgacccctgtgctgaaccccctcatctacaccctgaggaacaaggaggtgaagggggccctgggccgggtcatccggcggctgtag

SEQ ID NO: 40495 - DNA, 924 bp, Artificial Sequence; identical to SEQ ID NO: 40494
  Description of Artificial Sequence: Synthetic coding sequence

SEQ ID NO: 40496 - DNA, 924 bp, Artificial Sequence; identical to SEQ ID NO: 40494
  Description of Artificial Sequence: Synthetic coding sequence

SEQ ID NO: 40497 - DNA, 951 bp, Artificial Sequence
  Description of Artificial Sequence: Synthetic coding sequence
atggagaatgtgaccaccatgaatgagttcctgctgctgggcctgactggagtgcaggagctgcagcccttcttcttcggcatcttcctgatcatctacctgatcaacctgattggaaatggcagcatcctggtgatggtggtgctggagccccagctgcacagccccatgtacttcttcctgggcaacctgagctgcctggacatctcctacagctctgtgaccctgcccaagctgctggtgaacctggtgtgcagcagaagagccatctccttcctgggctgcatcatccagctgcacttcttccacttcctgggcagcacagaggccatcctgctggccatcatggcctttgacagatttgtggccatctgcaaccccctgcgctacaccgtcatcatgaacccccaggtgtgcatcctgctggccgctgctgcctggctgatctccttcttctacgccctgatgcacagcgtgatgacagcccacctgtccttctgtggcagccagaagctgaaccacttcttctatgatgtgaagcccctgctggagctggcctgcagcgacaccctgctgaaccagtggctgctgagcatcgtgacaggcagcatctccatgggcgccttcttcctgaccctgctgagctgcttctacgtgattggcttcctgctcttcaagaacagaagctgccgcatcctgcacaaggccctgagcacctgtgccagccacttcatggtggtgtgcctcttctacggccctgtgggcttcacctacatccggcctgccagcgccacctccatgatccaggaccgcatcatggccatcatgtacagcgctgtgacccctgtgctgaaccccctcatctacaccctgaggaacaaggaggtgatgatggccctgaagaagatcttcggcaggaagctgttcaaggactggcagcagcaccactag

SEQ ID NO: 40498 - DNA, 951 bp, Artificial Sequence; identical to SEQ ID NO: 40497
  Description of Artificial Sequence: Synthetic coding sequence

SEQ ID NO: 40499 - DNA, 951 bp, Artificial Sequence; identical to SEQ ID NO: 40497
  Description of Artificial Sequence: Synthetic coding sequence

SEQ ID NO: 40500 - DNA, 951 bp, Artificial Sequence; identical to SEQ ID NO: 40497
  Description of Artificial Sequence: Synthetic coding sequence

SEQ ID NO: 40501 - DNA, 936 bp, Artificial Sequence
  Description of Artificial Sequence: Synthetic coding sequence
atggacaacctgaccaaggtgacagagttcctgctgatggagttcagcggcatctgggagctgcaggtgctgcacgccggcctcttcctgctgatctacctggccgtgctggtgggcaacctgctgatcatcgctgtgatcaccctggaccagcacctgcacacccccatgtacttcttcctgaagaacctgtctgtgctggacctgtgctacatctctgtgacagtgcccaagagcatccggaacagcctgacccggcgcagcagcatctcctacctgggctgtgtggcccaggtgtacttcttcagcgcctttgccagcgctgagctggccttcctgactgtgatgtcctatgacagatatgtggccatctgccaccccctgcagtacagagctgtgatgaccagcggcggctgctaccagatggctgtgaccacctggctgagctgcttctcctatgctgctgtgcacacaggcaacatgttccgggagcacgtgtgccgcagcagcgtcatccaccagttcttccgggacatcccccacgtgctggccctggtgtcctgtgaggtgttctttgtggagttcctgaccctggccctgagcagctgcctggtgctgggctgcttcatcctgatgatgatctcctacttccagatcttcagcacagtgctgcgcatccccagcggccagagccgggccaaggccttcagcacctgcagcccccagctgattgtcatcatgctgttcctgaccaccggcctgtttgctgccctgggccccatcgccaaggccctgagcatccaggacctggtgattgccctgacctacacagtgctgccccccttcctgaaccccatcatctacagcctgaggaacaaggagatcaagacagccatgtggaggctgtttgtgaagatctacttcctgcagaagtag

SEQ ID NO: 40502 - DNA, 966 bp, Artificial Sequence
  Description of Artificial Sequence: Synthetic coding sequence
atggtgaacctgaccagcaccagcggcttcctgctgatgggcttcagtgatgagaggaagctgcagatcctgcacgccctggtgttcctggtgacctacctgctggccctgaccggcaacctgctgatcatcaccatcatcaccgtggaccggcggctgcacagccccatgtactacttcctgaagcacctgagcctgctggacctgtgcttcatctctgtgacagtgccccagagcatcgccaacagcctgatgggaaatggctacatcagcctggtgcagtgcatcctgcaggtgttcttcttcatcgccctggccagcagcgaggtggccatcctgactgtgatgtcctatgacagatatgctgccatctgccagcccctgcactatgagaccatcatggacccccgggcctgcagacatgctgtgattgctgtgtggattgctgggggcctgagcggcctgatgcacgccgccatcaacttcagcatccccctgtgtgggaagagggtcatccaccagttcttctgtgatgtgccccagatgctgaagctggcctgcagctatgagttcatcaatgaaattgccctggccgccttcaccaccagcgctgccttcatctgcctgatcagcatcgtgctgagctacatccgcatcttcagcacagtgctgcgcatccccagcgctgagggccgcaccaaggtgttcagcacctgcctgccccacctgtttgtggccaccttcttcctgtctgctgctggctttgagttcctgcggctgcccagcgacagcagcagcacagtggacctggtgttttctgtgttctacaccgtcatcccccccaccctgaaccctgtgatctacagcctgagaaatgacagcatgaaggccgccctgaggaagatgctgagcaaggaggagctgccccagaggaagatgtgcctgaaggccatgttcaagctgtag

SEQ ID NO: 40503 - DNA, 966 bp, Artificial Sequence; identical to SEQ ID NO: 40502
  Description of Artificial Sequence: Synthetic coding sequence

SEQ ID NO: 40504 - DNA, 966 bp, Artificial Sequence; identical to SEQ ID NO: 40502
  Description of Artificial Sequence: Synthetic coding sequence

SEQ ID NO: 40505 - DNA, 966 bp, Artificial Sequence; identical to SEQ ID NO: 40502
  Description of Artificial Sequence: Synthetic coding sequence

SEQ ID NO: 40506 - DNA, 939 bp, Artificial Sequence
  Description of Artificial Sequence: Synthetic coding sequence
atggtgaaccagagcagcaccccaggcttcctgctgctgggcttcagcgagcaccctggcctggagaggaccctgtttgtggtggtgttcaccagctacctgctgaccctggtgggcaacaccctcatcatcctgctgtctgtgctggaccccaagctgcacagccccatgtacttcttcctgagcaacctgtccttcctggacctgtgcttcaccaccagctgtgtgccccagatgctggtgaacctgtggggccccaagaagaccatctccttcctggactgcagcgtgcagatcttcatcttcctgagcctgggcaccacagagtgcatcctgctgactgtgatggcctttgacagatatgtggccgtgtgccagcccctgcactacgccaccatcatccacccccggctgtgctggcagctggcctctgtggcctgggtgattggcctggtggagagcgtggtgcagacccccagcaccctgcacctgcccttctgcccagaccggcaggtggatgactttgtgtgtgaggtgcctgccctgatccggctgagctgtgaggacaccagctacaatgagatccaggtggccgtggcctctgtgttcatcctggtggtgcccctgagcctcatcctggtgtcctatggagccatcacctgggccgtgctgcgcatcaacagcgccaagggccgcaggaaggccttcggcacctgcagcagccacctgactgtggtgaccctcttctacagctctgtgattgctgtgtacctgcagcccaagaacccctatgcccaggagcggggcaagttcttcggcctcttctatgctgtgggcacccccagcctgaaccccctcatctacaccctgaggaacaaggaggtgacccgggccttccggcggctgctgggcaaggagatgggcctgacccagagctag

SEQ ID NO: 40507 - DNA, 939 bp, Artificial Sequence
  Description of Artificial Sequence: Synthetic coding sequence
atggtgaaccagagcagcaccccaggcttcctgctgctgggcttcagcgagcaccctggcctggagaggaccctgtttgtggtggtgttcaccagctacctgctgaccctggtgggcaacaccctcatcatcctgctgagcgccctggaccccaagctgcacagccccatgtacttcttcctgagcaacctgtccttcctggacctgtgcttcaccaccagctgtgtgccccagatgctggtgaacctgtggggccccaagaagaccatctccttcctggactgcagcgtgcagatcttcatcttcctgagcctgggcaccacagagtgcatcctgctgactgtgatggcctttgacagatatgtggccgtgtgccagcccctgcactacgccaccatcatccacccccggctgtgctggcagctggcctctgtggcctgggtgattggcctggtggagagcgtggtgcagacccccagcaccctgcacctgcccttctgcccagaccggcaggtggatgactttgtgtgtgaggtgcctgccctgatccggctgagctgtgaggacaccagctacaatgagatccaggtggccgtggcctctgtgttcatcctggtggtgcccctgagcctcatcctggtgtcctatggagccatcacctgggccgtgctgcgcatcaacagcgccaagggccgcaggaaggccttcggcacctgcagcagccacctgactgtggtgaccctcttctacagctctgtgattgctgtgtacctgcagcccaagaacccctatgcccaggagcggggcaagttcttcggcctcttctatgctgtgggcacccccagcctgaaccccctcatctacaccctgaggaacaaggaggtgacccgggccttccggcggctgctgggcaaggagatgggcctgacccagagctag

SEQ ID NO: 40508 - DNA, 939 bp, Artificial Sequence; identical to SEQ ID NO: 40506
  Description of Artificial Sequence: Synthetic coding sequence

SEQ ID NO: 40509 - DNA, 939 bp, Artificial Sequence; identical to SEQ ID NO: 40506
  Description of Artificial Sequence: Synthetic coding sequence

SEQ ID NO: 40510 - DNA, 939 bp, Artificial Sequence
  Description of Artificial Sequence: Synthetic coding sequence
atgctgatgaagaagaatgccagctttgaggacttcttcatcctgctgggcttcagcaactggccccacctggaggtggtgctgtttgtggtgatcctgatcttctacctgatcaccctgattggcaacctcttcatcatcatcctgagctacctggacagccacctgcacacccccatgtacttcttcctgagcaacctgtccttcctggacctgtgctacaccaccagcagcatcccccagctgctggtgaacctgtggggccctgagaagaccatctcctatgccggctgcaccgtgcagctgtactttgtgctggccctgggcacagcagaatgtgtgctgctggtggtgatgtcctatgacagatatgctgctgtgtgccggcccctgcactacacagtgctgatgcacccccgcttctgccgcctgctggccgccgcctcctgggtgtctggcttcaccaccagcgccctgcacagcagcttcaccttctggatccccctgtgccgccaccggctggtggaccacttcttctgtgaggtgcctgccctgctgcggctgagctgtgtggacacccaggccaatgagctgaccctgatggtgatgagcagcatctttgtgctgatccccctcatcctgatcctgaccagctatggagccatcgcccgggctgtgctgtccatgcagagcaccaccggcctgcagaaggtgctgcggacctgtggggcccacctgatggtggtgtccctcttcttcatccctgtgatgtgcatgtacctgcagcccccatctgagaacagccaggaccagggcaagttcatcgccctcttctacacagtggtgacccccagcctgaaccccctcatctacaccttcaggaacaaggatgtgagaggagctgtgaagaggctgatgggctgggagtggggcatgtag

SEQ ID NO: 40511 - DNA, 939 bp, Artificial Sequence
  Description of Artificial Sequence: Synthetic coding sequence
atgatgatcaagaagaatgccagcagcgaggacttcttcatcctgctgggcttcagcaactggccccagctggaggtggtgctgtttgtggtgatcctgatcttctacctgatgaccctgactggaaacctcttcatcatcatcctgtcctatgtggacagccacctgcacacccccatgtacttcttcctgagcaacctgtccttcctggacctgtgctacaccaccagcagcatcccccagctgctggtgaacctgcggggccctgagaagaccatctcctatgccggctgcatggtgcagctgtactttgtgctggccctgggcattgctgaatgtgtgctgctggtggtgatgtcctatgaccgctacgtggccgtgtgccggcccctgcactacacagtgctgatgcacccccgcttctgccacctgctggtggccgcctcctgggtgattggcttcaccatcagcgccctgcacagcagcttcaccttctgggtgcccctgtgtggccaccggctggtggaccacttcttctgtgaggtgcctgccctgctgcggctgagctgtgtggacacccacgccaatgagctgaccctgatggtgatgagcagcatctttgtgctgatccccctcatcctgatcctgaccacctatggagccatcgcccgggctgtgctgtccatgcagagcaccaccggcctgcagaaggtgttccgcacctgtggggcccacctgatggtggtgtccctcttcttcatccctgtgatgtgcatgtacctgcagcccccatctgagaacagcccagaccagggcaagttcatcgccctcttctacacagtggtgacccccagcctgaaccccctcatctacaccctgaggaacaagcacgtgaagggagctgccaagaggctgctgggctgggagtggggcaagtag

SEQ ID NO: 40512 - DNA, 939 bp, Artificial Sequence
  Description of Artificial Sequence: Synthetic coding sequence
atgatgatcaagaagaatgccagcagcgaggacttcttcatcctgctgggcttcagcaactggccccagctggaggtggtgctgtttgtggtgatcctgatcttctacctgatgaccctgactggaaacctcttcatcatcatcctgtcctatgtggacagccacctgcacacccccatgtacttcttcctgagcaacctgtccttcctggacctgtgctacaccaccagcagcatcccccagctgctggtgaacctgcggggccctgagaagaccatctcctatgccggctgcatggtgcagctgtactttgtgctggccctgggcatcacagaatgtgtgctgctggtggtgatgtcctatgaccgctacgtggccgtgtgccggcccctgcactacacagtgctgatgcacccccgcttctgccacctgctggtggccgcctcctgggtgattggcttcaccatcagcgccctgcacagcagcttcaccttctgggtgcccctgtgtggccaccggctggtggaccacttcttctgtgaggtgcctgccctgctgcggctgagctgtgtggacacccacgccaatgagctgaccctgatggtgatgagcagcatctttgtgctgatccccctcatcctgatcctgaccacctatggagccatcgcccgggctgtgctgtccatgcagagcaccaccggcctgcagaaggtgttccgcacctgtggggcccacctgatggtggtgtccctcttcttcatccctgtgatgtgcatgtacctgcagcccccatctgagaacagcccagaccagggcaagttcatcgccctcttctacacagtggtgacccccagcctgaaccccctcatctacaccctgaggaacaagcacgtgaagggagctgccaagaggctgctgggctgggagtggggcaagtag

SEQ ID NO: 40513 - DNA, 939 bp, Artificial Sequence; identical to SEQ ID NO: 40511
  Description of Artificial Sequence: Synthetic coding sequence

SEQ ID NO: 40514 - DNA, 936 bp, Artificial Sequence
  Description of Artificial Sequence: Synthetic coding sequence
atgaatgatgatggcaaggtgaatgccagcagcgagggctacttcatcctggtgggcttcagcaactggccccacctggaggtggtgatctttgtggtggtgctgatcttctacctgatgaccctgattggcaacctcttcatcatcatcctgagctacctggacagccacctgcacacccccatgtacttcttcctgagcaacctgtccttcctggacctgtgctacaccaccagcagcatcccccagctgctggtgaacctgtggggccctgagaagaccatctcctatgccggctgcatgatccagctgtactttgtgctggccctgggcaccacagaatgtgtgctgctggtggtgatgtcctatgacagatatgctgctgtgtgccggcccctgcactacacagtgctgatgcacccccgcttctgccacctgctggccgtggcctcctgggtgtctggcttcaccaacagcgccctgcacagcagcttcaccttctgggtgcccctgtgtggccaccggcaggtggaccacttcttctgtgaggtgcctgccctgctgcggctgagctgtgtggacacccacgtgaatgagctgaccctgatgatcaccagcagcatctttgtgctgatccccctcatcctgatcctgaccagctatggagccatcgtgcgggccatcctgaggatgcagagcaccaccggcctgcagaaggtgtttggcacctgtggggcccacctgatggctgtgtccctcttcttcatcccagccatgtgcatgtacctgcagcccccatctggcaacagccaggaccagggcaagttcatcgccctcttctacacagtggtgacccccagcctgaaccccctcatctacaccctgaggaacaaggtggtgagaggagctgtgaagaggctgatgggctgggagtag

SEQ ID NO: 40515 - DNA, 939 bp, Artificial Sequence
  Description of Artificial Sequence: Synthetic coding sequence
atggagaatggcagctacaccagctacttcatcctgctgggcctcttcaaccacacccgggcccaccaggtgctcttcatgatggtgctgagcatcgtgctgaccagcctgtttggaaacagcctgatgatcctgctgatccactgggaccaccggctgcacacccccatgtacttcctgctgagccagctgagcctgatggatgtgatgctggtgtccaccaccgtgcccaagatggctgctgactacctgaccggcagcaaggccatcagcagagctggctgtggggcccagatcttcttcctgcccaccctgggcggcggggagtgcttcctgctggccgccatggcctatgacagatatgctgctgtgtgccaccccctgcgctaccccaccctgatgtcctggcagctgtgcctgaggatgaacctgagctgctggctgctgggcgctgctgatggcctgctgcaggccgtggccaccctgtccttcccctactgtggggcccacgagattgaccacttcttctgtgagacccctgtgctggtgcggctggcctgtgccgacacctctgtgtttgaaaatgccatgtacatctgctgcgtgctgatgctgctggtgcccttcagcctcatcctgagcagctatggcctcatcctggccgctgtgctgcacatgaggagcacagaggccaggaagaaggcctttgccacctgcagcagccacgtggccgtggtgggcctcttctacggggccgccatcttcacctacatgaggcccaagagccacaggagcaccaaccacgacaaggtggtgtctgccttctacaccatgttcacccccctgctgaaccccctcatctacagcgtgaagaacagcgaggtgaagggggccctgacccgctgcatgggccgctgtgtggccctgagccgggagtag

SEQ ID NO: 40516 - DNA, 930 bp, Artificial Sequence
  Description of Artificial Sequence: Synthetic coding sequence
atggagaacagcacagaggtgacagagttcatcctgctgggcctgacagatgaccccaacctgcagatccccctgctgctggccttcctgttcatctacctgatcaccctgctgggcaatggaggcatgatggtgatcatccacagcgacagccacctgcacacccccatgtacttcttcctgagcaacctgagcctggtggacctgggctacagcagcgctgtggcccccaagacagtggccgccctgcggagcggggacaaggccatctcctatgatggctgtgccgcccagttcttcttctttgtgggctttgccaccgtggagtgctacctgctggcctccatggcctatgacagacatgctgctgtgtgccggcccctgcactacaccaccaccatgacagctggggtgtgtgccctgctggccaccggcagctatgtgtctggcttcctgaatgccagcatccacgccgccggcaccttccggctgtccttctgtggcagcaatgagatcaaccacttcttctgtgacatcccccccctgctggccctgagctgcagcgacacccgcatcagcaagctggtggtgtttgtggccggcttcaacgtgttcttcaccctgctggtgatcctgatctcctacttcttcatctgcatcaccatccagaggatgcacagcgctgagggccagaagaaggtgttcagcacctgtgccagccacctgacagccctgagcatcttctacggcaccatcatcttcatgtacctgcagcccaacagcagccagagcgtggacacagacaagatcgccagcgtcttctacacagtggtgatccccatgctgaaccccctcatctacagcctgaggaacaaggaggtgaagagcgccctgtggaagatcctgaacaagctgtacccccagtactag

SEQ ID NO: 40517 - DNA, 942 bp, Artificial Sequence
  Description of Artificial Sequence: Synthetic coding sequence
atggaggaggagaatgccaccctgctgacagaatttgtgctgaccggcttcctgtaccagccccagtggaagatccccctcttcctggccttcctggtgatctacctgatcaccatcatgggcaacctgggcctgattgctgtgatctggaaggacccccacctgcacatccccatgtacctgctgctgggcaacctggcctttgtggatgcctggatcagcagcacagtgacccccaagatgctgaacaacttcctggccaagagcaagatgatcagcctgtctgagtgcaagatccagttcttctcctttgccatctctgtgaccacagagtgcttcctgctggccaccatggcctatgacagatatgtggccatctgcaagcccctgctgtacccagccatcatgaccaacggcctgtgcatccggctgctgatcctgtcctatgtgggcggcatcctgcacgccctgattcatgagggcttcctgttccggctgaccttctgcaacagcaacatcgtgcaccacatctactgtgacaccatccccctgagcaagatcagctgcacagacagcagcatcaacttcctgatggtgttcatcttcagcggcagcatccaggtgttcagcatcgtgaccatcctggtgtcctacacctttgtgctgtttgccatcctgaagaagaagagtgacaagggcgtgaggaaggccttcagcacctgtggggcccacctgttctctgtgtccctgtactacggccccctgctcttcatctacgtgggccctgccagcccccaggctgatgaccaggacatggtggagcccctcttctacaccgtcatcatccccctgctgaaccccatcatctacagcctgaggaacaagcaggtgacagtgtccttcaccaagatgctgaagaagcacgtgaaggtgtcctactag

SEQ ID NO: 40518 - DNA, 942 bp, Artificial Sequence
  Description of Artificial Sequence: Synthetic coding sequence
atggaggaggagaatgccaccctgctgacagaatttgtgctgaccggcttcctgtaccagccccagtggaagatccccctcttcctggccttcctggtgatctacctgatcaccatcatgggcaacctgggcctgattgctgtgatctggaaggacccccacctgcacatccccatgtacctgctgctgggcaacctggcctttgtggatgcctggatcagcagcacagtgacccccaagatgctgaacaacttcctggccaagagcaagatgatcagcctgtctgagtgcaagatccagttcttcagcatcgccatcggcgtgaccacagagtgcttcctgctggccaccatggcctatgacagatatgtggccatctgcaagcccctgctgtacccagccatcatgaccaacggcctgtgcatccggctgctgatcctgagctacatcgccggcatcctgcacgccctgattcatgagggcttcctgttccggctgaccttctgcaacagcaacatcgtgcaccacatctactgtgacaccatccccctgagcaagatcagctgcacagacagcagcatcaacttcctgatggtgttcatcttcagcggcagcatccaggtgttcagcatcgtgaccatcctgatctcctacacctttgtgctcttcaccgtgctggagaagaagagtgacaagggcgtgaggaaggccttcagcacctgtggggcccacctgttctctgtgtgcctgtactacggccccctgctgctgatgtatgtgggccctgccagcccccaggctgatggccagaacatggtggagcccctcttctacaccgtcatcatccccctgctgaaccccatcatctacagcctgaggaacaagcaggtgattgtgtccttcatcaagatgctgaagagaaatgtgaaggtgtcctactag

SEQ ID NO: 40519 - DNA, 933 bp, Artificial Sequence
  Description of Artificial Sequence: Synthetic coding sequence
atggaggaggagaatgccaccctgctgacagaatttgtgctgaccggcttcctgtaccagccccagtggaagatccccctcttcctggccttcctggtgatctacctgatcaccatcatgggcaacctgggcctgattgctgtgatctggaaggacccccacctgcacatccccatgtacctgctgctgggcaacctggcctttgtggatgcctggatcagcagcacagtgacccccaagatgctgaacaacttcctggccaagagcaagatgatcagcctgtctgagtgcaagatccagttcttcagcatcgccatcggcgtgaccacagagtgcttcctgctggccaccatggcctatgacagatatgtggccatctgcaagcccctgctgtacccagccatcatgaccaacggcctgtgcatccggctgctgatcctgagctacatcgccggcatcctgcacgccctgattcatgagggcttcctgttccggctgaccttctgcaacagcaacatcgtgcaccacatctactgtgacaccatccccctgagcaagatcagctgcacagacagcagcatcaacttcctgatggtgttcatcttcagcggcagcatccaggtgttcagcatcgtgaccatcctgatctcctacacctttgtgctcttcaccgtgctggagaagaagagtgacaagggcgtgaggaaggccttcagcacctgtggggcccacctgttctctgtgtgcctgtactacggccccctgctgctgatgtatgtgggccctgccagcccccaggctgatggccagaacatggtggagcccctcttctacaccgtcatcatccccctgctgaaccccatcatctacagcctgaggaacaagcaggtgattgtgtccttcatcaagatgctgaagagaaatggcatctag

SEQ ID NO: 40520 - DNA, 966 bp, Artificial Sequence
  Description of Artificial Sequence: Synthetic coding sequence
atgaacaaggagaaccacagcctgattgctgagttcatcctgaccggcttcacctaccaccccaagctgaagacagtgctgtttgtggtgttctttgccatctacctgatcaccatggtgggcaacatcggcctggtggccctgatctacatcgagcagaggctgcacacccccatgtacatcttcctgggcaacctggtgctgatggacagctgctgcagcagcgccatcacccccaagatgctggagaacttcttcagcgaggacaagaggatcaccctgtatgagtgcatggcccagttctacttcctgtgcctggccgagaccacagactgcttcctgctggccgccatggcctatgactgctacgtggccatctgcaaccccctgcagtaccacaccatgatgagcaagaccctgtgcatccagatgacagctggggcctacctggccggcaacctgcaccccatgattgaggtggagttcctgctgcggctgaccttctgtggcagccaccagatcaaccacttcttctgtgatgtgctgcccctgtaccgcctgagctgcatcaacccctacatcaatgagctggtgctcttcatcctggccggcagcatccagatcttcaccatcgtgctggtgtcctacttctacatcctcttcaccatcttcaccatgaagagcaaggagggccggggcaaggccctgagcacctgtgccagccacttcctgtctgtgtccatcttctgtgacagcctgctcttcatgtatgcccggcctggagctgtgaatgaaggagacaaggacatccctgtggccatcttctacaccctggtgatccccctgctgaaccccttcatctacagcctgaggaacaaggaggtgatcaacatcatgaagaagatcatgaagaagaggaagttctgccacatcctgaagcagatgagcagccccctggccacctag

SEQ ID NO: 40521 - DNA, 966 bp, Artificial Sequence
  Description of Artificial Sequence: Synthetic coding sequence
atggtgaacctgacctccatgagcggcttcctgctgatgggcttcagtgatgagaggaagctgcagatcctgcacgccctggtgttcctggtgacctacctgctggccctgaccggcaacctgctgatcatcaccatcatcaccgtggaccggcggctgcacagccccatgtactacttcctgaagcacctgagcctgctggacctgtgcttcatctctgtgacagtgccccagagcatcgccaacagcctgatgggaaatggctacatcagcctggtgcagtgcatcctgcaggtgttcttcttcatcgccctggccagcagcgaggtggccatcctgactgtgatgtcctatgacagatatgctgccatctgccagcccctgcactatgagaccatcatggacccccgggcctgcagacatgctgtgattgctgtgtggattgctgggggcctgagcggcctgatgcacgccgccatcaacttcagcatccccctgtgtgggaagagggtcatccaccagttcttctgtgatgtgccccagatgctgaagctggcctgcagctatgagttcatcaatgaaattgccctggccgccttcaccaccagcgctgccttcatctgcctgatcagcatcgtgctgagctacatccgcatcttcagcacagtgctgcgcatccccagcgctgagggccgcaccaaggtgttcagcacctgcctgccccacctgtttgtggccaccttcttcctgtctgctgctggctttgagttcctgcggctgcccagcgacagcagcagcacagtggacctggtgttttctgtgttctacaccgtcatcccccccaccctgaaccctgtgatctacagcctgagaaatgacagcatgaaggccgccctgaggaagatgctgagcaaggaggagctgccccagaggaagatgtgcctgaaggccatgttcaagctgtag

SEQ ID NO: 40522 - DNA, 966 bp, Artificial Sequence
  Description of Artificial Sequence: Synthetic coding sequence
atggagaggaagaaccagacagccatcacagagttcatcatcctgggcttcagcaacctgaatgagtggcagttcctgctcttcaccatcttcttcctgacctacttctgcaccctgggcggcaacatcctgatcatcctgaccaccgtgacagacccccacctgcacacccccatgtactacttcctgggcaacctggccttcatcgacatctgctacaccaccagcaatgtgccccagatgatggtgcacctgctgagcaagaagaagagcatctcctatgtgggctgtgtggtgcagctgtttgcctttgtgttctttgtgggctctgaatgtctgctgctggccgccatggcctatgaccgctacatcgccatctgcaaccccctgcgctacagcgtcatcctgagcaaggtgctgtgcaaccagctggccgccagctgctgggccgccggcttcctgaacagcgtggtgcacacagtgctgaccttctgcctgcccttctgtggcaacaaccagatcaactacttcttctgtgacatcccccccctgctgatcctgagctgtggcaacacctctgtgaatgagctggccctgctgagcactggagtcttcatcggctggacccccttcctgtgcatcgtgctgagctacatctgcatcatcagcaccatcctgcgcatccagagcagcgagggccgcaggaaggccttcagcacctgtgccagccacctggccatcgtgttcctgttctacggcagcgccatcttcacctacgtgcggcccatcagcacctacagcctgaagaaggaccggctggtgtctgtgctgtacagcgtggtgacccccatgctgaaccccatcatctacaccctgaggaacaaggacatcaaggaggccgtgaagaccatcggcagcaagtggcagccccccatcagcagcctggacagcaagctgacctactag

SEQ ID NO: 40523 - DNA, 966 bp, Artificial Sequence
  Description of Artificial Sequence: Synthetic coding sequence
atggagaggaagaaccagacagccatcacagagttcatcatcctgggcttcagcaacctgaatgagctgcagttcctgctcttcaccatcttcttcctgacctacttctgcaccctgggcggcaacatcctgatgatcctgaccaccgtgacagacccccacctgcacacccccatgtactacttcctgggcaacctggccttcatcgacatctgctacaccaccagcaatgtgccccagatgatggtgcacctgctgagcaagaagaagagcatctcctatgtgggctgtgtggtgcagctgtttgcctttgtgttctttgtgggctctgaatgtctgctgctggccgccatggcctatgaccgctacatcgccatctgcaaccccctgcgctacagcgtcatcctgagcaaggtgctgtgcaaccagctggccgccagctgctgggccgccggcttcctgaacagcgtggtgcacacagtgctgaccttctgcctgcccttctgtggcaacaaccagatcaactacttcttctgtgacatcccccccctgctgatcctgagctgtggcaacacctctgtgaatgagctggccctgctgagcactggagtcttcatcggctggacccccttcctgtgcatcgtgctgagctacatctgcatcatcagcaccatcctgcgcatccagagcagcgagggccgcaggaaggccttcagcacctgtgccagccacctggccatcgtgttcctgttctacggcagcgccatcttcacctacgtgcggcccatcagcacctacagcctgaagaaggaccggctggtgtctgtgctgtacagcgtggtgacccccatgctgaaccccatcatctacaccctgaggaacaaggacatcaaggaggccgtgaagaccatcggcagcaagtggcagccccccatcagcagcctggacagcaagctgacctactag

SEQ ID NO: 40524 - DNA, 966 bp, Artificial Sequence; identical to SEQ ID NO: 40523
  Description of Artificial Sequence: Synthetic coding sequence

SEQ ID NO: 40525 - DNA, 966 bp, Artificial Sequence; identical to SEQ ID NO: 40523
  Description of Artificial Sequence: Synthetic coding sequence

SEQ ID NO: 40526 - DNA, 939 bp, Artificial Sequence
  Description of Artificial Sequence: Synthetic coding sequence
atggagatcctgagcaacagcaccagcaagttccccaccttcctgctgaccggcatccctggcctggagagcgcccacgtgtggatcagcatccccttctgctgcttctacgccatcgccctgagcggcaacagcgtcatcctgtttgtgatcatcacccagcagagcctgcacgagcccatgtactacttcctgttccggctgagcgccacagacctgggcctgactgtgagcagcctgagcaccaccctgggcatcctgtggtttgaggcccgggagatcagcctgtacagctgcatcgtgcagatgttcttcctgcacggcttcaccttcatggagagcggcgtgctggtggccacagcctttgacagatatgtggccatctgtgaccccctgcgctacaccaccatcctgaccaacagccgcatcatccagatgggcctgctgatgatcacccgggccatcgtgctgatcctgcccctgctgctgctgctgaagcccctgtacttctgcaggatgaatgccctgagccacagctactgctaccacccagatgtgatccagctggcctgcagcgacatccgggccaacagcatctgtggcctgattgacctgatcctgaccactggaattgacaccccctgcatcgtgctgagctacatcctgatcatccacagcgtgctgcgcatcgccagccctgaggagtggcacaaggtgttcagcacctgtgtgagccacgtgggcgctgtggccttcttctacatccacatgctgagcctgagcctggtgtaccgctatggccgcagcgccccccgggtggtgcacagcgtgatggccaacgtgtacctgctgctgccccctgtgctgaaccccatcattgattctgtgaagaccaagcagatcaggaaggccatgctgagcctgctgctgaccaagtag

SEQ ID NO: 40527 - DNA, 960 bp, Artificial Sequence
  Description of Artificial Sequence: Synthetic coding sequence
atgctgcagaaccaggacaccatggagatcctgagcaacagcaccagcaagttccccaccttcctgctgaccggcatccctggcctggagagcgcccacgtgtggatcagcatccccttctgctgcttctacgccatcgccctgagcggcaacagcgtcatcctcttcgtcatcatcacccagcagagcctgcacgagcccatgtactacttcctgttccggctgagcgccacagacctgggcctgactgtgagcagcctgagcaccaccctgggcatcctgtggtttgaggcccgggagatcagcctgtacagctgcatcgtgcagatgttcttcctgcacggcttcaccttcatggagagcggcgtgctggtggccacagcctttgaccgctacgtggccatctgtgaccccctgcgctacaccaccatcctgaccaacagccgcatcatccagatgggcctgctgatgatcacccgggccatcgtgctgatcctgcccctgctgctgctgctgaagcccctgtacttctgcaggatgaatgccctgagccacagctactgctaccacccagatgtgatccagctggcctgcagcgacatccgggccaacagcatctgtggcctgattgacctgatcctgaccaccggcatcgacaccccctgcatcgtgctgagctacatcctgatcatccacagcgtgctgagaattgccagccctgaggagtggcacaaggtgttcagcacctgtgtgagccacgtgggcgctgtggccttcttctacatccacatgctgagcctgagcctggtgtaccgctatggccgcagcgccccccgggtggtgcacagcgtgatggccaacgtgtacctgctgctgccccctgtgctgaaccccatcatcgacagcgtgaagaccaagcagatcaggaaggccatgctgagcctgctgctgaccaagtag

SEQ ID NO: 40528 - DNA, 981 bp, Artificial Sequence
  Description of Artificial Sequence: Synthetic coding sequence
atgtctgtgcagtacagcctgagcccccagttcatgctgctgagcaacatcacccagttcagccccatcttctacctgaccagcttccctggcctggagggcatcaagcactggatcttcatccccttcttcttcatgtacatggtggccatcagcggcaactgcttcatcctgatcatcatcaagaccaacccccggctgcacacccccatgtactacctgctgagcctgctggccctgacagacctgggcctgtgtgtgtccaccctgcccaccaccatgggcatcttctggttcaacagccacagcatctactttggagcctgccagatccagatgttctgcatccacagcttctccttcatggagagctctgtgctgctgatgatgagctttgaccggctggtggccatctgccaccccctgcgctacagcgtcatcatcaccggccagcaggtggtgcgggccggcctgattgtcatcttccggggccctgtggccaccatccccatcgtgctgctgctgaaggccttcccctactgcggctctgtggtgctgagccacagcttctgcctgcaccaggaggtgatccagctggcctgcacagacatcaccttcaacaacctgtatggcctgatggtggtggtgttcaccgtgatgctggacctggtgctgattgccctgtcctatggcctcatcctgcacacagtggccggcctggccagccaggaggagcagaggcgggccttccagacctgcacagcccccctgtgtgctgtgctggtgttctttgtgcccatgatgggcctgagcctggtgcacagatttgggaagcacgcccccccagccatccacctgctgatggccaacgtgtacctgtttgtgccccccatgctgaaccccatcatctacagcatcaagaccaaggagatccaccgggccatcatcaagttcctgggcctgaagaaggccagcaagtag

SEQ ID NO: 40529 - DNA, 945 bp, Artificial Sequence
  Description of Artificial Sequence: Synthetic coding sequence
atgaagaacaagtccatggagattgagttcatcctgctgggcctgacagatgacccccagctgcagatcgtcatcttcctgttcctgttcctgaactacaccctgagcctgatgggcaacctgatcatcatcatcctgaccctgctggacccccggctgaagacccccatgtacttcttcctgaggaacttctccttcctggaggtgatcttcaccaccgtgtgcatcccccgcttcctgatcaccatcgtgacccgggacaagaccatctcctacaacaactgtgccacccagctgttcttcatcctgctgcccggggtgacagagttctacctgctggccgccatgtcctatgacagatatgtggccatctgcaagcccctgcactaccccatcatcatgagcagcaaggtgtgctaccagctggtgctgagctcctgggtgacaggcttcctgatcatcttcccccccctggtgatgggcctgaagctggacttctgtgccagcaagaccatcgaccacttcatgtgtgagaccagccccatcctgcagatcagctgcacagacacccacgtgctggagctgatgtccttcaccctggccgtggtgaccctggtggtgaccctggtgctggtgatcctgagctacacctgcatcatcaagaccatcctgaagttcagcagcgcccagcagaggaacaaggccttcagcacctgcaccagccacatgattgtggtgtccatgacctacggcagctgcatcttcatgtacatcaagcccagcgccaaggagcgggtgacagtgtccaagggcgtggccctgctgtacaccagcatcgcccccctgctgaaccccttcatctacaccctgaggaaccagcaggtgaaggaggtgttctgggatgtgctgcagaagaacctgtgcttcagcaagaggcccttctag

SEQ ID NO: 40530 - DNA, 939 bp, Artificial Sequence
  Description of Artificial Sequence: Synthetic coding sequence
atgaagaacagaacatctgtgacagacttcatcctgctgggcctgacagacaacccccagctgcaggtggtgatcttctccttcctgttcctgacctacgtgctgtctgtgacaggcaacctgaccatcatcagcctgaccctgctggacagccacctgaagacccccatgtacttcttcctgaggaacttcagcctggagatctccttcacctctgtgtgcaacccccgcttcctgatcagcatcctgaccggggacaagagcatctcctacaatgcctgtgccgcccagctgttcttcttcatcttcctgggcagcacagagttcttcctgctggcctccatgtcctatgactgctacgtggccatctgcaagcccctgcactacaccaccatcatgtctgaccgcatctgctaccagctgatcatcagctcctggctggccggcttcctggtgatcttcccccccctggccatgggcctgcagctggacttctgtgacagcaatgtgattgaccacttcacctgtgacagcgcccccctgctgcagatcagctgcacagacaccagcaccctggagctgatgtccttcatcctggccctcttcaccctcatcagcaccctcatcctggtgatcctgagctacacctacatcatccgcaccatcctgcgcatccccagcgcccagcagaggaagaaggccttcagcacctgcagcagccacgtgattgtggtgtccatctcctatggcagctgcatcttcatgtatgtgaagaccagcgccaaggagggcgtggccctgaccaagggcgtggccatcctgaacacctctgtggcccccatgctgaaccccttcatctacaccctgaggaaccagcaggtgaagcaggccttcaaggatgtgctgaggaagatcagccacaagaagaagaagcactag

SEQ ID NO: 40531 - DNA, 114 bp, Artificial Sequence
  Description of Artificial Sequence: Synthetic coding sequence
atgatcacagatgtgcagctggccatctttgccaacatgctgggcgtgtccctcttcctgctggtggtgctgtaccactacgtggccgtgaacaaccccaagaagcaggagtag

SEQ ID NO: 40532 - DNA, 330 bp, Artificial Sequence
  Description of Artificial Sequence: Synthetic coding sequence
atgagcatcacagatgtgctgtctgcagatgacattgctgctgccctgcaggagtgccaggaccctgacacctttgagccccagaagttcttccagaccagcggcctgagcaagatgtctgccagccaggtgaaggatgtgttccgcttcatcgacaatgaccagagcggctacctggatgaggaggagctgaagttcttcctgcagaagtttgaaagtggggcccgggagctgacagaaagtgagaccaagagcctgatggctgctgctgacaatgatggagatggcaagatcggggctgaggagttccaggagatggtgcacagctag

SEQ ID NO: 40533 - DNA, 372 bp, Artificial Sequence
  Description of Artificial Sequence: Synthetic coding sequence
atgaagaccatcctgggcttcaagggcctcttctacctgcacagcctcatctggacctgtgccggggactggagcgccatccaggtgcactgcacccagttctggttctttgcccgcatcaagcccaccatcttctacaacctgtatgtgaacccagatgaggtgttcctgggagatggctgccacgtgacccacgtgctgcccaacgtgtactatgagttcttctaccacccccatgactgtggcatcgtgacccagcccctgcaggaggtgctgctgctgaagaccaagatccgctacatcagccgggacagcacagtgcgctctgagatgcccctgagctgtgtggtgcacaagcagaagtgccagtag

SEQ ID NO: 40534 - DNA, 1356 bp, Artificial Sequence
  Description of Artificial Sequence: Synthetic coding sequence
atgggcaacctgctgggcggcgtgtccttccgggagcccaccaccgtggaggactgtgacagcacctggcagacagattctgagcctgagcctgaggagcccggccctgggggcggcagcgagggccctggccaggagagcgagcagcctgcccagcccccagagcaggccggcggccggcctggggccagccctgccccagatgaagatgctgaggccgccggggctgagcagggcggggacagcacagaggccacagccaagcccaagaggagcttctatgctgcccgggacctgtacaagtaccgccaccagtaccccaacttcaaggacatccgctaccagaatgacctgagcaacctgcgcttctacaagaacaagatccccttcaagccagatggagtgtacatcgaggaggtgctgagcaagtggaagggggactatgagaagctggagcacaaccacacctacatccagtggctgttccccctgcgggagcagggcctgaacttctacgccaaggagctgaccacctatgaaattgaggagttcaagaagaccaaggaggccatccgccgcttcctgctggcctacaagatgatgctggagttcttcggcatcaagctgacagacaagacaggaaatgtggcccgggctgtgaactggcaggagcgcttccagcacctgaatgaaagccagcacaactacctgcgcatcacccgcatcctgaagagcctgggggagctgggctatgagagcttcaagagccccctggtgaagttcatcctgcacgaggccctggtggagaacaccatccccaacatcaagcagagcgccctggagtactttgtgtacaccatccgggaccggcgggagaggaggaagctgctgcgctttgcccagaagcactacaccccatctgagaacttcatctggggcccccccaggaaggagcagagcgagggcagcaaggcccagaagatgagcagccccctggccagcagccacaacagccagacctccatgcacaagaaggccaaggacagcaagaacagcagcagcgctgtgcacctgaacagcaagacagctgaggacaagaaggtggcccccaaggagcctgtggaggagacagaccggcccagccctgagcccagcaatgaggccgccaagcccaggaacacagagaaggacagcaatgctgagaacatgaacagccagcctgagaagacagtgaccacccccacagagaagaaggagagcgtgtccccagagaacaatgaggagggcggcaatgacaaccaggacaatgaaaatcctggcaacaccaactgccatgatgtggtgctggtgcagtag

SEQ ID NO: 40535 - DNA, 570 bp, Artificial Sequence
  Description of Artificial Sequence: Synthetic coding sequence
atgatcaacacccaggacagcagcatcctgcccctgagcaactgcccccagctgcagtgctgccgccacatcgtgcccggccccctgtggtgcagtgatgccccccaccccctgagcaagatccctgggggccggggcggcggccgggaccccagcctgagcgccctgatctacaaggatgagaagctgactgtgacccaggacctgcctgtgaatgatggcaagccccacatcgtgcacttccagtatgaggtgacagaggtgaaggtgtcctcctgggatgctgtgctgagcagccagagcctgtttgtggagatcccagatggcctgctggctgatggcagcaaggagggcctgctggccctgctggagtttgctgaggagaagatgaaggtgaactacgtgttcatctgcttcaggaagggccgggaggaccgggcccccctgctgaagaccttctccttcctgggctttgagatcgtgcggcccggccacccctgtgtgcccagcaggccagatgtgatgttcatggtgtaccccctggaccagaacctgagtgatgaggactag

SEQ ID NO: 40536 - DNA, 7035 bp, Artificial Sequence
  Description of Artificial Sequence: Synthetic coding sequence
atgatcccctggagcatcttcctgctgcacgtgctgctcttcagcctgcaggagtacatctgtgccagcagcatcctgatgggcaccagcaagaatggcttcaatgaaaatcggcagaagagggccctgctggccgcccagtttgaggccaccagcccccgctacttcttccatgatgccatcaactggggcgagagcaagatcaagggcagctgcccctatgaatgtctgaatggagccttctgcagcaagacaggcacctgtgactgccagatcttccaggccctgggcacccgctgccagatcatccccaacatgggaaatggaagagatggcatctgcaagacctggggccagtaccactttgagacctttgatggcatctactactacttccctggcaactgcagctacatctttgccaaggactgtggggacctggagccccgctacacagtgtgggtgcacaacagccccaagtgcctgggctctgtgtacagctgctaccgcagcatcagcctcttcttcagcaaccaggaggagatccgcatctacggccacgagatcaagaagaatggcatcagcctgaccctgccccagaccatcggccagatcttcatcgagaagctggccgactacatcctggtgaagaccaccttcggcttcagcctggcctgggatggcatcagcggcatctacctgaagctgtctgaggaccacaagggcaagagctgtggcctgtgtggcaactacaatgacatccagagtgatgacttcatcatcctgcaggaggactacacagaggacatcgccatgtttgccaacagctggagcgtgcagaccccagatgacaccaagtgtgtgctgacccccagcgacttccccaacccctgcagcagcggcatgcctgcctttgaggccatcttcttcaagtgccagatcctgctgcagttccccttcctgagctgccacgagtacatcgacccctacctgtacatcgccagctgtgtgaatgacctgtgcaagacagatgatgatgagacctactgccgggccgccacagaatatgcccgggcctgcagccatgctggctaccccatccaggactggagagatgacttccctgcctgcacagacaagtgtgatgacagctttgtgcaccgggactgcatcagctgctgcccccccacctgcacctttgagaagcagtgcctgggcagcaacctgcactgcctggatggctgctactgcccagatggcctggtgatggacaatggcacctgcatcagcctggagaactgcccctgtggcttccacggcctggcctacagcgtgggcagcaagattgagcaggagtgcacagaatgtgtgtgtgtgggcggcgtgtggaactgcacagagcaggactgccctgtgcagtgcagcgtggtgggggacagccacttcaccacctttgatggccgccactacagcttcatcggcatgtgccagtacatcctggtgaagggcaccgggaaggacaagttcaccatcaccctgcagaaggccccctgtgagcagaacctgggcctggtgtgcctgcagagcatcaccctcatcctggaggatgacttcaacaagcaggtgaccctgggccggggcggccagatcctgaccagccccaaccagggcttcaacctgaatggaattgtggagatccagaccctgagcagcctcttcatcctgctgaagaccaccttcggcctgaagatcctgtttgccattgatggagagcgcatctacatccagctgaccagcgcctggaagaggaggaccctgggcctgtgtggcaccttcaatggaaacatcagagatgacttcctgagccccagcggcatgattgagggcaccccccagctgcacgccaatgcctggagggtgagcagcacctgctttgcccctgtgcacgtgcctgtggtggacccctgcaacatcaaccagcagaacatcggctacgccgcccactgtgatgtgatccaccaggagctgtttgccccctgccacatctacatcagccctggcctgtactaccagctgtgcagacatgatgcctgcaagtgtggcagcagctgcctgtgcaatgccctggcccactacgcctacctgtgtggccagcacggcgtgcccatcgacttccgcacccagatctccttctgtgctgtggtgtgccagaagggcatgctgtaccaccactgcagcagcttctgcctgcacagctgcatcagcctgagcagccctgagcagtgcagtgatgactgtgccgagggctgcaactgcccagagggcaagttctatgaggacaccctgaacttctgtgtgcccatcttccactgccgctgccactaccggggctctgtgtaccagcccggggagctgatccccacccccagcggcctgtgccagtgcagcaatggaacagtgaagtgtgatgagctggccaccccatctgctgtgcacatctgcccagagggcaaggagtactttgactgccgcttcccagaccctgagctgcctgctgggggcgtgaactgtgagaccacctgtgccaacctggccatgaacttcacctgcacccccagcagcccctgcatcagcggctgtgtgtgtgcccctggcatggccgagcaccggggcaagtgctacgtgcctgagagctgcccctgcatctggaaggactgggagtacctgagcggggaggtgattgccaccccctgctacacctgtgtgtgccggcggggcatgttcaactgcacctactacccctgcccagctgtgtgcaccatctacggggacagacactactacagctttgatggcctggagtatgactacatcagtgactgccaggtgttcctgatcaagtctgcagatgacagcgacatctctgtgattgcccagaacaagaagtgctttgacaatgacatcgtgtgcagcaagtctgtgctgatctctgtgggggacacagagatctacctgaatgacaccccctacaagcagaagcagagcggcttcttcctggagaacaagagcacctaccagctgtggaaggccggctactacatcgtggtgtacttccctgagaaggacatcaccatcctgtgggacaggaagaccaccatccacatcaaggtgggcccccagtggaagaacaagctgagcggcctgtgtggcaactttgacaagtgcaccagcaatgacatgaccaccagcaacaacctggaggtgagaaatgcccgggtgtttggagacagctgggccctgggccagtgtgagagcccagatgagaccatcaagccctgtgaggcccaccagaacaagttcccctatgccaagaaggagtgcagcatcctgtacagcgacatctttgccagctgcagaaatgtgattgatgtgaccagctttgccaagaactgccacgaggacacctgcaactgcaacctgggcggggactgtgaatgtctgtgcaccagcattgctgcctatgcctacaagtgctgccaggagggcatcagcatccactggaggagcagcacagtgtgcagcctggactgtgagtactacaatgaaggcctgggggagggcccctacatgctggccagctatggccagagcggcctggtgctgggcgccaacatgaccagccgctctgtgttctgcctgcccaggagctctgtgcacaccagcctcttcttctacttcatgatcaccccaggcctcttcaaggagaaggtgagcagcctggccctggtgtccctggagagcgctgagcggcccaactacttcctgtatgtgcatgacaatgacaccctgagcctggagctgtgggaggccaacagcgccttccaccggcgggccaccttcttccaccaccagggcctgtggatccctggctacagcgcctttgagctgtacagcaagaagggcttcttcatcatcttcacagacagctctgtgaaggccagcaaatatgatgattctgaggagttcaagcacagcagcagcttcagcattgaggagatccaggccgctgtgccctacaggaagatgtgtgagtggaggtatgagccctgtgccaccccctgcttcaagacctgcagcgaccctgaggccctggcctgcaagttcctgccccctgtggagggctgcctgccctactgccccaagaacatgatcctggatgaggtgaccctgaagtgtgtgtacccccgggactgcatccctgtgatccccacagagcccaccctgatgcccccagccaagcccaccgtgcccatgttcaccgtgtgggagatgatcacccccagcgacatcaccgtgtttgacatgctgacccccaccaccggcctggagtgtgagccccagaagtttgatcctgtgtatgactgcagccagtacatctgcctgaacatggagtggcagctgtacaactggagcctgaactgccccaaggatgtggagatgccagactgtggcttccggggccggcctgtgcaggtgaacagcgacatctgctgcccagagtgggagtgcccctgccgctgcagcatgctgtctgagctgagcatcatcacctttgatggcaacaatgctgccctgtacagcatggccagctacatcctggtgcgcatccctggagagatcatcgtggcccacattgaaaaatgttccatgaaccagaatggaaacagcctgaagaagctggcccccagcggccgcatcagcggcctgtgcttcaagaagctgaatgtgaccacccccatccacaagatcatcgtgaaccggctggccaggaaggtggaggtggacagcatcgtggtgcccctgcccttcagcagccaggagctgagcattgaagattctggctccatgtatgtgatcaccaccccagctggcctcatcatcaagtggagccacctgaccggcatcatcgacatccacttcggcttccgcttcaacctgagcagctacacagagggcctgtgtggcatctgcaatgaagatcctgatgatgacctgaggatgcagaatggcaccatcatcaccaacatggaggacatcggcctcttcattgaatcctgggagattgagaagagctttgaggtgaccatgagaagacctgtgaggaactgcacagaacatgactgcagccagtgcatcgacctgctgaacagacgcatcttcatcccctgccacgacaaggtgtccccagaggacttctgtgagaagatgtggatcaactacacctacttctggaactatgaatgtgatgccctgagcgcctacgtggccctgtgcaacaagtttgacatctgcatccagtggaggaccccagactactgcagcctgagctgcccagagggcaaggagtaccagccctgtgtgcggccctgtgaggcccggacctgcctgaaccagtggttctacggccacaccagctgcctgaacctgcgggaggactgtgtgtgcaaggtgggcaccatcctgcaccggccccacagcgcccagtgcatccctgagaaggaatgtgcctgcacagacagcgaggaccagcccaggacagctggggagatctggaatggaggcattgatgaatgtaccctgtacaagtgcctggagaatggcagcatcatccccatcgagccagactgtgatgaggagcccacccctgtgtgtgagcgggaggccgaggtggtgatgggcatcatcgacaagtggacctgctgcagcaaggaggtgtgtggctgtgacaccaccctgtgtgagaccagcatccccacctgcaccaacagccagaagctgattgtgggccacagccccctgagctgctgcccccagtacaagtgtgaatgtgaccccctgaagtgccccagcatcagcaccccagaatgtcgggaggaccagttcatgatccaggtgcggcaggaggagccctgctgcttcagccccttctgtgtgtgtgagagctgcaccaagcctgtgcccctgtgccatgatggagagttcctgactgtggacctgaacagcacccacttctgctgcccccagtactactgtgtgtgtgagcccaacctgtgccccatgcccctgctgaactgtgccgaggacatgaacctggtgaaggaaaatgtgtctggccagtgctgccccacctggcactgtgagtgcaactgtgaaaatctcatcatgcccacctgtgaggtgggggagttcaccgccatcgaccacaacttccagagcgactgtggctgcatccagtacctgtgtgagaaggatgatgtgtgtgtgttccaggaggtgtctgtgctgaaccctggccagagcatgatcaagtacctggaggaggacttctgctacgccatcgagtgcctggaggagaaggacaaccacacaggcttccacaccctgaacttcaccctggtgaactgcagcaagaagtgtgatgtgcaccaggtgtacacccccagccccagcgactatggctgctgcggcacctgcaagaatgtgtcctgcaagttccacatggagaatggcacctctgtggtgtatgctgtgggcagcacctggcactacaactgcaccacctatgaatgtgtgaagacagatgagggcgccatcatcctgaactacaccatggtgtgcccccccttcaatgaaacagagtgcaagatgaatgaaggcatcgtgaagctgtacaatgaaggctgctgcaagatctgcaagcgggaggagcgcatctgccagaaggtgatcatcaagagcgtcatcaggaagcaggactgcatgagccagagccccatcaacgtggccagctgtgatggaaaatgtcccagcgccaccatctacaacatcaacatcgagagccacctgcgcttctgcaagtgctgccgggagaatggagtgaggaacctgtctgtgcccctgtactgcagcggaaatggaacagagatcatgtacaccctgcaggagcccatcgactgcacctgccagtggaactag

SEQ ID NO: 40537 - DNA, 1434 bp, Artificial Sequence
  Description of Artificial Sequence: Synthetic coding sequence
atgtggatgttctcctggctgtgtgccatcctgatcatcctggccatcgccggcatgaacaccatcgccaagaccaccccccacaccaagttcaccaagaagtctgaggagcgggagatgcccaagggcctgaagcccagcagcggccccccacctgaggaggaggagaccctcttcacagagatggccgagatggccgagcccatcaccaagcccagcgccctggacagcgtgtttggaacagccaccctgagcccctttgagaacttcaccctggaccctgctgacttcttcctgaactgctgtgactgctgcagccctgtgcccggccagaagggggagcctggagagaccggccagcccggccccaagggggaggccggcaacctgggcatccctggccccccaggagtggtgggcccccagggcccccggggctacaagggggagaagggcctgaagggggagcggggggaccagggcgtgcccggctacccaggcaagccaggggcccagggcgagcccggccccaagggggacaagggcaacatcggcctgggcggcgtgaagggccagaagggcagcaagggggacacctgtggcaactgcaccaagggggagaagggggaccagggcgccatgggcagccctggcctgcacggcggccctggggccaagggggagaagggggagatgggagagaagggggagatgggagacaagggctgctgcggggacagcggggagcggggcggcaagggccagaagggggagggcggcatgaagggggagaagggcagcaagggggacagcggcatggagggcaagtctggaagaaatggcctgcccggggccaagggggaccccggcatcaagggggagaagggggagctgggccccccaggcctgctgggccccaccggccccaagggggacatcggcaacaagggcgtgcggggccccaccgggaagaagggcagccggggcttcaagggcagcaagggggagctggcccgggtgcccaggtctgccttctctgctggcctgagcaagcccttccccccacccaacatccccatcaagtttgagaagatcctgtacaatgaccagggcaactacagccctgtgacaggcaagttcaactgcagcatccctggcacctacgtgttctcctaccacatcaccgtgcggggccggcctgcccgcatcagcctggtggcccagaacaagaagcagttcaagagccgggagaccctgtatggccaggagattgaccaggccagcctgctggtgatcctgaagctgtctgctggggaccaggtgtggctggaggtgtccaaggactggaatggagtgtatgtgtctgcagaagatgacagcatcttcaccggcttcctgctgtacccagaggagaccagcggcatcagcccctag

SEQ ID NO: 40538 - DNA, 1716 bp, Artificial Sequence
  Description of Artificial Sequence: Synthetic coding sequence
atgaccatcctgcccaagaagaagcccccacctccagatgctgaccctgccaatgagcccccacctcctggccccatgcccccagcccccaggagaggaggaggagtgggcgtgggcggcggcggcactggagtgggcggcggggaccgggaccgggacagcggcgtggtgggcgcccggccccgggccagccccccaccccagggccccctgcccggccccccaggggccctgcaccgctgggccctggccgtgcccccaggagctgtggccggcccccggccccagcaggccagccccccaccctgtggcggccctgggggccctgggggcggccctggagatgccctgggcgctgctgctgctggggtgggcgctgctggggtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaagctgctgctgcccgcatcgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacaggcaccagcgctgtggagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcatgctgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 40539 - DNA, 1701 bp, Artificial Sequence
  Description of Artificial Sequence: Synthetic coding sequence
atgaccatcctgcccaagaagaagcccccacctccagatgctgaccctgccaatgagcccccacctcctggccccatgcccccagcccccaggagaggaggaggagtgggcgtgggcggcggcggcactggagtgggcggcggggaccgggaccgggacagcggcgtggtgggcgcccggccccgggccagccccccaccccagggccccctgcccggccccccaggggccctgcaccgctgggccctggccgtgcccccaggagctgtggccggcccccggccccagcaggccagccccccaccctgtggcggccctgggggccctgggggcggccctggagatgccctgggcgctgctgctgctggggtgggcgctgctggggtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaagctgctgctgcccgcatcgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacagagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcacgccgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 40540 - DNA, 762 bp, Artificial Sequence
  Description of Artificial Sequence: Synthetic coding sequence
atgggcagtgatgcctgggtgggcctgtggaggccccaccggccccggggccccatcgccgcccactatggaggccctggccccaagtacaagctgccccccaacacaggctacgccctgcatgaccccagccggccccgggccccagccttcacctttggagcccgcttccccacccagcagaccacctgtggccctggccctggccacctggtgcctgccaggatgacagtgcggggcacagatggagccccagcctacagcatctacggccggccccggcgcagcgcccccttcctgaccccaggccctggccgctacttccctgagagagctggaaatgccacctaccccagcgcccccaggcacaccatcgcccccaggaactggggcgtgcaggccgagcagcagagccctggccctgctgcctacacagtgcccagcctgctgggcccccgggtgattggcaaggtgtctgcccccacctgcagcatctacggccggcgggctgctggcagcttctttgaggacctgagcaagaccccaggcccctgtgcctaccaggtggtgtcccctggggtgtacaagagccgggccccccagttcaccatcctggcccggaccagcctgccccaggacaacaccaggaagccaggccctgctgcctacaacgtggaccagcacaggaagccccggggctggagctttggcatccgccacagcgactacctggcccccctggtgacagatgctgacaactag

SEQ ID NO: 40541 - DNA, 762 bp, Artificial Sequence; identical to SEQ ID NO: 40540
  Description of Artificial Sequence: Synthetic coding sequence

SEQ ID NO: 40542 - DNA, 465 bp, Artificial Sequence
  Description of Artificial Sequence: Synthetic coding sequence
atgctgcccggctacgccctgcaccctgtggccgccgcccggccccggctgcacctgcggcgggccctgccccacgccgcagatgatgtgcggccccgggcccggcccccaggggcccggagccatgaccgggcccggcacagaagaagaccccggctgctgcacctgcggccccccacccccctgagcgccctgccccacagcggcacctggagcggccccccaggcccctggccaccccagaggagaacagccagccgggaggcccacctgggcaccccagacctgaaccctgagagccccagcgacaccctgacctacagcgtgcccccctacccagacctgaagagccagaccccaccccggggctttgacaagtcctggctgcggctgcccaccagccccaggacccccagccgggtgcccacccggctgcccaggagcagcagccccccccacccctag

SEQ ID NO: 40543 - DNA, 825 bp, Artificial Sequence
  Description of Artificial Sequence: Synthetic coding sequence
atgaagctgcccaagggcaccaggagctctgtgtactttgcccagcaccctgagaaggagcccctgcccagccggcaggaggtgaagcagacccctgtgatcatggccaagatcaagggccctggccctgccaagtacctgcggcccagctgcaccggctacatcgaccatgacatctccatgttcaaggccccagcctacaccctgcacagccgccacagcgagaagaggatggtgtgccacagcagccctggcccctgctacctgctggaccccaagatcaccaggtttggcatgagcagctgcccccaggtgcccatggaggagcgcatcagcaacctgcggctgaaccccaccctggccagctgccagtactactttgagaagatccaccccccaggagagcggcgggccccccagtacaccttcggctaccgccggccctacagagtgatggacctgaacccagcccccaaccagtaccagatgcccctgctgctgggccccaacacccctgtgtcccgggccgccccctgctacagcctggccagccgggacaagaactggttctacaaggaggatgtggccggcggccctggccccaccacctacgcccggcctgagcccagcatctaccagaacagaagccccacctacagcatggccaagagatttgcctaccccctggacctgacccccaggcctggccctggcagccatgaggtgcagcaggtgacagtgcacaagccccacatcccagccttcaccatgggcatcaagcacagcctgcacctgtgccccctggtgattgacatccgggactag

SEQ ID NO: 40544 - DNA, 870 bp, Artificial Sequence
  Description of Artificial Sequence: Synthetic coding sequence
atgggcaccctgagctgtgacagcaccccccggctggccacagcccccctgggcagaagagtgacagagggccagatccctgagaccggcctgaggaagagctgtggcacagccaccctggagaatggcagcggccctggcctgtatgtgctgcccagcacagtgggcttcatcaaccacgactgcaccagggtggccagccctgcctacagcctggtgcggcggcccagcgaggccccaccccaggacaccagccctggccccatctacttcctggaccccaaggtgaccaggtttggccgcagctgcaccccagcctacagcatgcagggccgggccaagagccggggccctgaggtgaccccaggccctggggcctacagccctgagaaggtgccccctgtgcgccacaggaccccaccagccttcaccctgggctgccgcctgcccctgaagcccctggacaccagcgccccagccccaaatgcctacaccatgccacccctgtggggcagccagatcttcaccaagcccagcagccccagctacacagtggtgggccgcaccccaccagcccggcccccccaggaccctgctgagatccctggccctggccagtatgacagcccagatgccaacacctaccggcagaggctgcctgccttcaccatgctgggccggccccgggccccccggcccctggaggagaccccaggccctggggcccactgcccagagcaggtgacagtgaacaaggcccgggccccagccttctccatgggcatccgccacagcaagagggccagcaccatggccgccaccacccccagcaggcctgctggccaccggctgcccggccgctgctgctag

SEQ ID NO: 40545 - DNA, 762 bp, Artificial Sequence
  Description of Artificial Sequence: Synthetic coding sequence
atgggcaccctgagctgtgacagcaccccccggctggccacagcccccctgggcagaagagtgacagagggccagatccctgagaccggcctgaggaagagctgtggcacagccaccctggagaatgccccaccccaggacaccagccctggccccatctacttcctggaccccaaggtgaccaggtttggccgcagctgcaccccagcctacagcatgcagggccgggccaagagccggggccctgaggtgaccccaggccctggggcctacagccctgagaaggtgccccctgtgcgccacaggaccccaccagccttcaccctgggctgccgcctgcccctgaagcccctggacaccagcgccccagccccaaatgcctacaccatgccacccctgtggggcagccagatcttcaccaagcccagcagccccagctacacagtggtgggccgcaccccaccagcccggcccccccaggaccctgctgagatccctggccctggccagtatgacagcccagatgccaacacctaccggcagaggctgcctgccttcaccatgctgggccggccccgggccccccggcccctggaggagaccccaggccctggggcccactgcccagagcaggtgacagtgaacaaggcccgggccccagccttctccatgggcatccgccacagcaagagggccagcaccatggccgccaccacccccagcaggcctgctggccaccggctgcccggccgctgctgctag

SEQ ID NO: 40546 - DNA, 3405 bp, Artificial Sequence
  Description of Artificial Sequence: Synthetic coding sequence
atgggcctgctggccagcgctggcctgctgctgctgctggtgattggccaccccaggagcctgggcctgaagtgtggcatccgcatggtgaacatgaagagcaaggagcctgctgtgggcagccgcttcttcagccgcatcagctcctggaggaacagcacagtgacaggccacccctggcaggtgtccctgaagagtgatgagcaccacttctgtggcggcagcctcatccaggaggacagagtggtgacagctgcccactgcctggacagcctgtctgagaagcagctgaagaacatcaccgtgaccagcggggagtacagcctcttccagaaggacaagcaggagcagaacatccctgtgtccaagatcatcacccaccctgagtacaacagccgggagtacatgagcccagacatcgccctgctgtacctgaagcacaaggtgaagtttggaaatgctgtgcagcccatctgcctgcctgacagtgatgacaaggtggagcccggcatcctgtgcctgagcagcggctggggcaagatcagcaagaccagcgagtacagcaatgtgctgcaggagatggagctgcccatcatggatgaccgggcctgcaacacagtgctgaagtccatgaacctgccccccctgggccgcaccatgctgtgtgccggcttcccagactggggcatggatgcctgccagggcgacagcggcggccccctggtgtgccggcggggcggcggcatctggatcctggccggcatcacctcctgggtggccggctgtgccggcggctctgtgcctgtgaggaacaaccacgtgaaggccagcctgggcatcttcagcaaggtgtctgagctgatggacttcatcacccagaacctcttcaccggcctggaccggggccagcccctgagcaaggtgggcagccgctacatcaccaaggccctgagctctgtgcaggaggtgaatggcagccagaggggcaagggcatcctggacatggagaagcaggtgggctgtgaccatgactatgtgtccctgcggagcagcagcggcgtgctcttcaaccagaggagcctgatggaggatgatggcaagcagaacaagagggtgtgtgggaagatcctgcccagccccctgctggccgagaccagcgaggccatggtgccctttgtgtctgacacagaagattctggcagcggctttgagctgactgtgacagctgtgcagaagtctgaggccggcagcggctgcggcagcctggccatcctggtggaggagggcaccaaccacagcgccaagtacccagacctgtaccccagcaacacccgctgccactggttcatctgtgcccctgagaagcacatcatcaagctgacctttgaagattttgctgtgaagttcagccccaactgcatctatgatgctgtggtgatctatggagacagcgaggagaagcacaagctggccaagctgtgtggcatgctgaccatcaccagcatcttcagcagcagcaacatgaccgtcatctacttcaagagtgatggcaagaaccggctgcagggcttcaaggcccgcttcaccatcctgcccagcgagagcctgaacaagtttgagcccaagctgcccccccagaacaaccctgtgtccacagtgaaggccatcctgcatgatgtgtgtggcatcccccccttcagcccccagtggctgagcagaagaattgctggaggagaggaggcctgcccccactgctggccctggcaggtgggcctgcgcttcctgggggactaccagtgtggcggggccatcatcaaccctgtgtggatcctgacagctgcccactgtgtgcagctgaagaacaaccccctgtcctggaccatcatcgccggggaccatgacaggaacctgaaggagagcacagagcaggtgagaagagccaagcacatcatcgtgcatgaggacttcaacaccctgtcctatgacagcgacatcgccctgatccagctgagcagccccctggagtacaacagcgtggtgcggcctgtgtgcctgccccacagcgctgagcccctcttcagcagcgagatctgtgctgtgacaggctggggcagcatctctgcagatggcggcctggccagccggctgcagcagatccaggtgcacgtgctggagcgggaggtgtgtgagcacacctactacagcgcccaccctgggggcatcacagagaagatgatctgtgccggctttgctgccagcggggagaaggacttctgccagggcgacagcggcggccccctggtgtgcagacatgaaaatggcccctttgtgctgtatggaattgtgtcctggggcgccggctgtgtgcagccctggaagccaggagtgtttgcccgggtgatgatcttcctggactggatccagagcaagatcaatggacctgccagcctgcagaccaacaacaagtgcaagaccctgaagcagcagctgcccccacccacccccagcccagattctgcctcctggccaggctgctgcagcgaggccgagctggagaagccccggggcttcttccccaccccccgctacctgctggactaccggggccgcctggagtgctcctgggtgctgcgggtgtctgccagctccatggccaagttcaccatcgagtacctgagcctgctgggcagccctgtgtgccaggacagcgtgctgatcatctatgaggagcggcacagcaagaggaagacagctgggggcctgcacggccggcggctgtacagcatgaccttcatgagccctggccccctggtgcgggtgaccttccacgccctggtgcggggggccttcggcatctcctacatcgtgctgaaggtgctgggccccaaggacagcaagatcacccggctgagccagagcagcaaccgggagcacctggtgccctgtgaagatgtgctgctgaccaagccagagggcatcatgcagatccccaggaacagccacaggaccaccatgggctgccagtggaggctggtggcccccctgaaccacatcatccagctgaacatcatcaacttccccatgaagcccaccacctttgtgtgccacggccacctgcgggtgtatgagggctttggacctgggaagaagctgattgccagctttgctggcaccctggccatgatcctgaccaaggacatcctgaagcgggagaagctgaacttcatcaacacctacatcatgcacatctgggagaacagcgtgtatgacaacgtgcgctctgtgggcaagaggaagcagaagaagtttgccagcaacctgagctacagcatggaggccgagaagagccgcatccaggtgcctgctgacctggtgcctgccaagggcagcctgagcggcagctag

SEQ ID NO: 40547 - DNA, 1695 bp, Artificial Sequence
  Description of Artificial Sequence: Synthetic coding sequence
atgctgatcagcaggaacaagctgatcctgctgctgggcatcgtgttctttgagcggggcaagagcgccaccctgagcctgcccaaggcccccagctgtggccagagcctggtgaaggtgcagccctggaactacttcaacatcttcagccgcatcctgggcggcagccaggtggagaagggcagctacccctggcaggtgtccctgaagcagaggcagaagcacatctgtggcggcagcatcgtgagcccccagtgggtgatcacagctgcccactgcatcgccaacagaaatattgtgtccaccctgaatgtgacagctggggagtatgacctgagccagacagatcctggagagcagaccctgaccatcgagaccgtcatcatccacccccacttcagcaccaagaagcccatggactatgacatcgccctgctgaagatggccggggccttccagtttggccactttgtgggccccatctgcctgcctgagctgcgggagcagtttgaggccggcttcatctgcaccacagctggctggggccgcctgacagaaggaggagtgctgagccaggtgctgcaggaggtgaacctgcccatcctgacctgggaggagtgtgtggccgccctgctgaccctgaagaggcccatcagcggcaagaccttcctgtgcaccggcttcccagatggcggcagagatgcctgccagggcgacagcggcggcagcctgatgtgcaggaacaagaagggggcctggaccctggccggcgtgacctcctggggcctgggctgcggccggggctggaggaacaacgtgaggaagagtgaccagggcagccctggcatcttcacagacatcagcaaggtgctgccctggattcatgagcacatccagacaggcaacagaaggaagagcagccgggcctggtgcagcgagcaggatgtgattgtgtctggagctgagggcaagctgcacttccctgagagcctgcacctgtactatgagagcaagcagagatgtgtgtggaccctgctggtgcctgaggagatgcacgtgctgctgtccttcagccacctggatgtggagagctgccaccacagctacctgtccatgtacagcctggaggaccggcccatcggcaagttctgtggggagagcctgcccagcagcatcctgattggcagcaacagcctgcggctgaagtttgtgtctgatgccacagacaatgctgctggcttcaacctgacctacaaggccctgaagcccaactacatcccagattctggctgcagctacctgactgtgctgtttgaggagggcctcatccagagcctgaactacccagagaactacagcgacaaggccaactgtgactggatcttccaggccagcaagcaccacctgatcaagctgtccttccagagcctggagattgaggagagcggggactgcaccagtgactatgtgacagtgcacagtgatgtggagaggaagaaggagatcgcccggctgtgtggctatgatgtgcccacccctgtgctgagccccagcagcatcatgctgatctccttccagagtgatgaaaatggcacctgccggggcttccaggccaccgtgtccttcatccccaaggccggcaagaagattgagctgcccaccctgtggttccctgtgctgatcctggtgatgtag

SEQ ID NO: 40548 - DNA, 756 bp, Artificial Sequence
  Description of Artificial Sequence: Synthetic coding sequence
atgccccgggccttcctggtgcgcagccggcggccccagccccccaactggggccacctgcctgaccagctgcggggagatgcctacatcccagactgcagcagcctgggcggccccccagcccagcagagcagctctgtgcgggacccctggacagctgtgtctgtgctgggcacctgcccccccctgctgctgtgtgtgggcaatgccagccccttcctggtggcccctggccctgctgccaccggcatcagcagcagcggggcccaggacagcagcccccacgtggatgaccccctgtacctgtgcatgcactggaggaaggagagcgccagcaggaaccagcccacccagggcaacctgaccagcgccccccggggccctggcaccctgggctgccccctgtgccccaaggccttccccctgcagaggatgctgaccaggcacctgaagtgccacagccctgtgagaagacacctgtgccgctgctgcggcaagggcttccatgatgcctttgacctgaagaggcacatgaggacccacacaggcatccggcccttccgctgcagcgcctgtgggaaggccttcacccagcgctgcagcctggaggcccacctggccaaggtgcacggccagcctgccagctatgcctaccgggagcggcgggagaagctgcacgtgtgtgaggactgtggcttcaccagcagcaggccagacacctacgcccagcaccgggccctgcaccgggccgcctag

SEQ ID NO: 40549 - DNA, 1683 bp, Artificial Sequence
  Description of Artificial Sequence: Synthetic coding sequence
atgggcaagtggaggccccggggctgctgccggggcaacatgcagtgccggcaggaggtgcctgccaccctgaccagcagcgagctgttcagcaccaggaaccagccccagccccagccccagcccctgctggctgatgcccctgtgccctgggccgtggccagcaggatgtgcctgaccccaggccagggctgcggccaccagggccaggatgagggccccctgcctgcccccagccccccaccagccatgagcagcagcaggaaggaccacctgggcgccagcagcagcgagcccctgcctgtgatcatcgtgggcaatggccccagcggcatctgcctgagctacctgctgagcggctacaccccctacaccaagccagatgccatccacccccaccccctgctgcagaggaagctgacagaggcccctggggtgtccatcctggaccaggacctggactacctgtctgagggcctggagggccgcagccagagccctgtggccctgctgtttgatgccctgctgcggccagacacagactttggaggcaacatgaagtctgtgctgacctggaagcacaggaaggagcacgccatcccccacgtggtgctgggcaggaacctgcccggcggggcctggcacagcattgagggctccatggtgatcctgagccagggccagtggatgggcctgcctgacctggaggtgaaggactggatgcagaagaagagaagaggcctgaggaacagccgggccacagctggggacatcgcccactactacagagattatgtggtgaagaagggcctgggccacaactttgtgtctggagctgtggtgacagctgtggagtggggcaccccagaccccagcagctgtggggcccaggacagcagccccctcttccaggtgtctggcttcctgaccaggaaccaggcccagcagcccttcagcctgtgggccagaaatgtggtgctggccaccggcacctttgacagccctgcccggctgggcatccctggagaggccctgcccttcatccaccacgagctgagcgccctggaggccgccaccagggtgggcgctgtgaccccagccagtgaccctgtgctgatcatcggggccggcctgtctgctgctgatgctgtgctgtatgcccggcactacaacatccctgtgatccacgccttcagaagagctgtggatgatcctggcctggtgttcaaccagctgcccaagatgctgtacccagagtaccacaaggtgcaccagatgatgagggagcagagcatcctgagccccagcccctatgagggctaccgcagcctgcccaggcaccagctgctgtgcttcaaggaggactgccaggccgtgttccaggacctggagggcgtggagaaggtgtttggagtgtccctggtgctggtgctgattggcagccacccagacctgtccttcctgcctggagctggagctgactttgctgtggaccctgaccagcccctgagcgccaagaggaaccccattgatgtggaccccttcacctaccagagcacccggcaggagggcctgtatgccatgggccccctggccggggacaactttgtgcgctttgtgcagggcggggccctggccgtggccagcagcctgctgaggaaggagaccaggaagcccccatag

SEQ ID NO: 40550 - DNA, 1434 bp, Artificial Sequence
  Description of Artificial Sequence: Synthetic coding sequence
atgagcagcagcaggaaggaccacctgggcgccagcagcagcgagcccctgcccgtcatcatcgtgggcaatggccccagcggcatctgcctgagctacctgctgagcggctacaccccctacaccaagccagatgccatccacccccaccccctgctgcagaggaagctgacagaggcccctggggtgtccatcctggaccaggacctggactacctgtctgagggcctggagggccgcagccagagccctgtggccctgctgtttgatgccctgctgcggccagacacagactttggaggcaacatgaagtctgtgctgacctggaagcacaggaaggagcacgccatcccccacgtggtgctgggcaggaacctgcctggaggagcctggcacagcattgagggctccatggtgatcctgagccagggccagtggatgggcctgcctgacctggaggtgaaggactggatgcagaagaagaggcggggcctgaggaacagccgggccacagctggggacatcgcccactactacagagattatgtggtgaagaagggcctgggccacaactttgtgtctggagctgtggtgacagctgtggagtggggcaccccagaccccagcagctgtggggcccaggacagcagccccctcttccaggtgtctggcttcctgaccaggaaccaggcccagcagcccttcagcctgtgggccagaaatgtggtgctggccaccggcacctttgacagccctgcccggctgggcatccctggagaggccctgcccttcatccaccacgagctgagcgccctggaggccgccaccagggtgggcgctgtgaccccagccagtgaccctgtgctgatcattggagctggcctgtctgctgctgatgctgtgctgtatgcccggcactacaacatccctgtgattcatgccttccggcgggctgtggatgaccccggcctggtgttcaaccagctgcccaagatgctgtacccagagtaccacaaggtgcaccagatgatgagggagcagagcatcctgagccccagcccctatgagggctaccgcagcctgcccaggcaccagctgctgtgcttcaaggaggactgccaggccgtgttccaggacctggagggcgtggagaaggtgtttggagtgtccctggtgctggtgctgattggcagccacccagacctgtccttcctgcccggggccggggctgactttgctgtggaccctgaccagcccctgagcgccaagaggaaccccattgatgtggaccccttcacctaccagagcacccggcaggagggcctgtatgccatgggccccctggccggggacaactttgtgcgctttgtgcagggcggggccctggccgtggccagcagcctgctgaggaaggagaccaggaagccaccctag

SEQ ID NO: 40551 - DNA, 1434 bp, Artificial Sequence; identical to SEQ ID NO: 40550
  Description of Artificial Sequence: Synthetic coding sequence

SEQ ID NO: 40552 - DNA, 1518 bp, Artificial Sequence
  Description of Artificial Sequence: Synthetic coding sequence
atgcccctggtggaggagaccagcctgctggaggacagctctgtgaccttccctgtggtgatcattggaaatggccccagcggcatctgcctgagctacatgctgagcggctaccggccctacctgagcagcgaggccatccaccccaacaccatcctgaacagcaagctggaggaggcccggcacctgagcatcgtggaccaggacctggagtacctgtctgagggcctggagggccgcagcagcaaccctgtggccgtgctgtttgacaccctgctgcacccagatgctgactttggctatgactaccccagcgtgctgcactggaagctggagcagcaccactacatcccccacgtggtgctgggcaagggccccccaggaggagcctggcacaacatggagggctccatgctgaccatcagctttggctcctggatggagctgcccggcctgaagttcaaggactgggtgagcagcaagaggaggagcctgaagggggacagagtgatgcctgaggagatcgcccgctactacaagcactacgtgaaggtgatgggcctgcagaagaacttccgggagaacacctacatcacctctgtgtcccggctgtacagagaccaggatgatgatgacatccaggaccgggacatcagcaccaagcacctgcagatcgagaagagcaacttcatcaagaggaactgggagatccggggctaccagagaattgctgatggcagccacgtgcccttctgcctgtttgctgaaaatgtggccctggccaccggcaccctggacagccctgcccacctggagattgaaggagaggacttcccctttgtgttccacagcatgcctgagtttggagctgccatcaacaagggcaagctgcggggcaaggtggaccctgtgctgattgtgggcagcggcctgacagctgctgatgctgtgctgtgtgcctacaacagcaacatccctgtgattcatgtgttcagaagaagagtgacagaccccagcctcatcttcaagcagctgcccaagaagctgtacccagagtaccacaaggtgtaccacatgatgtgcacccagagctacagcgtggacagcaacctgctgagtgactacaccagcttccctgagcaccgggtgctgtccttcaagagtgacatgaagtgtgtgctgcagagcgtgtctggcctgaagaagatcttcaagctgtctgctgctgtggtgctgattggcagccaccccaacctgtccttcctgaaggaccagggctgctacctgggccacaagagcagccagcccatcacctgcaagggcaaccctgtggagattgacacctacacctatgagtgcatcaaggaggccaacctgtttgccctgggccccctggtgggggacaactttgtgcgcttcctgaagggcggggccctgggcgtgacccgctgcctggccacccggcagaagaagaagcacctgtttgtggagcggggcggcggagatggcatcgcctag

SEQ ID NO: 40553 - DNA, 1650 bp, Artificial Sequence
  Description of Artificial Sequence: Synthetic coding sequence
atgcctgtgtggtgctgccgctgcagcctggccggccacttcaggaactacagcgacacagaaacagaaggagagatcttcaacagcctggtgcagtactttggagacaacctgggcaggaaggtgaaggccatgcccctggtggaggagaccagcctgctggaggacagctctgtgaccttccctgtggtgatcattggaaatggccccagcggcatctgcctgagctacatgctgagcggctaccggccctacctgagcagcgaggccatccaccccaacaccatcctgaacagcaagctggaggaggcccggcacctgagcatcgtggaccaggacctggagtacctgtctgagggcctggagggccgcagcagcaaccctgtggccgtgctgtttgacaccctgctgcacccagatgctgactttggctatgactaccccagcgtgctgcactggaagctggagcagcaccactacatcccccacgtggtgctgggcaagggccccccaggaggagcctggcacaacatggagggctccatgctgaccatcagctttggctcctggatggagctgcccggcctgaagttcaaggactgggtgagcagcaagaggaggagcctgaagggggacagagtgatgcctgaggagatcgcccgctactacaagcactacgtgaaggtgatgggcctgcagaagaacttccgggagaacacctacatcacctctgtgtcccggctgtacagagaccaggatgatgatgacatccaggaccgggacatcagcaccaagcacctgcagatcgagaagagcaacttcatcaagaggaactgggagatccggggctaccagagaattgctgatggcagccacgtgcccttctgcctgtttgctgaaaatgtggccctggccaccggcaccctggacagccctgcccacctggagattgaaggagaggacttcccctttgtgttccacagcatgcctgagtttggagctgccatcaacaagggcaagctgcggggcaaggtggaccctgtgctgattgtgggcagcggcctgacagctgctgatgctgtgctgtgtgcctacaacagcaacatccctgtgattcatgtgttcagaagaagagtgacagaccccagcctcatcttcaagcagctgcccaagaagctgtacccagagtaccacaaggtgtaccacatgatgtgcacccagagctacagcgtggacagcaacctgctgagtgactacaccagcttccctgagcaccgggtgctgtccttcaagagtgacatgaagtgtgtgctgcagagcgtgtctggcctgaagaagatcttcaagctgtctgctgctgtggtgctgattggcagccaccccaacctgtccttcctgaaggaccagggctgctacctgggccacaagagcagccagcccatcacctgcaagggcaaccctgtggagattgacacctacacctatgagtgcatcaaggaggccaacctgtttgccctgggccccctggtgggggacaactttgtgcgcttcctgaagggcggggccctgggcgtgacccgctgcctggccacccggcagaagaagaagcacctgtttgtggagcggggcggcggagatggcatcgcctag

SEQ ID NO: 40554 - DNA, 1584 bp, Artificial Sequence
  Description of Artificial Sequence: Synthetic coding sequence
atgtctgaggacagcagcgccctgccctggagcatcaacagagatgattatgagctgcaggaggtgattggcagcggggccacagctgtggtgcaggccgcctactgtgcccccaagaaggagaaggtggccatcaagaggatcaacctggagaagtgccagacctccatggatgagctgctgaaggagatccaggccatgagccagtgccaccaccccaacatcgtgtcctactacaccagctttgtggtgaaggatgagctgtggctggtgatgaagctgctgagcggcggctctgtgctggacatcatcaagcacatcgtggccaagggggagcacaagtctggagtgctggatgagagcaccatcgccaccatcctgcgggaggtgctggagggcctggagtacctgcacaagaatggccagatccacagagatgtgaaggccggcaacatcctgctgggggaggatggctctgtgcagattgctgactttggagtgtctgccttcctggccactggaggagacatcaccaggaacaaggtgaggaagacctttgtgggcaccccctgctggatggcccctgaggtgatggagcaggtgcggggctatgacttcaaggctgacatctggagctttggcatcacagccatcgagctggccaccggggccgccccctaccacaagtacccacccatgaaggtgctgatgctgaccctgcagaatgacccccccagcctggagactggagtgcaggacaaggagatgctgaagaagtatggcaagagcttcaggaagatgatcagcctgtgcctgcagaaggaccctgagaagaggcccacagctgctgagctgctgcggcacaagttcttccagaaggccaagaacaaggagttcctgcaggagaagaccctgcagagggcccccaccatcagcgagcgggccaagaaggtgagaagagtgcccggcagcagcggccgcctgcacaagacagaagatggcggctgggagtggagcgatgatgaatttgatgaggagagcgaggagggcaaggccgccatcagccagctgcggagcccccgggtgaaggagagcatcagcaacagcgagctgttccccaccacagatcctgtgggcaccctgctgcaggtgcctgagcagatcagcgcccacctgccccagcctgctggccagatcgccacccagcccacccaggtgtccctgcccccaacagctgagcccgccaagacagcccaggccctgagcagcggcagcggcagccaggagaccaagatccccatcagcctggtgctgcggctgaggaacagcaagaaggagctgaatgacatccgctttgagttcaccccaggccgggacacagctgagggcgtgtcccaggagctgatctctgctggcctggtggatggccgggacctggtgattgtggccgccaacctgcagaagatcgtggaggagccccagagcaacagatctgtgaccttcaagctggccagcggcgtggagggcagtgacatcccagatgatggcaagctgattggatttgcccagctgagcatctcctag

SEQ ID NO: 40555 - DNA, 309 bp, Artificial Sequence
  Description of Artificial Sequence: Synthetic coding sequence
atgtctgcccgggtgcgcagccgcagccggggcagaggagatggccaggaggccccagatgtggtggcctttgtggcccctggagagagccagcaggaggagcccccaacagacaaccaggacatcgagcccggccaggagcgggagggcaccccacccatcgaggagaggaaggtggagggggactgccaggagatggacctggagaagaccaggagtgaaagaggagatggcagtgatgtgaaggagaagaccccacccaaccccaagcacgccaagaccaaggaggccggagatggccagccctag

SEQ ID NO: 40556 - DNA, 336 bp, Artificial Sequence
  Description of Artificial Sequence: Synthetic coding sequence
atgtctgagcacgtgaggaccaggagccagagcagcgagagaggaaatgaccaggagagcagccagcctgtgggcagcgtcatcgtgcaggagcccacagaggagaagaggcaggaggaggagcccccaacagacaaccagggcatcgcccccagcggggagattgaaaatgaaggagccccagctgtgcagggccctgacatggaggccttccagcaggagctggccctgctgaagattgaagatgagcctggagatggcccagatgtgcgggagggcatcatgcccacctttgacctgaccaaggtgctggaggccggagatgcccagccctag

SEQ ID NO: 40557 - DNA, 285 bp, Artificial Sequence
  Description of Artificial Sequence: Synthetic coding sequence
atgtctgagcacgtgaggaccaggagccagagcagcgagagaggaaatgaccaggagagcagccagcctgtgggcagcgtcatcgtgcaggagcccacagaggagaagaggcaggaggaggagcccccaacagacaaccagggccctgacatggaggccttccagcaggagctggccctgctgaagattgaagatgagcctggagatggcccagatgtgcgggagggcatcatgcccacctttgacctgaccaaggtgctggaggccggagatgcccagccctag

SEQ ID NO: 40558 - DNA, 393 bp, Artificial Sequence
  Description of Artificial Sequence: Synthetic coding sequence
atgcaggccccctgggccggcaacagaggctgggccggcacccgggaggaggtgcgggacatgtctgagcacgtgaccaggagccagagcagcgagagaggaaatgaccaggagagcagccagcctgtgggccctgtgattgtgcagcagcccacagaggagaagaggcaggaggaggagcccccaacagacaaccagggcatcgcccccagcggggagatcaagaatgaaggagccccagctgtgcagggcacagatgtggaggccttccagcaggagctggccctgctgaagattgaagatgcccctggagatggcccagatgtgcgggagggcaccctgcccacctttgaccccaccaaggtgctggaggccggggagggccagctgtag

SEQ ID NO: 40559 - DNA, 282 bp, Artificial Sequence
  Description of Artificial Sequence: Synthetic coding sequence
atgtctgagcacgtgaccaggagccagagcagcgagagaggaaatgaccaggagagcagccagcctgtgggccctgtgattgtgcagcagcccacagaggagaagaggcaggaggaggagcccccaacagacaaccagggcacagatgtggaggccttccagcaggagctggccctgctgaagattgaagatgcccctggagatggcccagatgtgcgggagggcaccctgcccacctttgaccccaccaaggtgctggaggccggggagggccagctgtag

SEQ ID NO: 40560 - DNA, 333 bp, Artificial Sequence
  Description of Artificial Sequence: Synthetic coding sequence
atgtctgagcacgtgaccaggagccagagcagcgagagaggaaatgaccaggagagcagccagcctgtgggccctgtgattgtgcagcagcccacagaggagaagaggcaggaggaggagcccccaacagacaaccagggcatcgcccccagcggggagatcaagaatgaaggagccccagctgtgcagggcacagatgtggaggccttccagcaggagctggccctgctgaagattgaagatgcccctggagatggcccagatgtgcgggagggcaccctgcccacctttgaccccaccaaggtgctggaggccggggagggccagctgtag

SEQ ID NO: 40561 - DNA, 3273 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctggggtgggctgggagaatgtgctgctgaaggagggggagagcgccagcaatgccacagagaccagcggccctgacatgaccatcaagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagctctgtgctggaggccaccagggtgaacagaaggaagagcgccctggccctgcgctgggaggccggcatctatgccaaccaggaggaggaggacaatgaatag

SEQ ID NO: 40562 - DNA, 3312 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctggggtgggctgggagaatgtgctgctgaaggagggggagagcgccagcaatgccacagagaccagcggccctgacatgaccatcaagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagcagctacaccagcaagctgctgagctgcaaggtgaccagcgaggtgctggaggccaccagggtgaacagaaggaagagcgccctggccctgcgctgggaggccggcatctatgccaaccaggaggaggaggacaatgaatag

SEQ ID NO: 40563 - DNA, 1302 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctgctgtgtatgccatggagatcaacgtggagaaggacaagcagacaggagagaccaagatcctgagcaccagcaccatcggccctgagggcgtgcaccagaagggcgtgaaggtgtatgatgatggcaccaaggtggtgtatgaggtgcgcagcggcggcaccgtggtggagaatggagtgcacaagctgagcaccaaggatgtggaggagctgatccagaaggccggccagagcagcctgggcggcggccacgtgtctgagaggacagtgattgctgatggcagcctgagccaccccaaggagcacatgctgtgcaaggaggccaagctggagatggtgcacaagagcaggaaggaccacagcagcggcaaccctggccagcaggcccaggcccccagcgctgctggccctgaggccaacctggaccagcctgtgaccatgatcttcatgggctaccagaacattgaagatgaggaggagaccaagaaggtgctgggctatgatgagaccatcaaggccgagctggtgctgattgatgaagatgatgagaagagcctgcgggagaagacagtgacagatgtgtccaccattgatggaaatgctgctgagctggtgtctggccggcctgtgtctgacaccacagagcccagcagccctgagggcaaggaggagagcctggccacagagcccgcccctggggtgggctgggagaatgtgctgctgaaggagggggagagcgccagcaatgccacagagaccagcggccctgacatgaccatcaagaagccaccccagctgtctgagtag

SEQ ID NO: 40564 - DNA, 1404 bp, Artificial Sequence
  Description of Artificial Sequence: Synthetic coding sequence
atgctgatcttctggaccatcaccctcttcctgctgggcgccgccaagggcaaggaggtgtgctatgaggacctgggctgcttcagtgacacagagccctggggcggcacagccatccggcccctgaagatcctgccctggagccctgagaagattggcacccgcttcctgctgtacaccaatgaaaaccccaacaacttccagatcctgctgctgagtgaccccagcaccatcgaggccagcaacttccagatggacaggaagacccgcttcatcatccacggcttcatcgacaagggagatgagagctgggtgacagacatgtgcaagaagctgtttgaggtggaggaggtgaactgcatctgtgtggactggaagaagggcagccaggccacctacacccaggccgccaacaacgtgcgggtggtgggcgcccaggtggcccagatgctggacatcctgctgacagagtacagctacccacccagcaaggtgcacctgattggccacagcctgggcgcccacgtggccggggaggccggcagcaagaccccaggcctgagccgcatcaccggcctggaccctgtggaggccagctttgagagcaccccagaggaggtgcggctggaccccagtgatgctgactttgtggatgtgatccacacagatgctgcccccctcatccccttcctgggcttcggcaccaaccagcagatgggccacctggacttcttccccaatggaggagagagcatgcctggctgcaagaagaatgccctgagccagatcgtggacctggatggcatctgggccggcacccgggactttgtggcctgcaaccacctgcggagctacaagtactacctggagagcatcctgaacccagatggctttgctgcctacccctgcaccagctacaagagctttgaaagtgacaagtgcttcccctgcccagaccagggctgcccccagatgggccactatgctgacaagtttgctggccgcaccagcgaggagcagcagaagttcttcctgaacacaggagaggccagcaactttgcccgctggaggtatggagtgtccatcaccctgagcggccgcacagccaccggccagatcaaggtggccctgtttggaaataaaggaaacacccaccagtacagcatcttccggggcatcctgaagccaggcagcacccacagctatgaatttgatgccaagctggatgtgggcaccatcgagaaggtgaagttcctgtggaacaacaacgtcatcaaccccaccctgcccaaggtgggcgccaccaagatcaccgtgcagaagggggaggagaagacagtgtacaacttctgcagtgaagatactgtgcgggaggacaccctgctgaccctgaccccctgctag

SEQ ID NO: 40565 - DNA, 1407 bp, Artificial Sequence
  Description of Artificial Sequence: Synthetic coding sequence
atgctgcccccctggaccctgggcctgctgctgctggccaccgtgcggggcaggaaggtgtgctacggccagctgggctgcttcagtgatgagaagccctgggccggcaccctgcagaggcctgtgaagctgctgccctggagccctgaggacatcgacacccgcttcctgctgtacaccaatgaaaaccccaacaacttccagctgatcactggaacagagccagacaccatcgaggccagcaacttccagctggacaggaagacccgcttcatcatccacggcttcctggacaaggcagaagattcctggcccagcgacatgtgcaagaagatgtttgaggtggagaaggtgaactgcatctgtgtggactggaggcatggcagccgggccatgtacacccaggccgtgcagaacatccgggtggtgggcgctgagacagccttcctgatccaggccctgagcacccagctgggctacagcctggaggatgtgcacgtgattggccacagcctgggcgcccacacagctgctgaggccggccggcggctgggcggccgggtgggccgcatcaccggcctggaccctgctggcccctgcttccaggatgagcctgaggaggtgcggctggaccccagtgatgctgtgtttgtggatgtgatccacacagacagcagccccatcgtgcccagcctgggcttcggcatgagccagaaggtgggccacctggacttcttccccaacggcggcaaggagatgcctggctgcaagaagaatgtgctgagcaccatcacagacattgatggcatctgggagggcatcggcggctttgtgtcctgcaaccacctgcggagctttgagtactacagcagctctgtgctgaacccagatggcttcctgggctacccctgtgccagctatgatgagttccaggagagcaagtgcttcccctgcccagctgagggctgccccaagatgggccactacgccgaccagttcaagggcaagaccagcgctgtggagcagaccttcttcctgaacacaggagagagcggcaacttcaccagcaagtacaagatctctgtgaccctgagcggcaaggagaaggtgaatggctacatccgcatcgccctgtatggcagcaatgaaaacagcaagcagtatgagatcttcaagggcagcctgaagccagatgccagccacacctgtgccattgatgtggacttcaacgtgggcaagatccagaaggtgaagttcctgtggaacaagaggggcatcaacctgtctgagcccaagctgggcgccagccagatcaccgtgcagagcggggaggatggaacagagtacaacttctgcagcagtgacacagtggaggagaatgtgctgcagagcctgtacccctgctag

SEQ ID NO: 40566 - DNA, 423 bp, Artificial Sequence
  Description of Artificial Sequence: Synthetic coding sequence
atggccgccatccccagcagcggcagcctggtggccacccatgactactacagaagaaggctgggcagcaccagcagcaacagcagctgcagcagcacagagtgccctggagaggccatcccccaccccccaggagagtgcagaattgcccccttcagccccaggagcagccgctcctggcagcaccaggaccccaccagcctgctgagcggcctgcccaaggctgaccccggccactggtgggccagcttcttcttcggcaagagcaccctgcccttcatggccaccgtgctggagagcgctgagcacagcgagcccccccaggccagcagctccatgacagcctgtggcctggccagagatgcccccaggaagcagcccggcggccagagcagcacagccagcgctggcccccccagctag

SEQ ID NO: 40567 - DNA, 213 bp, Artificial Sequence
  Description of Artificial Sequence: Synthetic coding sequence
atggccgccatccccagcagcggcagcctggtggccacccatgactactacagaagaaggctgggcagcaccagcagcaacagcagctgcagcagcacagagtgccctggagaggccatcccccaccccccaggcctgcccaaggctgaccccggccactggtgggccagcttcttcttcggcaagagcaccctgcccccacccaccctgtag

SEQ ID NO: 40568 - DNA, 345 bp, Artificial Sequence
  Description of Artificial Sequence: Synthetic coding sequence
atggccgccatccccagcagcggcagcctggtggccacccatgactactacagaagaaggctgggcagcaccagcagcaacagcagctgcagcagcacagagtgccctggagaggccatcccccaccccccaggcctgcccaaggctgaccccggccactggtgggccagcttcttcttcggcaagagcaccctgcccttcatggccaccgtgctggagagcgctgagcacagcgagcccccccaggccagcagctccatgacagcctgtggcctggccagagatgcccccaggaagcagcccggcggccagagcagcacagccagcgctggcccccccagctag

SEQ ID NO: 40569 - DNA, 1860 bp, Artificial Sequence
  Description of Artificial Sequence: Synthetic coding sequence
atgtaccgcagcggggagcggctgctgggcagccacgccctgcctgctgagcagagggacttcctgcccctggagaccaccaacaacaacaacaaccaccaccagcccggggcctgggccaggagagctggcagcagcgccagcagcccccccagcgccagcagcagcccccaccccagcgctgctgtgcctgctgctgaccctgctgacagcgccagcggcagcagcaacaagaggaagagggacaacaagcccagcggcggccgggctgctgggggcggccgggcagatggcggcggcgtggtgtacagcggcaccccctggaagagaagaaactacaaccagggcgtggtgggcctgcacgaggagatcagtgacttctatgagtacatgagccccaggcctgaggaggagaagatgaggatggaggtggtgaaccgcatcgagagcgtcatcaaggagctgtggcccagcgcagatgtgcagatcttcggcagcttcaagacaggcctgtacctgcccaccagtgacatcgacctggtggtgtttgggaagtgggagaacctgcccctgtggaccctggaggaggccctgaggaagcacaaggtggctgatgaggacagcgtgaaggtgctggacaaggccaccgtgcccatcatcaagctgacagacagcttcacagaggtgaaggtggacatctccttcaacgtgcagaatggagtgcgggctgctgacctgatcaaggacttcaccaagaagtaccctgtgctgccctacctggtgctggtgctgaagcagttcctgctgcagagggacctgaatgaggtgttcaccggcggcatcggcagctacagcctcttcctgatggctgtgtccttcctgcagctgcacccccgggaggatgcctgcatccccaacaccaactatggagtgctgctgattgagttctttgagctgtatggccgccacttcaactacctgaagacaggcatccgcatcaaggatggcggcagctatgtggccaaggatgaggtgcagaagaacatgctggatggctaccggcccagcatgctgtacatcgaggaccccctgcagcctggaaatgatgtgggccgcagcagctatggagccatgcaggtgaagcaggcctttgattatgcctacgtggtgctgagccatgctgtgagccccatcgccaagtactaccccaacaatgaaacagagagcatcctgggccgcatcatccgggtgacagatgaggtggccacctacagagactggatcagcaagcagtggggcctgaagaacagacctgagcccagctgcaatggaaatggagtgaccctcatcgtggacacccagcagctggacaagtgcaacaacaacctgtctgaggagaatgaggccctgggcaagtgccgcagcaagaccagcgagagcctgagcaagcacagcagcaacagcagcagcggccctgtgagcagcagcagcgccacccagagcagcagcagtgatgtggacagtgatgccaccccctgcaagacccccaagcagctgctgtgccggcccagcactggaaacagagtgggcagccaggatgtgtccctggagagcagccaggccgtgggcaagatgcagagcacccagaccaccaacaccagcaacagcaccaacaagagccagcacggcagcgcccggctcttccgcagcagcagcaagggcttccagggcaccacccagaccagccacggcagcctgatgaccaacaagcagcaccagggcaagagcaacaaccagtactaccacggcaagaagaggaagcacaagagagatgcccccctgagtgacctgtgcaggtag

SEQ ID NO: 40570 - DNA, 2097 bp, Artificial Sequence
  Description of Artificial Sequence: Synthetic coding sequence
atgaggccccggcccaggtctgcccctgggaagccccggcggcgcagccgggcccggctgcggagcagcaggaccccatctggaggagccagcggcggcggcggcagcagcagcagcagcagcacagccaccggcggcagcggcagcagcacaggcagccctgggggcgccgccagcgccccagccccagccccagctggcatgtacagaagtggagagcggctgctgggcagccacgccctgcctgctgagcagagggacttcctgcccctggagaccaccaacaacaacaacaaccaccaccagcccggggcctgggcccggcgggccggcagcagcgccagcagccccccatctgccagcagcagcccccaccccagcgctgctgtgcctgctgctgaccctgctgacagcgccagcggcagcagcaacaagaggaagagggacaacaaggccagcacctacggcctgaactacagcctgctgcagcccagcggcggccgggccgccggcggcggccgggcagatggcggcggcgtggtgtacagcggcaccccctggaagagaagaaactacaaccagggcgtggtgggcctgcacgaggagatcagtgacttctatgagtacatgagccccaggcctgaggaggagaagatgaggatggaggtggtgaacagaattgaatctgtcatcaaggagctgtggcccagcgcagatgtgcagatcttcggcagcttcaagacaggcctgtacctgcccaccagtgacatcgacctggtggtgtttgggaagtgggagaacctgcccctgtggaccctggaggaggccctgaggaagcacaaggtggctgatgaagattctgtgaaggtgctggacaaggccaccgtgcccatcatcaagctgacagacagcttcacagaggtgaaggtggacatctccttcaacgtgcagaatggagtgcgggctgctgacctgatcaaggacttcaccaagaagtaccctgtgctgccctacctggtgctggtgctgaagcagttcctgctgcagagggacctgaatgaggtgttcaccggcggcatcggcagctacagcctcttcctgatggctgtgtccttcctgcagctgcaccccagagaagatgcctgcatccccaacaccaactacggcgtgctgctgattgagttctttgagctgtatggccgccacttcaactacctgaagacaggcatccgcatcaaggatggcggcagctatgtggccaaggatgaggtgcagaagaacatgctggatggctaccggcccagcatgctgtacatcgaggaccccctgcagcctggaaatgatgtgggccgcagcagctatggagccatgcaggtgaagcaggcctttgattatgcctacgtggtgctgagccatgctgtgagccccatcgccaagtactaccccaacaatgaaacagagagcatcctgggccgcatcatccgggtgacagatgaggtggccacctacagagactggatcagcaagcagtggggcctgaagaacagacctgagcccagctgcaatggaaatggagtgaccctgattgtggacacccagcagctggacaagtgcaacaacaacctgtctgaagaaaatgaggccctgggcaaatgtcgcagcaagaccagcgagagcctgagcaagcacagcagcaacagcagcagcggccctgtgagcagcagcagcgccacccagagcagcagcagtgatgtggacagtgatgccaccccctgcaagacccccaagcagctgctgtgccggcccagcacaggcaacagagtgggcagccaggatgtgtccctggagagcagccaggccgtgggcaagatgcagagcacccagaccaccaacaccagcaacagcaccaacaagagccagcacggcagcgcccggctcttccgcagcagcagcaagggcttccagggcaccacccagaccagccacggcagcctgatgaccaacaagcagcaccagggcaagagcaacaaccagtactaccacggcaagaagaggaagcacaagagagatgcccccctgagtgacctgtgcaggtag

SEQ ID NO: 40571 - DNA, 522 bp, Artificial Sequence
  Description of Artificial Sequence: Synthetic coding sequence
atggacatcgagaaggtgaacagcatggacctgggggagtttgtggatgtgtttggaaatgccacagagcgctgccccctgattgctgctgctgtgtggagccagaggcccttcagtgacctggaggacctggagaagcacttctttgccttcattgatgccctggcccagagcggccaggagggcatcctgcgctgccacccagacctggccggcagcgagctgcagaggggcaccctgacagctgagagccagcgggagcagagcggggccggcctgcggagcctgggcgcagatgagcggctgcggctggccgagctgaatgcccagtaccgggccaggtttggcttcccctttgtgctggccgcccgcttcagtgacagaacagctgtgccccgggagctggcccggcggctgctgtgccccagcgcccaggagctgaggacagccctgggggaggtgaagaagattggcagcctgcggctggccgacctgctgcgggctgaccctgccaagctgtag

SEQ ID NO: 40572 - DNA, 2022 bp, Artificial Sequence
  Description of Artificial Sequence: Synthetic coding sequence
atggccgagagcagcctgtaccggcagaggctggaggtgattgctgagaagaggcggctgcaggaggagatccgggccgcccggcgggaggtggaggaggagaagctgcgggtggagcggctgaagaggaagagcctgcgggagcgctggctgatggatggagctgctgctgtgcctgagcccagcgaggaccccaccagcaaggacccccagagccctgagggccaggcccaggcccgcatccggaacctggaggacagcctcttcaccctgcagagccagctgcagctgctgcagagcgccagcactggagcccagcacaagcccagcggccggcccagctggaggcggcagggccaccggcccctgagccagagcatcgtggaggccggctctgtgggccagacagacctgaacaagagggccagcctgcctgctggcctggtgggcaccccacctgagagccccagcgagcccagagaagatgtgctgggcttcctgcccggcccccggcaggtgcctggagctgctggggacagcagcgaggccaacggcccctgccccagccccatccccaccccagagcagggcctgagccagagagctgtgcccagcgagggccgggtgggggaggccaagggcggcggcgtggtgtctgtggtgtgggagggcctgcgggccacagaggactgtgccactggagccaccggccctgagctggaggccaaggtggaggaggtggtgctggaggccatcggggacaggaagggggccggcagcctggagctgcctgcctgggtgaaggaggaccggggcatcgtggaggtggtgtgggagggcgtgggcggcagtgatgctgaggccatgggagagatcggccgggtgcctgaggtggtgcagaccagcagcccccggctgcaggagcggctggaggccgccgccagcattgaaggagaagatgtgccccagggcagcccagaaggagatggccagggcggcagcggcggggaggagggcagcttcatctgggtggagcgggtgaccctgtctgaggagtgggaggagctgctggtggagggcctggagggccctgaggtggccggccgggagagaggagatgagagccccctgggcgctgagggcgccaagacaggaggaggagaggagacctgggaggccgagaagaggaaggccgaggagagcatgggcatcggcagcgaggagaagccaggcaccggcagagatgaagctgagatgagccctgtggtggagaggaagggcggggagaagaagctggagctggagagccggggcagcgctgagaagctgggcacagagcgggagggcggggaggagcccctgggcatcgagaggaaggtggagggccacctgcgggcagagaaggagggagatgaggagaagagaggagctgaggaggaggaggtggaggagcccctgggcgtggagaagaagggcggggaggaggagcctgaggccaccaaggagcccctggaggccgagaggaaaggaggagaggagaccctggaggccgagaagagaggaggagaggagagcctggagacagagaagacccagggcacagaaggagacctgaacctggagcagggcagccgggagggcagcgagagccaggccgaggagatgaatgaggccggcccccccctggaggccaacacagagaccaggcctgagaaggagggcccccagccccaggagaagcctgtgggcgccctggaggaggagggcgtgaagccccagacagctgctgagggccagggccccctgggagatgccacccccctgctggccgagaccccagcccctgagcagcctgctgagtgccagcccctgctgcagggcgagggccccagcgccaaccccagcgcccaccctgtgcccacctacgccccagcccggcagcctgagcccagcgcccccacagaaggagaggaggccagcggccccaagcagaagacctgccagtgctgtgctgtgatgtag

SEQ ID NO: 40573 - DNA, 1347 bp, Artificial Sequence
  Description of Artificial Sequence: Synthetic coding sequence
atggccctgaccctgctggaggactggtgcaagggcatggacatggaccccaggaaggccctgctgattgtgggcatccccatggagtgcagcgaggtggagatccaggacacagtgaaggccggcctgcagcccctgtgtgcctacagagtgctgggccgcatgttcagaagagaagataatgccaaggctgtgttcatcgagctggccgacacagtgaactacaccaccctgcccagccacatccctggaaaaggaggctcctgggaggtggtggtgaagcccaggaacccagatgatgagttcctgagccggctgaactacttcctgaaggatgagggccgctccatgacagatgtggcccgggccctgggctgctgcagcctgcctgctgagagcctggatgctgaggtgatgccccaggtgcgcagcccccccctggagccccccaaggagagcatgtggtacaggaagctgaaggtgttttctggaacagccagccccagccctggagaggagacctttgaggactggctggagcaggtgacagagatcatgcccatctggcaggtgtctgaggtggagaagagaagaaggctgctggagagcctgcggggccctgccctgagcatcatgagggtgctgcaggccaacaatgacagcatcaccgtggagcagtgcctggatgccctgaagcagatctttggagacaaggaggacttccgggccagccagttccgcttcctgcagaccagccccaagattggagagaaggtgtccaccttcctgctgcggctggagcccctgctgcagaaggctgtgcacaagagccccctgtctgtgcgcagcacagacatgatccggctgaagcacctgctggcccgggtggccatgaccccagccctgcggggcaagctggagctgctggaccagaggggctgcccccccaacttcctggagctgatgaagctgatcagagatgaggaggagtgggagaacacagaggccgtgatgaagaacaaggagaagcccagcggccggggccgcggggccagcggccggcaggcccgggcagaggcctctgtgtctgccccccaggccaccgtgcaggcccgctccttcagtgacagcagcccccagaccatccagggcggcctgccccccctggtgaagagaagaaggctgctgggcagcgagagcaccagaggagaggaccacggccaggccacctaccccaaggccgagaaccagaccccaggccgggagggcccccaggccgccggggaggagctgggcaatgaagctggagctggggccatgagccaccccaagccctgggagacctag

SEQ ID NO: 40574 - DNA, 423 bp, Artificial Sequence
  Description of Artificial Sequence: Synthetic coding sequence
atggccctgaccctgctggaggactggtgcaagggcatggacatggaccccaggaaggccctgctgattgtgggcatccccatggagtgcagcgaggtggagatccaggacacagtgaaggccggcctgcagcccctgtgtgcctacagagtgctgggccgcatgttcagaagagaagataatgccaaggctgtgttcatcgagctggccgacacagtgaactacaccaccctgcccagccacatccctggaaaaggaggctcctgggaggtggtggtgaagcccaggaacccagatgatgagttcctgagccggctgaactacttcctgaaggatgagggccgctccatgacagatgtggcccgggccctgggctgctgcagcctgcctgctgagagcctggatgctgaggtgatgccctag

SEQ ID NO: 40575 - DNA, 1347 bp, Artificial Sequence; identical to SEQ ID NO: 40573
  Description of Artificial Sequence: Synthetic coding sequence

SEQ ID NO: 40576 - DNA, 1347 bp, Artificial Sequence; identical to SEQ ID NO: 40573
  Description of Artificial Sequence: Synthetic coding sequence

SEQ ID NO: 40577 - DNA, 1347 bp, Artificial Sequence; identical to SEQ ID NO: 40573
  Description of Artificial Sequence: Synthetic coding sequence

SEQ ID NO: 40578 - DNA, 1200 bp, Artificial Sequence
  Description of Artificial Sequence: Synthetic coding sequence
atggctgtgaccatgctgcaggactggtgccgctggatgggcgtgaatgcccggcggggcctgctgatcctgggcatccctgaggactgtgatgatgctgagttccaggagagcctggaggccgccctgcggcccatgggccacttcaccgtgctgggcaaggtgttccgggaggaggacaatgccacagctgccctggtggagctggaccgggaggtgaactatgccctggtgccccgggagatccctggcactggaggcccctggaatgtggtgtttgtgccccgctgcagcggggaggagttcctgggcctgggccgggtcttccacttccctgagcaggagggccagatggtggagagcgtggccggggccctgggcgtgggcctgcggcgggtgtgctggctgcggagcatcggccaggccgtgcagccctgggtggaggccgtgcgctaccagagcctgggcgtcttcagcggccgggaccagcctgcccctggagaggagagctttgaggtgtggctggaccacaccacagagatgctgcacgtgtggcagggcgtgtctgagcgggagaggagaagaaggctgctggagggcctgcggggcacagccctgcagctggtgcacgccctgctggctgaaaatcctgccaggacagcccaggactgcctggccgccctggcccaggtgtttggagacaatgaaagccaggccaccatccgggtgaagtgcctgacagcccagcagcagagcggggagcggctgagcgcctttgtgctgcggctggaggtgctgctgcagaaggccatggagaaggaggccctggcccgggccagcgctgacagagtgcggctgcggcagatgctgacccgggcccacctgacagagcccctggatgaggccctgaggaagctgaggatggccggccgcagccccagcttcctggagatgctgggcctggtgcgggagagcgaggcctgggaggccagcctggcccggtctgtgcgggcccagacccaggagggcgctggggcccgggccggggcccaggccgtggcccgggccagcaccaaggtggaggccgtgcctgggggccctggccgggagcctgagggcctgcggcaggccggcggccaggaggccgaggagctgctgcaggagggcctgaagcctgtgctggaggagtgtgacaactag

SEQ ID NO: 40579 - DNA, 1200 bp, Artificial Sequence; identical to SEQ ID NO: 40578
  Description of Artificial Sequence: Synthetic coding sequence

SEQ ID NO: 40580 - DNA, 1200 bp, Artificial Sequence; identical to SEQ ID NO: 40578
  Description of Artificial Sequence: Synthetic coding sequence

SEQ ID NO: 40581 - DNA, 1200 bp, Artificial Sequence
  Description of Artificial Sequence: Synthetic coding sequence
atggctgtgaccatgctgcaggactggtgccgctggatgggcgtgaatgcccggcggggcctgctgatcctgggcatccctgaggactgtgatgatgctgagttccaggagagcctggaggccgccctgcggcccatgggccacttcaccgtgctgggcaaggccttccgggaggaggacaatgccacagctgccctggtggagctggaccgggaggtgaactatgccctggtgccccgggagatccctggcactggaggcccctggaatgtggtgtttgtgccccgctgcagcggggaggagttcctgggcctgggccgggtcttccacttccctgagcaggagggccagatggtggagagcgtggccggggccctgggcgtgggcctgcggcgggtgtgctggctgcggagcatcggccaggccgtgcagccctgggtggaggccgtgcgctgccagagcctgggcgtcttcagcggccgggaccagcctgcccctggagaggagagctttgaggtgtggctggaccacaccacagagatgctgcacgtgtggcagggcgtgtctgagcgggagaggagaagaaggctgctggagggcctgcggggcacagccctgcagctggtgcacgccctgctggctgaaaatcctgccaggacagcccaggactgcctggccgccctggcccaggtgtttggagacaatgaaagccaggccaccatccgggtgaagtgcctgacagcccagcagcagagcggggagcggctgagcgcctttgtgctgcggctggaggtgctgctgcagaaggccatggagaaggaggccctggcccgggccagcgctgacagagtgcggctgcggcagatgctgacccgggcccacctgacagagcccctggatgaggccctgaggaagctgaggatggccggccgcagccccagcttcctggagatgctgggcctggtgcgggagagcgaggcctgggaggccagcctggcccggtctgtgcgggcccagacccaggagggcgctggggcccgggccggggcccaggccgtggcccgggccagcaccaaggtggaggccgtgcctgggggccctggccgggagcctgagggcctgctgcaggccggcggccaggaggccgaggagctgctgcaggagggcctgaagcctgtgctggaggagtgtgacaactag

SEQ ID NO: 40582 - DNA, 1200 bp, Artificial Sequence; identical to SEQ ID NO: 40581
  Description of Artificial Sequence: Synthetic coding sequence

SEQ ID NO: 40583 - DNA, 1347 bp, Artificial Sequence; identical to SEQ ID NO: 40573
  Description of Artificial Sequence: Synthetic coding sequence

SEQ ID NO: 40584 - DNA, 1347 bp, Artificial Sequence; identical to SEQ ID NO: 40573
  Description of Artificial Sequence: Synthetic coding sequence

SEQ ID NO: 40585 - DNA, 1347 bp, Artificial Sequence; identical to SEQ ID NO: 40573
  Description of Artificial Sequence: Synthetic coding sequence

SEQ ID NO: 40586 - DNA, 1347 bp, Artificial Sequence; identical to SEQ ID NO: 40573
  Description of Artificial Sequence: Synthetic coding sequence

SEQ ID NO: 40587 - DNA, 1908 bp, Artificial Sequence
  Description of Artificial Sequence: Synthetic coding sequence
atggccatgagcctgctgcaggactggtgccgcagcctggatgtggatgcccaccgggccctgctggtgacaggcatccctgagggcctggagcaggctgatgtggaggccgtgctgcagcccaccctgctgcccctgggcaccttccggctgcggcacatgaaggccctgatgaatgagaaggcccaggccgccctggtggagtttgtggaggatgtgaaccacgccgccatcccccgggagatccctgggaaggatggagtgtggagggtgctgtggaaggaccgggcccaggacaccagggtgctgcggcagatgaggcggctgctgctggatgatggccccacccaggccgctgaggccggcaccccaggagaggcccccaccccaccagccagcgagacccaggcccaggacagcggggaggtgacaggccaggccggcagcctgctgggcgccgccaggaacccccggcggggcagaagaggaagaagaaacagaacaagaagaaaccggctgacccagaagggcaagaagaggagcagaggaggccggcccagcgccccagcccggtctgaggccgaggacagcagtgatgagagcctgggcatcgtcatcgaggagattgaccagggcgacctgtctggagaggaggaccagagcgccctgtatgccaccctgcaggccgccgcccgggagctggtgcggcagtgggccccctgcaacagcgagggggaggaggatggcccccgggagttcctggccctggtgacagtgacagacaagagcaagaaggaggaggccgagaaggagcctgctggagctgagagcatccggctgaacaccaaggaggacaagaatggagtgcctgacctggtggccctgctggccgtgcgggacaccccagatgaggagcctgtggacagcgacaccagcgagagtgacagccaggagagcggggaccaggagacagaggagctggacaaccctgagtttgtggccatcgtggcctacacagaccccagcgacccctgggcccgggaggagatgctgaagatcgcctctgtgattgagagcctgggctggagcgatgagaaggacaagagggaccccctgcggcaggtgctgtctgtgatgagcaaggacaccaacggcaccagggtgaaggtggaggaggccggccgggaggtggatgctgtggtgctgaggaaggctggagatgatggagacctgcgggagtgcatcagcaccctggcccagcctgacctgcccccccaggccaagaaggccggccggggcctgtttggaggctggagcgagcacagagaagatgagggcggcctgctggagctggtggccctgctggccgcccaggacatggccgaggtgatgaaggaggagaaggaaaatgcctgggagggcggcaagtacaagtaccccaagggcaagctgggggaggtgctggccctgctggccgcccgggagaacatgggcagcaatgaaggcagcgaggaggccagtgatgagcagagcgaggaggagagcgaggacacagagagcgaggccagcgagcctgaggaccgggccagcaggaagccccgggccaagagggccaggacagccccccggggcctgaccccagctggggccccacccacagccagcggggccaggaagacccgggccggcggccggggccggggccggggcgtgaccccagagaagaaggccggcagccggggcagcgcccaggatgatgctgctggcagcaggaagaagaagggcagcgctggagctggggcccacgcccgggccggggaggccaagggccaggcccccaccggcagcaaggccgcccggggcaagaaggcccggcggggccggcggctgccccccaagtgcaggtag

SEQ ID NO: 40588 - DNA, 666 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgcagtgggagtgccccccagagagcctgagctttgaccccctgctgatcaccctggccgagggcctgcgggagaccaagcacccctacacctttgtgtccaaggagggcttccgggagctgctgctggtgaagggggcccctgagaaggccatccccctgctgcccaggctcatccctgtgctgaaggccgccctggtgcacagtgatgatgaggtgtttgagcggggcctgaatgccctggtgcagctgtctgtggtggtgggccccagcctgaatgaccacctgaagcacctgctgaccagcggcagcctgagcatcatcaagagcaagatccccacctactgcagcatctgctgctag

SEQ ID NO: 40589 - DNA, 666 bp, Artificial Sequence; identical to SEQ ID NO: 40588
  Description of Artificial Sequence: Synthetic coding sequence

SEQ ID NO: 40590 - DNA, 747 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgcagtgggagtgccccccagagagcctgagctttgaccccctgctgatcaccctggccgagggcctgcgggagaccaagcacccctacacctttgtgtccaaggagggcttccgggagctgctgctggtgaagggggcccctgagaaggccatccccctgctgcccaggctcatccctgtgctgaaggccgccctggtgcacagtgatgatgaggtgtttgagcggggcctgaatgccctggtgcagctgtctgtggtggtgggccccagcctgaatgaccacctgaagcacctgctgaccagcctgagcaagaggctgatggacaagaagttcaaggagcccatcaccagcgccctgcagaagctggagcagcacggcggcagcggcagcctgagcatcatcaagagcaagatccccacctactgcagcatctgctgctag

SEQ ID NO: 40591 - DNA, 276 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgctag

SEQ ID NO: 40592 - DNA, 258 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagctag

SEQ ID NO: 40593 - DNA, 666 bp, Artificial Sequence; identical to SEQ ID NO: 40588
  Description of Artificial Sequence: Synthetic coding sequence

SEQ ID NO: 40594 - DNA, 411 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgcagtgggagtgccccccagagagcctgagctttgaccccctgctgatcaccctggccgagggcctgcgggagaccaagcacccctacacctttgtgtccaagtag

SEQ ID NO: 40595 - DNA, 612 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgcagtgggagtgccccccagagagcctgagctttgaccccctgctgatcaccctggccgagggcctgcgggagaccaagcacccctacacctttgtgtccaaggagggcttccgggagctgctgctggtgaagggggcccctgagaaggccatccccctgctgcccaggctcatccctgtgctgaaggccgccctggtgcacagtgatgatgaggtgtttgagcggggcctgaatgccctggtgcagctgtctgtggtggtgggccccagcctgaatgaccacctgaagcacctgctgaccagctag

SEQ ID NO: 40596 - DNA, 369 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgcagtgggagtgccccccagagagcctgagctttgaccccctgctgatcaccctggccgagtag

SEQ ID NO: 40597 - DNA, 309 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaacccctttggagagcagagccgggtgcccagcgcctttgctgccatctacagcaagggcggcatcccctgccgcctggtgcacggctctgtgaagcaccggctgtag

SEQ ID NO: 40598 - DNA, 372 bp, Artificial Sequence
  Description of Artificial Sequence: Synthetic coding sequence
atgcagaagtctgagggcagcggcggcacccagctgaagaacagagccactggaaattatgaccagaggaccagcagcagcacccagctgaagcacagaaatgctgtgcagggcagcaagagcagcctgagcaccagcagccctgagagcgccaggaagctgcacccccggcccagcgacaagctgaaccccaagaccatcaaccctgtgcacagtgatgatgaggtgtttgagcggggcctgaatgccctggtgcagctgtctgtggtggtgggccccagcctgaatgaccacctgaagcacctgctgaccagcggcagcctgagcatcatcaagagcaagatccccacctactgcagcatctgctgctag

SEQ ID NO: 40599 - DNA, 372 bp, Artificial Sequence; identical to SEQ ID NO: 40598
  Description of Artificial Sequence: Synthetic coding sequence

SEQ ID NO: 40600 - DNA, 762 bp, Artificial Sequence
  Description of Artificial Sequence: Synthetic coding sequence
atgaagcacatcaacctgagctttgctgcctgtggcttcctgggcatctaccacctgggcgccgccagcgccctgtgccgccacggcaagaagctggtgaaggatgtgaaggcctttgctggggccagcgctggcagcctggtggcctctgtgctgctgacagcccctgagaagattgaggagtgcaaccagttcacctacaagtttgctgaggagatccggcggcagagctttggagctgtgaccccaggctatgacttcatggcccggctgcggagcggcatggagagcatcctgccccccagcgcccacgagctggcccagaaccggctgcacgtgtccatcaccaatgccaagacccgggagaaccacctggtgtccaccttcagcagcagagaagatctcatcaaggtgctgctggccagcagctttgtgcccatctatgccggcctgaagctggtggagtacaagggccagaagtgggtggatggcggcctgaccaatgccctgcccatcctgcctgtgggccgcacagtgaccatcagccccttcagcggccgcctggacatcagcccccaggacaagggccagctggacctgtatgtgaacatcgccaagcaggacatcatgctgagcctggccaacctggtgcggctgaaccaggccctcttcccccccagcaagaggaagatggagagcctgtaccagtgtggctttgatgacacagtgaagttcctgctgaaggagaactggtttgaatag

SEQ ID NO: 40601 - DNA, 573 bp, Artificial Sequence
  Description of Artificial Sequence: Synthetic coding sequence
atgaagcacatcaacctgagctttgctgcctgtggcttcctgggcatctaccacctgggcgccgccagcgccctgtgccgccacggcaagaagctggtgaaggatgtgaaggcctttgctggggccagcgctggcagcctggtggcctctgtgctgctgacagcccctgagaagattgaggagtgcaaccagttcacctacaagtttgctgaggagatccggcggcagagctttggagctgtgaccccaggctatgacttcatggcccggctgcggagcggcatggagagcatcctgccccccagcgcccacgagctggcccagaaccggctgcacgtgtccatcaccaatgccaagacccgggagaaccacctggtgtccaccttcagcagcagagaagatctcatcaaggtgctgctggccagcagctttgtgcccatctatgccggcctgaagctggtggagtacaagggccagaagtgggtggatggcggcctgaccaatgccctgcccatcctgcctgtgggccgcacagtgaccatcagccccttcagcggccgcctggacatctag

SEQ ID NO: 40602 - DNA, 762 bp, Artificial Sequence; identical to SEQ ID NO: 40600
  Description of Artificial Sequence: Synthetic coding sequence

SEQ ID NO: 40603 - DNA, 501 bp, Artificial Sequence
  Description of Artificial Sequence: Synthetic coding sequence
atggcccggctgcggagcggcatggagagcatcctgcccccatctgcccacgagctggcccagaaccggctgcacgtgtccatcaccaatgccaagacccgggagaaccacctggtgtccaccttcagcagccgggaggacctgatcaaggtgctgctggccagcagctttgtgcccatctatgccggcctgaagctggtggagtacaagggccagaagtgggtggatggcggcctgaccaatgccctgcccatcctgcctgtgggccgcacagtgaccatcagccccttcagcggccgcctggacatcagcccccaggacaagggccagctggacctgtatgtgaacatcgccaagcaggacatcatgctgagcctggccaacctggtgcggctgaaccaggccctcttcccccccagcaagaggaagatggagagcctgtaccagtgtggctttgatgacacagtgaagttcctgctgaaggagaactggtttgaatag

SEQ ID NO: 40604 - DNA, 969 bp, Artificial Sequence
  Description of Artificial Sequence: Synthetic coding sequence
atggagggcatcagcaacttcaagacccccagcaagctgtctgagaagaagaagtctgtgctgtgcagcacccccaccatcaacatcccagccagccccttcatgcagaagctgggcttcggcaccggggtgaatgtgtacctgatgaagaggagcccccggggcctgagccacagcccctgggccgtgaagaagatcaaccccatctgcaatgaccactacagatctgtgtaccagaagaggctgatggatgaggccaagatcctgaagagcctgcaccaccccaacatcgtgggctaccgggccttcacagaggccaatgatggcagcctgtgcctggccatggagtatggaggagagaagagcctgaatgacctgattgaggagcgctacaaggccagccaggaccccttccctgctgccatcatcctgaaggtggccctgaacatggcccggggcctgaagtacctgcaccaggagaagaagctgctgcatggagacatcaagagcagcaatgtggtgatcaagggggactttgagaccatcaagatctgtgatgtgggcgtgtccctgcccctggatgagaacatgacagtgacagatcctgaggcctgctacatcggcacagagccctggaagcccaaggaggccgtggaggagaatggagtcatcacagacaaggctgacatctttgccttcggcctgaccctgtgggagatgatgaccctgagcatcccccacatcaacctgagcaatgatgatgatgatgaggacaagacctttgatgaaagtgactttgatgatgaggcctactatgctgccctgggcaccaggcctcccatcaacatggaggagctggatgagagctaccagaaggtgattgagctgttctctgtgtgcaccaatgaagaccccaaggaccggcccagcgctgcccacatcgtggaggccctggagacagatgtgtag

SEQ ID NO: 40605 - DNA, 1560 bp, Artificial Sequence
  Description of Artificial Sequence: Synthetic coding sequence
atgaccagcaccttcaacccccgggagtgcaagctgagcaagcaggagggccagaactacggcttcttcctgcgcatcgagaaggacacagagggccacctggtgcgggtggtggagaagtgcagccctgctgagaaggccggcctgcaggatggagacagagtgctgcgcatcaatggagtgtttgtggacaaggaggagcacatgcaggtggtggacctggtgaggaagagcggcaacagcgtgaccctgctggtgctggatggagacagctatgagaaggctgtgaagaccagggtggacctgaaggagctgggccagagccagaaggagcagggcctgagtgacaacatcctgagccctgtgatgaatggaggagtgcagacctggacccagccccggctgtgctacctggtgaaggagggcggcagctatggcttcagcctgaagacagtgcagggcaagaagggcgtgtacatgacagacatcaccccccagggcgtggccatgagagctggggtgctggctgatgaccacctgattgaggtgaatggagaaaatgtggaggatgccagccatgaggaggtggtggagaaggtgaagaagagcggcagccgggtgatgttcctgctggtggacaaggagacagacaagagacatgtggagcagaagatccagttcaagcgggagacagccagcctgaagctgctgccccaccagcccagaattgtggagatgaagaagggcagcaatggctacggcttctacctgcgggccggcagcgagcagaagggccagatcatcaaggacattgattctggcagccctgctgaggaggccggcctgaagaacaatgacctggtggtggccgtgaatggagagagcgtggagaccctggaccatgattctgtggtggagatgatcaggaagggcggggaccagaccagcctgctggtggtggacaaggagacagacaacatgtaccgcctggcccacttcagccccttcctgtactaccagagccaggagctgcccaacggctctgtgaaggaggccccagcccccacccccaccagcctggaggtgagcagccccccagacaccacagaggaggtggaccacaagcccaagctgtgccgcctggccaagggagaaaatggctacggcttccacctgaatgccatccggggcctgcccggcagcttcatcaaggaggtgcagaagggcggccctgctgacctggccggcctggaggatgaagatgtgatcatcgaggtgaatggagtgaatgtgctggatgagccctatgagaaggtggtggaccgcatccagagcagcggcaagaatgtgaccctgctggtgtgtgggaagaaggcctatgactacttccaggccaagaagatccccatcgtgagcagcctggccgaccccctggacaccccaccagacagcaaggagggcatcgtggtggagagcaaccacgacagccacatggccaaggagcgggcccacagcacagccagccacagcagcagcaacagcgaggacacagagatgtag

SEQ ID NO: 40606 - DNA, 1560 bp, Artificial Sequence; identical to SEQ ID NO: 40605
  Description of Artificial Sequence: Synthetic coding sequence

SEQ ID NO: 40607 - DNA, 609 bp, Artificial Sequence
  Description of Artificial Sequence: Synthetic coding sequence
atggccgagggggaggaggagggcggagatgtgctgatctctgtgggccacgccaacgtgctgggctacaccctgcgggagttcctgcagctgctgcagcacatcaccatcggcaccgtgctgcagatcaaggtgtacagagacttcatcaacatccctgaggagtggcaggagatctatgacctgatccctgaggccaagtttcctgtgaccagcacccccaagaagattgagctggccaaggatgagagcttcaccagcagtgatgacaatgaaaatgtggacctggacaagaggctgcagtactaccgctacccctggagcacagtgcaccacccagcccggcggcccatcagcatcagccgggactggcacggctacaagaagaagaaccacaccatctctgtgggcaaggacatcaactgtgatgtgatgatccacagagatgacaagaaggaggtgcgggcccccagcccctactggatcatggtgaagcaggacaatgaaagcagcagcagcagcaccagcagcaccagtgatgccttctggctggaggactgtgcccaggtggaggagggcaaggcccagctggtgtccaaggtgggctag

SEQ ID NO: 40608 - DNA, 795 bp, Artificial Sequence
  Description of Artificial Sequence: Synthetic coding sequence
atgcagaaggccagccacaagaacaagaaggagcggggcgtgagcaacaaggtgaagacctctgtgcacaacctgagcaagacccagcagaccaagctgactgtgggcagcctgggcctgggcctcatcatcatccagcacggcccctacctgcagatcacccacctgatcagaaaaggagctgctgccaatgatggcaagctgcagcctggagatgtgctgatctctgtgggccacgccaacgtgctgggctacaccctgcgggagttcctgcagctgctgcagcacatcaccatcggcaccgtgctgcagatcaaggtgtacagagacttcatcaacatccctgaggagtggcaggagatctatgacctgatccctgaggccaagtttcctgtgaccagcacccccaagaagattgagctggccaaggatgagagcttcaccagcagtgatgacaatgaaaatgtggacctggacaagaggctgcagtactaccgctacccctggagcacagtgcaccacccagcccggcggcccatcagcatcagccgggactggcacggctacaagaagaagaaccacaccatctctgtgggcaaggacatcaactgtgatgtgatgatccacagagatgacaagaaggaggtgcgggcccccagcccctactggatcatggtgaagcaggacaatgaaagcagcagcagcagcaccagcagcaccagtgatgccttctggctggaggactgtgcccaggtggaggagggcaaggcccagctggtgtccaaggtgggctag

SEQ ID NO: 40609 - DNA, 615 bp, Artificial Sequence
  Description of Artificial Sequence: Synthetic coding sequence
atgcagaaggccagccacaagaacaagaagggagatgtgctgatctctgtgggccacgccaacgtgctgggctacaccctgcgggagttcctgcagctgctgcagcacatcaccatcggcaccgtgctgcagatcaaggtgtacagagacttcatcaacatccctgaggagtggcaggagatctatgacctgatccctgaggccaagtttcctgtgaccagcacccccaagaagattgagctggccaaggatgagagcttcaccagcagtgatgacaatgaaaatgtggacctggacaagaggctgcagtactaccgctacccctggagcacagtgcaccacccagcccggcggcccatcagcatcagccgggactggcacggctacaagaagaagaaccacaccatctctgtgggcaaggacatcaactgtgatgtgatgatccacagagatgacaagaaggaggtgcgggcccccagcccctactggatcatggtgaagcaggacaatgaaagcagcagcagcagcaccagcagcaccagtgatgccttctggctggaggactgtgcccaggtggaggagggcaaggcccagctggtgtccaaggtgggctag

SEQ ID NO: 40610 - DNA, 2103 bp, Artificial Sequence
  Description of Artificial Sequence: Synthetic coding sequence
atggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgaccccagccacagcaacagcacagccacccaggaggaggatgaggaggaggaggagagctttggcaccctgagtgacaagtacagcagcagaagactcttcaggaagtctgctgcccagttccacaacctgcgctttggagagaggagagatgagcagatggagcctgagcccaagctgtggagaggaagaagaaacaccccctactggtacttcctgcagtgcaagcacctgatcaaggagggcaagctggtggaggccctggacctgtttgagcggcagatgctgaaggaggagcggctgcagcccatggagagcaactacacagtgctgattggaggctgcggccgggtgggctacctgaagaaggccttcaacctgtacaaccagatgaagaagagggacctggagcccagtgatgccacctacacagccctcttcaacgtgtgtgccgagagcccctggaaggacagcgccctgcagagcgccctgaagctgcggcagcagctgcaggccaagaactttgagctgaacctgaagacctaccacgccctgctgaagatggccgccaagtgtgccgacctgaggatgtgcctggatgtgttcaaggagatcatccacaagggccacgtggtgacagaggagaccttctccttcctgctgatgggctgcatccaggacaagaagacaggcttccgctatgccctgcaggtgtggaggctgatgctgagcctgggcctgcagcccagccgggacagctacaacctgctgctggtggccgcccgggactgtggcctgggggacccccaggtggccagcgagctgctgctgaagccccgggaggaggccaccgtgctgcagccccctgtgtcccggcagaggcccaggagaacagcccaggccaaggccggcaacctgatgtctgccatgctgcacgtggaggccctggagcggcagctgttcctggagcccagccaggccctgggccccccagagcccccagaggcccgggtgcctgggaaggcccagcctgaggtggacaccaaggccgagcccagccacacagctgccctgacagctgtggccctgaagcccccacctgtggagctggaggtgaacctgctgaccccaggagctgtgcccccaacagtggtgtcctttggaacagtgaccaccccagctgaccggctggccctgattggaggcctggagggcttcctgagcaagatggccgagcaccggcagcagcctgacatccgcaccctgaccctgctggccgaggtggtggagagcggcagccctgctgagagcctgctgctggccctgctggatgagcaccaggtggaggccgacctgaccttcttcaacaccctggtgaggaagaagagcaagctgggggacctggagggcgccaaggccctgctgcctgtgctggccaagaggggcctggtgcccaacctgcagaccttctgcaacctggccatcggctgccaccggcccaaggatggcctgcagctgctgacagacatgaagaagagccaggtgacccccaacacccacatctacagcgccctgatcaatgctgccatcaggaagctgaactacacctacctgatcagcatcctgaaggacatgaagcagaacagagtgcctgtgaatgaggtggtgatccggcagctggagtttgctgcccagtacccacccacctttgaccgctaccagggcaagaacacctacctggagaagattgatggcttccgggcctactacaagcagtggctgactgtgatgcctgctgaggagaccccccacccctggcagaagttccgcaccaagccccagggcgaccaggacaccgggaaggaggctgatgatggctgtgccctgggcggccgctag

SEQ ID NO: 40611 - DNA, 321 bp, Artificial Sequence
  Description of Artificial Sequence: Synthetic coding sequence
atggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgaccccagccacagcaacagcacagccacccaggaggaggatgaggaggaggaggagagctttggcaccctgagtgacaagtacagcagcagaagactcttcaggaagagcgcctag

SEQ ID NO: 40612 - DNA, 435 bp, Artificial Sequence
  Description of Artificial Sequence: Synthetic coding sequence
atggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgaccccagccacagcaacagcacagccacccaggaggaggatgaggaggaggaggagagctttggcaccctgagtgacaagtacagcagcagaagactcttcaggaagtctgctgcccagttccacaacctgcgctttggagagaggagagatgagcagatggagcctgagcccaagctgtggagaggaagaagaaacaccccctactggtacttcctgcagtgcaagtag

SEQ ID NO: 40613 - DNA, 495 bp, Artificial Sequence
  Description of Artificial Sequence: Synthetic coding sequence
atggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgaccccagccacagcaacagcacagccacccaggaggaggatgaggaggaggaggagagctttggcaccctgagtgacaagtacagcagcagaagactcttcaggaagtctgctgcccagttccacaacctgcgctttggagagaggagagatgagcagatggagcctgagcccaagctgtggagaggaagaagaaacaccccctactggtacttcctgcagtgcaagcacctgatcaaggagggcaagctggtggaggccctggacctgtttgagcggcagatgctgtag

SEQ ID NO: 40614 - DNA, 213 bp, Artificial Sequence
  Description of Artificial Sequence: Synthetic coding sequence
atggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgacccctag

SEQ ID NO: 40615 - DNA, 1449 bp, Artificial Sequence
  Description of Artificial Sequence: Synthetic coding sequence
aggaagaggctggtgcggcggggggacagagctggcctgcctgtgggcgtgcaccagctgcaggccaagaactttgagctgaacctgaagacctaccacgccctgctgaagatggccgccaagtgtgccgacctgaggatgtgcctggatgtgttcaaggagatcatccacaagggccacgtggtgacagaggagaccttctccttcctgctgatgggctgcatccaggacaagaagacaggcttccgctatgccctgcaggtgtggaggctgatgctgagcctgggcctgcagcccagccgggacagctacaacctgctgctggtggccgcccgggactgtggcctgggggacccccaggtggccagcgagctgctgctgaagccccgggaggaggccaccgtgctgcagccccctgtgtcccggcagaggcccaggagaacagcccaggccaaggccggcaacctgatgtctgccatgctgcacgtggaggccctggagcggcagctgttcctggagcccagccaggccctgggccccccagagcccccagaggcccgggtgcctgggaaggcccagcctgaggtggacaccaaggccgagcccagccacacagctgccctgacagctgtggccctgaagcccccacctgtggagctggaggtgaacctgctgaccccaggagctgtgcccccaacagtggtgtcctttggaacagtgaccaccccagctgaccggctggccctgattggaggcctggagggcttcctgagcaagatggccgagcaccggcagcagcctgacatccgcaccctgaccctgctggccgaggtggtggagagcggcagccctgctgagagcctgctgctggccctgctggatgagcaccaggtggaggccgacctgaccttcttcaacaccctggtgaggaagaagagcaagctgggggacctggagggcgccaaggccctgctgcctgtgctggccaagaggggcctggtgcccaacctgcagaccttctgcaacctggccatcggctgccaccggcccaaggatggcctgcagctgctgacagacatgaagaagagccaggtgacccccaacacccacatctacagcgccctgatcaatgctgccatcaggaagctgaactacacctacctgatcagcatcctgaaggacatgaagcagaacagagtgcctgtgaatgaggtggtgatccggcagctggagtttgctgcccagtacccacccacctttgaccgctaccagggcaagaacacctacctggagaagattgatggcttccgggcctactacaagcagtggctgactgtgatgcctgctgaggagaccccccacccctggcagaagttccgcaccaagccccagggcgaccaggacaccgggaaggaggctgatgatggctgtgccctgggcggccgctag

SEQ ID NO: 40616 - DNA, 2250 bp, Artificial Sequence
  Description of Artificial Sequence: Synthetic coding sequence
atggcctctgtggtgcctgtgaaggacaagaagctgctggaggtgaagctgggggagctgcccagctggatcctgatgagggacttcagccccagcggcatctttggagccttccagaggggccctgggggcaccgggaagccagagatggactttgtgcggctggcccggctgtttgcccgggcccggcccatgggcctcttcatcctgcagcacctggacccctgccgggcccgctgggccggcggccgggagggcctgatgaggcccatgtgggcccccttcagcagcagcagcagccagctgcccctgggccaggagcggcaggagaacacaggcagcctgggcagtgaccccagccacagcaacagcacagccacccaggaggaggatgaggaggaggaggagagctttggcaccctgagtgacaagtacagcagccggcggctcttcaggaagtctgctgcccagttccacaacctgcgctttggagagaggagagatgagcagatggagcctgagcccaagctgtggagaggaagaagaaacaccccctactggtacttcctgcagtgcaagcacctgatcaaggagggcaagctggtggaggccctggacctgtttgagcggcagatgctgaaggaggagcggctgcagcccatggagagcaactacacagtgctgattggaggctgcggccgggtgggctacctgaagaaggccttcaacctgtacaaccagatgaagaagagggacctggagcccagtgatgccacctacacagccctcttcaacgtgtgtgccgagagcccctggaaggacagcgccctgcagagcgccctgaagctgcggcagcagctgcaggccaagaactttgagctgaacctgaagacctaccacgccctgctgaagatggccgccaagtgtgccgacctgaggatgtgcctggatgtgttcaaggagatcatccacaagggccacgtggtgacagaggagaccttctccttcctgctgatgggctgcatccaggacaagaagacaggcttccgctatgccctgcaggtgtggaggctgatgctgagcctgggcctgcagcccagccgggacagctacaacctgctgctggtggccgcccgggactgtggcctgggggacccccaggtggccagcgagctgctgctgaagccccgggaggaggccaccgtgctgcagccccctgtgtcccggcagaggcccaggagaacagcccaggccaaggccggcaacctgatgtctgccatgctgcacgtggaggccctggagcggcagctgttcctggagcccagccaggccctgggccccccagagcccccagaggcccgggtgcctgggaaggcccagcctgaggtggacaccaaggccgagcccagccacacagctgccctgacagctgtggccctgaagcccccacctgtggagctggaggtgaacctgctgaccccaggagctgtgccccccaccgtggtgtcctttggcaccgtgaccaccccagctgaccggctggccctgattggaggcctggagggcttcctgagcaagatggccgagcaccggcagcagcctgacatccgcaccctgaccctgctggccgaggtggtggagagcggcagccctgctgagagcctgctgctggccctgctggatgagcaccaggtggaggccgacctgaccttcttcaacaccctggtgaggaagaagagcaagctgggggacctggagggcgccaaggccctgctgcctgtgctggccaagaggggcctggtgcccaacctgcagaccttctgcaacctggccatcggctgccaccggcccaaggatggcctgcagctgctgacagacatgaagaagagccaggtgacccccaacacccacatctacagcgccctgatcaatgctgccatcaggaagctgaactacacctacctgatcagcatcctgaaggacatgaagcagaacagagtgcctgtgaatgaggtggtgatccggcagctggagtttgctgcccagtacccacccacctttgaccgctaccagggcaagaacacctacctggagaagattgatggcttccgggcctactacaagcagtggctgactgtgatgcctgctgaggagaccccccacccctggcagaagttccgcaccaagccccagggcgaccaggacaccgggaaggaggctgatgatggctgtgccctgggcggccgctag

SEQ ID NO: 40617 - DNA, 1311 bp, Artificial Sequence
  Description of Artificial Sequence: Synthetic coding sequence
atgaggcctggaggagagaggcctgtggagggcggggcctgcaatggccgctctgagctggagctgctgaagctgcggtctgcagaatgtattgatgaggccgctgagcggctgggcgccctgagccgggccatctggagccagcctgagctggcctatgaggagcaccacgcccaccgggtgctgacccacttctttgagcgggagcccccagctgcctcctgggccgtgcagccccactaccagctgcccacagccttccgggcagagtgggagcccccagaggcccgggcccccagcgccaccccccggcccctgcacctgggcttcctgtgtgaatatgatgccctgcccggcatcggccacgcctgtggccacaacctgattgctgaggtgggcgctgctgctgccctgggcgtgcggggggccctggagggcctgccccggcccccacctcctgtgaaggtggtggtgctgggcaccccagcagaagaagatggcggcggcaagattgacctgattgaggccggggccttcaccaacctggatgtggtgttcatggcccaccccagccaggagaatgctgcctacctgcctgacatggccgagcatgatgtgacagtgaagtactacggcaaggccagccacagcgccagctacccctgggagggcctgaatgccctggatgctgctgtgctggcctacaacaacctgtctgtgttccggcagcagatgaagcccacctggagggtgcacggcatcatcaagaatggaggagtgaagcccaacatcatccccagctacagcgagctgatctactacttccgggcccccagcatgaaggagctgcaggtgctgaccaagaaggccgaggactgcttccgggctgctgccctggccagcggctgcaccgtggagatcaagggcggggcccatgactactacaacgtgctgcccaacaagagcctgtggaaggcctacatggagaatggaaggaagctgggcatcgagttcatcagcgaggacaccatgctgaatggccccagcggcagcacagactttggaaatgtgtcctttgtggtgcccggcatccacccctacttccacatcggcagcaatgccctgaaccacacagagcagtacacagaggccgccggcagccaggaggcccagttctacaccctgaggacagccaaggccctggccatgacagccctggatgtgatcttcaagccagagctgctggagggcatccgggaggacttcaagctgaagctgcaggaggagcagtttgtgaatgctgtggagtag

SEQ ID NO: 40618 - DNA, 840 bp, Artificial Sequence
  Description of Artificial Sequence: Synthetic coding sequence
atggcccggccccagccctgtggcccccctcatgcccgctgtggcagccccagcctgcctgagcggcccctgcaggtgaaggtggtgggcctcttcagctgccccaacttccagatcgccaagtctgctgctgaggagctgaagaatgagacctgggagtacagcagcagcgtcatcagctttgtgaatggccagttcctgggagatgccctggacctgcagaagtgggcccacgaggtgtgggacatcgtggacatcaagcccagcgccctgtatgatgccctgacagaggacttcagcgccaagttcctgcgggacaccaagcatgactttgtgttcctggacatctgcatcgacagcagccccatcggccgcctcatctttgagctgtactgtgatgtgtgccccaagacctgcaagaacttccaggtgctgtgcaccgggaaggccggcttcagccagaggggcatccggctgcactacaagaacagcatcttccacagaattgtgcagaatggctggatccagggcggggacatcgtgtatggcaagggggacaatggagagagcatctacggccccacctttgaagatgagaacttctctgtgccccacaacaagaggggcgtgctgggcatggccaacaagggccgccacagcaatggcagccagttctacatcaccctgcaggccaccccctacctggacaggaagtttgtggccttcggccagctgattgagggcacagaggtgctgaagcagctggagctggtgcccacccagaatgaaagacccatccacatgtgccgcatcacagacagcggggacccctatgcctag

SEQ ID NO: 40619 - DNA, 936 bp, Artificial Sequence
  Description of Artificial Sequence: Synthetic coding sequence
atggcccggccccagccctgtggcccccctcatgcccgctgtggcagccccagcctgcctgagcggcccctgcaggtgaaggtggtgggcctcttcagctgccccaacttccagatcgccaagtctgctgctgagaacctgaagaacaaccaccccagcaagtttgaggaccccatcctggtgcccctgcaggagtttgcctggcaccagtacctgcaggagaagaagcgggagctgaagaatgagacctgggagtacagcagcagcgtcatcagctttgtgaatggccagttcctgggagatgccctggacctgcagaagtgggcccacgaggtgtgggacatcgtggacatcaagcccagcgccctgtatgatgccctgacagaggacttcagcgccaagttcctgcgggacaccaagcatgactttgtgttcctggacatctgcatcgacagcagccccatcggccgcctcatctttgagctgtactgtgatgtgtgccccaagacctgcaagaacttccaggtgctgtgcaccgggaaggccggcttcagccagaggggcatccggctgcactacaagaacagcatcttccacagaattgtgcagaatggctggatccagggcggggacatcgtgtatggcaagggggacaatggagagagcatctacggccccacctttgaagatgagaacttctctgtgccccacaacaagaggggcgtgctgggcatggccaacaagggccgccacagcaatggcagccagttctacatcaccctgcaggccaccccctacctggacaggaagtttgtggccttcggccagctgattgagggcacagaggtgctgaagcagctggagctggtgcccacccagaatgaaagacccatccacatgtgccgcatcacagacagcggggacccctatgcctag

SEQ ID NO: 40620 - DNA, 1014 bp, Artificial Sequence
  Description of Artificial Sequence: Synthetic coding sequence
atggcccggccccagccctgtggcccccctcatgcccgctgtggcagccccagcctgcctgagcggcccctgcaggtgaaggtggtgggcctcttcagctgccccaacttccagatcgccaagtctgctgctgagaacctgaagaacaaccaccccagcaagtttgaggaccccatcctggtgcccctgcaggagtttgcctggcaccagtacctgcaggagaagaagcgggagctgaagaatgagacctgggagtacagcagcagcgtcatcagctttgtgaatggccagttcctgggagatgccctggacctgcagaagtgggcccacgaggtgtgggacatcgtggacatcaagcccagcgccctgtatgatgccctgacagaggacttcagcgccaagttcctgcgggacaccaagcatgactttgtgttcctggacatctgcatcgacagcagccccatcggccgcctcatctttgagctgtactgtgatgtgtgccccaagacctgcaagaacttccaggtgctgtgcaccgggaaggccggcttcagccagaggggcatccggctgcactacaagaacagcatcttccacagaattgtgcagaatggctggatccagggcggggacatcgtgtatggcaagggggacaatggagagagcatctacggccccacctttgaggagctgtatggcagcctgaagaggtctgtgaagaggcagaaggagagcagaggagtgggcaagattgagaagtacagagatgagaacttctctgtgccccacaacaagaggggcgtgctgggcatggccaacaagggccgccacagcaatggcagccagttctacatcaccctgcaggccaccccctacctggacaggaagtttgtggccttcggccagctgattgagggcacagaggtgctgaagcagctggagctggtgcccacccagaatgaaagacccatccacatgtgccgcatcacagacagcggggacccctatgcctag

SEQ ID NO: 40621 - DNA, 495 bp, Artificial Sequence
  Description of Artificial Sequence: Synthetic coding sequence
atggtgaacagcgtggtgttctttgagatcaccagagatggcaagcccctgggccgcatcagcatcaagctgtttgctgacaagatccccaagacagctgagaacttccgggccctgagcactggagagaagggcttccgctacaagggcagctgcttccaccgcatcatccctggcttcatgtgccagggcggggacttcacccggcccaatggaactggagacaagagcatctatggagagaagtttgatgatgagaacctgatcaggaagcacactggaagtggcatcctgtccatggccaatgccggccccaacaccaacggcagccagttcttcatctgtgccgccaagacagagtggctggatggcaagcacgtggccttcggcaaggtgaaggagcgggtgaacatcgtggaggccacagagcacttcggctacagaaacagcaagaccagcaagaagatcaccatcgctgactgtggccagttctag

SEQ ID NO: 40622 - DNA, 495 bp, Artificial Sequence; identical to SEQ ID NO: 40621
  Description of Artificial Sequence: Synthetic coding sequence

SEQ ID NO: 40623 - DNA, 423 bp, Artificial Sequence
  Description of Artificial Sequence: Synthetic coding sequence
atgcaccggggcgtgggccctgccttccgggtggtgaggaagatggccgccagcggggctgagccccaggtgctggtgcagtacctggtgctgaggaaggacctgagccaggcccccttctcctggccagctggggccctggtggcccaggcctgccacgccgccacagctgccctgcacacccaccgggaccacccccacacagctgcctacctgcaggagctgggccgcatgaggaaggtggtgctggaggccccagatgagaccaccctgaaggagctggccgagaccctgcagcagaagaacatcgaccacatgctgtggctggagcagccagaaaatattgccacctgcatcgccctgcggccctaccccaaggaggaggtgggccagtacctgaagaagttccgcctcttcaagtag

SEQ ID NO: 40624 - DNA, 393 bp, Artificial Sequence
  Description of Artificial Sequence: Synthetic coding sequence
atggctgatggcaaggctggagatgagaagccagagaagagccagagagctggagctgctgggggccctgaggaggaggccgagaagcctgtgaagaccaagacagtgagcagcagcaatggaggagagagcagcagccgctctgctgagaagaggtctgctgaggaggaggccgctgacctgcccaccaagcccaccaagatcagcaagtttggatttgccatcggcagccagaccaccaagaaggccagcgccatcagcatcaagctgggcagcagcaagcccaaggagaccgtgcccaccctggcccccaagaccctgtctgtggccgccgccttcaatgaagatgaagatggctacaccaacatctcctggaccaagctgctgcagtag

SEQ ID NO: 40625 - DNA, 222 bp, Artificial Sequence; identical to SEQ ID NO: 36594
  Description of Artificial Sequence: Synthetic coding sequence

SEQ ID NO: 40626 - DNA, 2667 bp, Artificial Sequence
  Description of Artificial Sequence: Synthetic coding sequence
atggacaggagcagcaagaggcggcaggtgaagcccctggccgccagcctgctggaggccctggactatgacagcagtgatgacagcgacttcaaggtgggagatgccagtgacagcgagggcagcggaaatggaagtgaagatgccagcaaggacagcggggagggcagctgcagcgacagcgaggagaacatcctggaggaggagctgaatgaagacatcaaggtgaaggaggagcagctgaagaacagcgctgaggaggaggtgctgagcagcgagaagcagctgatcaagatggagaagaaggaggaggaggagaatggagagcggcccaggaagaagaaggagaaggagaaggagaaggagaaggagaaggagaaggagaaggagcgggagaaggagaaggagaaggccaccgtgtctgaaaatgtggccgccagcgctgctgccaccaccccagccaccagccccccagctgtgaacaccagccccagcgtgcccaccaccaccacagccacagaggagcaggtgtctgagcccaagaagtggaacctgcggaggaaccggcccctgctggactttgtgtccatggaggagctgaatgacatggatgattatgacagtgaagatgacaatgactggaggcccaccgtggtgaagaggaagggccgcagcgccagccagaaggagggcagtgatggagacaatgaagatgatgaagatgagggcagcggcagtgatgaagatgaaaatgatgagggcaatgatgaggaccacagcagccctgccagcgagggcggctgcaagaagaagaagagcaaggtgctgagcaggaacagcgcagatgatgaggagctgaccaatgacagcctgaccctgagccagagcaagagcaatgaagacagcctcatcctggagaagagccagaactggagcagccagaagatggaccacatcctgatctgctgcgtgtgcctgggggacaacagtgaagatgctgatgagatcatccagtgtgacaactgtggcatcaccgtgcatgagggctgctatggagtggatggagagagtgacagcatcatgagcagcgccagcgagaacagcacagagccctggttctgtgatgcctgcaagtgtggggtgagccccagctgtgagctgtgccccaaccaggacggcatcttcaaggagacagatgctggccgctgggtgcacatcgtgtgtgccctgtatgtgcctggggtggcctttggagacatcgacaagctgcggcctgtgaccctgacagagatgaactacagcaagtacggggccaaggagtgcagcttctgtgaggaccccaggtttgccaggactggagtgtgcatcagctgtgatgctggcatgtgccgggcctacttccacgtgacctgtgcccagaaggagggcctgctgtctgaggccgctgctgaagaagatattgctgaccccttctttgcctactgcaagcagcacgccgaccggctggacaggaagtggaagaggaagaactacctggccctgcagagctactgcaagatgagcctgcaggagcgggagaagcagctgagccctgaggcccaggcccgcatcaatgcccggctgcagcagtaccgggccaaggccgagctggcccggagcacccggccccaggcctgggtgccccgggagaagctgccccggcccctgaccagcagcgccagcgccatcaggaagctgatgaggaaggccgagctgatgggcatcagcacagacatcttccctgtggacaacagcgacaccagcagctctgtggatggaagaaggaagcacaagcagcctgccctgacagctgactttgtgaactactactttgagaggaacatgaggatgatccagatccaggagaacatggccgagcagaagaacatcaaggacaagctggagaatgagcaggagaagctgcacgtggagtacaacaagctgtgtgagagcctggaggagctgcagaacctgaatggcaagctgcggtctgagggccagggcatctgggccctgctgggccgcatcaccggccagaagctgaacatcccagccatcctgcgggcccccaaggagaggaagcccagcaagaaggagggcggcacccagaagaccagcaccctgcctgctgtgctgtacagctgtggcatctgcaagaagaaccacgaccagcacctgctgctgctgtgtgacacctgcaagctgcactaccacctgggctgcctggacccccccctgaccaggatgcccaggaagaccaagaacagctactggcagtgcagtgaatgtgaccaggccggcagcagtgacatggaggccgacatggccatggagaccctgcctgatggcaccaagaggagccggcggcagatcaaggagcctgtgaagtttgtgccccaggatgtgcccccagagcccaagaagatccccatccggaacaccaggacccggggcaggaagaggagctttgtgcctgaggaggagaagcatgaggagcgggtgccccgggagcggcggcagaggcagagcgtgctgcagaagaagcccaaggccgaggacctgaggacagaatgtgccacctgcaagggcactggagacaatgaaaacctggtgcgctaccccagctag

SEQ ID NO: 40627 - DNA, 1992 bp, Artificial Sequence
  Description of Artificial Sequence: Synthetic coding sequence
atgattgtgcagatgaccgtcatcctgaagctggagatgccccaggacagcctcatcctggagaagagccagaactggagcagccagaagatggaccacatcctgatctgctgcgtgtgcctgggggacaacagtgaagatgctgatgagatcatccagtgtgacaactgtggcatcaccgtgcatgagggctgctacggcgtggatggagagagtgacagcatcatgagcagcgccagcgagaacagcacagagccctggttctgtgatgcctgcaagtgtggggtgagccccagctgtgagctgtgccccaaccaggacggcatcttcaaggagacagatgctggccgctgggtgcacatcgtgtgtgccctgtatgtgcctggggtggccttcggggacatcgacaagctgcggcctgtgaccctgacagagatgaactacagcaaatatggagccaaggaatgttccttctgtgaggaccccaggtttgccaggactggagtgtgcatcagctgtgatgctggcatgtgccgggcctacttccacgtgacctgtgcccagaaggagggcctgctgtctgaggccgctgctgaggaggacattgctgaccccttctttgcctactgcaagcagcacgccgaccggctggacaggaagtggaagaggaagaactacctggccctgcagagctactgcaagatgagcctgcaggagcgggagaagcagctgagccctgaggcccaggcccgcatcaatgcccggctgcagcagtaccgggccaaggccgagctggcccggagcacccggccccaggcctgggtgccccgggagaagctgccccggcccctgaccagcagcgccagcgccatcaggaagctgatgaggaaggccgagctgatgggcatcagcacagacatcttccctgtggacaacagcgacaccagcagctctgtggatggccgcaggaagcacaagcagcctgccctgacagctgactttgtgaactactactttgaaagaaacatgaggatgatccagatccaggagaacatggccgagcagaagaacatcaaggacaagctggagaatgagcaggagaagctgcacgtggagtacaacaagctgtgtgagagcctggaggagctgcagaacctgaatggcaagctgcggtctgagggccagggcatctgggccctgctgggccgcatcaccggccagaagctgaacatcccagccatcctgcgggcccccaaggagaggaagcccagcaagaaggagggcggcacccagaagaccagcaccctgcctgctgtgctgtacagctgtggcatctgcaagaagaaccacgaccagcacctgctgctgctgtgtgacacctgcaagctgcactaccacctgggctgcctggacccccccctgaccaggatgcccaggaagaccaagaacagctactggcagtgcagtgaatgtgaccaggccggcagcagtgacatggaggccgacatggccatggagaccctgcctgatggcaccaagaggagccggcggcagatcaaggagcctgtgaagtttgtgccccaggatgtgcccccagagcccaagaagatccccatccggaacaccaggacccggggcaggaagaggagctttgtgcctgaggaggagaagcatgaggagcgggtgccccgggagcggcggcagaggcagagcgtgctgcagaagaagcccaaggccgaggacctgaggacagaatgtgccacctgcaagggcaccggggacaatgaaaacctggtgcgctgtgatgaatgtcggctgtgctaccacttcggctgcctggacccccccctgaagaagagccccaagcagacaggctacggctggatctgccaggagtgtgacagcagcagcagcaaggaggatgaaaatgaagctgagaggaagaacatcagccaggagctgaacatggagcagaagaaccccaagaagtag

SEQ ID NO: 40628 - DNA, 1077 bp, Artificial Sequence
  Description of Artificial Sequence: Synthetic coding sequence
atggccgagcggcaggaggagcagaggggcagcccccccctgcgggcagagggcaaggcagatgctgaggtgaagctgatcctgtaccactggacccacagcttcagcagccagaaggtgcggctggtgattgctgagaaggccctgaagtgtgaggagcatgatgtgtccctgcccctgtctgagcacaatgagccctggttcatgaggctgaacagcactggagaggtgcctgtgctgatccacggggagaacatcatctgtgaggccacccagatcatcgactacctggagcagaccttcctggatgagaggaccccccggctgatgccagacaaggagagcatgtactacccccgggtgcagcactaccgggagctgctggacagcctgcccatggatgcctacacccacggctgcatcctgcaccctgagctgactgtggacagcatgatcccagcctatgccaccacccgcatccgcagccagatcggcaacacagaaagtgagctgaagaagctggccgaggagaacccagacctgcaggaggcctacatcgccaagcagaagaggctgaagagcaagctgctggaccatgacaacgtgaagtacctgaagaagatcctggatgagctggagaaggtgctggaccaggtggagacagagctgcagaggagaaatgaggagaccccagaggagggccagcagccctggctgtgtggggagagcttcaccctggctgatgtgtccctggccgtgaccctgcaccggctgaagttcctgggctttgcccggaggaactggggcaatggcaagaggcccaacctggagacctactatgaaagagtgctgaagaggaagaccttcaacaaggtgctgggccacgtgaacaacatcctgatctctgctgtgctgcccacagccttccgggtggccaagaagagggcccccaaggtgctgggcaccaccctggtggtgggcctgctggccggcgtgggctactttgccttcatgctgttcaggaagaggctgggctccatgatcctggccttccggccccggcccaactacttctag

SEQ ID NO: 40629 - DNA, 1722 bp, Artificial Sequence
  Description of Artificial Sequence: Synthetic coding sequence
atgagcaagaagccacccaacagacctggcatcacctttgaaattggagcccggctggaggccctggactacctgcagaagtggtaccccagcagaattgagaagattgattatgaggagggcaagatgctggtgcactttgagcgctggagccacagatatgatgagtggatctactgggacagcaaccggctgcggcccctggagaggcctgccctgaggaaggagggcctgaaggatgaggaggacttctttgacttcaaggccggggaggaggtgctggcccgctggacagactgccgctactacccagccaagattgaggccatcaacaaggagggcaccttcaccgtgcagttctatgatggagtcatccgctgcctgaagaggatgcacatcaaggccatgccagaagatgccaagggccaggtgaagagccagcaccccctgtcctggtgctgccccatcgaccctgctggcagctgcaaccagagcatgggcagcgaggactggatcgccctggtgaaggctgctgctgctgctgctgccaagaacaagacaggcagcaagcccaggaccagcgccaacagcaacaaggacaaggacaaggatgagaggaagtggttcaaggtgcccagcaagaaggaggagaccagcacctgcatcgccaccccagatgtggagaagaaggaggacctgcccaccagcagcgagaccttcggcctgcacgtggagaatgtgcccaagatggtgttcccccagcctgagagcaccctgagcaacaagaggaagaacaaccagggcaacagcttccaggccaagagggcccggctgaacaagatcaccggcctgctggccagcaaggctgtgggcgtggatggagctgagaagaaggaggactacaatgaaacagcccccatgctggagcaggccatcagccccaagccccagagccagaagaagaatgaggccgacatcagcagcagcgccaacacccagaagccagccctgctgagcagcaccctgagcagcggcaaggcccggagcaagaagtgcaagcatgagagcggggacagcagcggctgcatcaagccacccaagagccccctgagccctgagctgatccaggtggaggacctgaccctggtgtcccagctgagcagcagcgtcatcaacaagaccagccccccccagcctgtgaaccccccccggcccttcaagcacagcgagaggagaagaagaagccagaggctggccaccctgcccatgccagatgattctgtggagaaggtgagcagccccagccctgccacagatggcaaggtgttcagcatcagcagccagaaccagcaggagagctctgtgcctgaggtgcctgatgtggcccacctgcccctggagaagctgggcccctgcctgcccctggacctgagccggggcagcgaggtgacagcccctgtggccagtgacagcagctacagaaatgaatgtcccagggctgagaaggaggacacccagatgctgcccaaccccagcagcaaggccatcgcagatggccgcggggccccagctgctgctggcatcagcaagacagagaagaaggtgaagctggaggacaagagcagcacagccttcggcatccgctcctgggacttcagcgccctgctgatgaagatccccagctacagccccatcagcctgagcggcctgcctgagagctag

SEQ ID NO: 40630 - DNA, 1332 bp, Artificial Sequence
  Description of Artificial Sequence: Synthetic coding sequence
atgcacatcaaggccatgccagaagatgccaagggccaggtgaagagccagcaccccctgtcctggtgctgccccatcgaccctgctggcagctgcaaccagagcatgggcagcgaggactggatcgccctggtgaaggctgctgctgctgctgctgccaagaacaagacaggcagcaagcccaggaccagcgccaacagcaacaaggacaaggacaaggatgagaggaagtggttcaaggtgcccagcaagaaggaggagaccagcacctgcatcgccaccccagatgtggagaagaaggaggacctgcccaccagcagcgagaccttcggcctgcacgtggagaatgtgcccaagatggtgttcccccagcctgagagcaccctgagcaacaagaggaagaacaaccagggcaacagcttccaggccaagagggcccggctgaacaagatcaccggcctgctggccagcaaggctgtgggcgtggatggagctgagaagaaggaggactacaatgaaacagcccccatgctggagcaggccatcagccccaagccccagagccagaagaagaatgaggccgacatcagcagcagcgccaacacccagaagccagccctgctgagcagcaccctgagcagcggcaaggcccggagcaagaagtgcaagcatgagagcggggacagcagcggctgcatcaagccacccaagagccccctgagccctgagctgatccaggtggaggacctgaccctggtgtcccagctgagcagcagcgtcatcaacaagaccagccccccccagcctgtgaaccccccccggcccttcaagcacagcgagaggagaagaagaagccagaggctggccaccctgcccatgccagatgattctgtggagaaggtgagcagccccagccctgccacagatggcaaggtgttcagcatcagcagccagaaccagcaggagagctctgtgcctgaggtgcctgatgtggcccacctgcccctggagaagctgggcccctgcctgcccctggacctgagccggggcagcgaggtgacagcccctgtggccagtgacagcagctacagaaatgaatgtcccagggctgagaaggaggacacccagatgctgcccaaccccagcagcaaggccatcgcagatggccgcggggccccagctgctgctggcatcagcaagacagagaagaaggtgaagctggaggacaagagcagcacagccttcggcatccgctcctgggacttcagcgccctgctgatgaagatccccagctacagccccatcagcctgagcggcctgcctgagagctag

SEQ ID NO: 40631 - DNA, 858 bp, Artificial Sequence
  Description of Artificial Sequence: Synthetic coding sequence
atgagcaagaagccacccaacagacctggcatcacctttgaaattggagcccggctggaggccctggactacctgcagaagtggtaccccagcagaattgagaagattgattatgaggagggcaagatgctggtgcactttgagcgctggagccacagatatgatgagtggatctactgggacagcaaccggctgcggcccctggagaggcctgccctgaggaaggagggcctgaaggatgaggaggacttctttgacttcaaggccggggaggaggtgctggcccgctggacagactgccgctactacccagccaagattgaggccatcaacaaggagggcaccttcaccgtgcagttctatgatggagtcatccgctgcctgaagaggatgcacatcaaggccatgccagaagatgccaagggccaggactggatcgccctggtgaaggctgctgctgctgctgctgccaagaacaagacaggcagcaagcccaggaccagcgccaacagcaacaaggacaaggacaaggatgagaggaagtggttcaaggtgcccagcaagaaggaggagaccagcacctgcatcgccaccccagatgtggagaagaaggaggacctgcccaccagcagcgagaccttcggcctgcacgtggagaatgtgcccaagatggtgttcccccagcctgagagcaccctgagcaacaagaggaagaacaaccagggcaacagcttccaggccaagagggcccggctgaacaagatcaccggcctgctggccagcaaggctgtgggcgtggatggagctgagaagaaggaggactacaatgaaacagcccccatgctggagcaggtgtag

SEQ ID NO: 40632 - DNA, 3054 bp, Artificial Sequence
  Description of Artificial Sequence: Synthetic coding sequence
atgagcaagaagccacccaacagacctggcatcacctttgaaattggagcccggctggaggccctggactacctgcagaagtggtaccccagcagaattgagaagattgattatgaggagggcaagatgctggtgcactttgagcgctggagccacagatatgatgagtggatctactgggacagcaaccggctgcggcccctggagaggcctgccctgaggaaggagggcctgaaggatgaggaggacttctttgacttcaaggccggggaggaggtgctggcccgctggacagactgccgctactacccagccaagattgaggccatcaacaaggagggcaccttcaccgtgcagttctatgatggagtcatccgctgcctgaagaggatgcacatcaaggccatgccagaagatgccaagggccaggtgaagagccagcaccccctgtcctggtgctgccccatcgaccctgctggcagctgcaaccagagcatgggcagcgaggactggatcgccctggtgaaggctgctgctgctgctgctgccaagaacaagacaggcagcaagcccaggaccagcgccaacagcaacaaggacaaggacaaggatgagaggaagtggttcaaggtgcccagcaagaaggaggagaccagcacctgcatcgccaccccagatgtggagaagaaggaggacctgcccaccagcagcgagaccttcggcctgcacgtggagaatgtgcccaagatggtgttcccccagcctgagagcaccctgagcaacaagaggaagaacaaccagggcaacagcttccaggccaagagggcccggctgaacaagatcaccggcctgctggccagcaaggctgtgggcgtggatggagctgagaagaaggaggactacaatgaaacagcccccatgctggagcaggccatcagccccaagccccagagccagaagaagaatgaggccgacatcagcagcagcgccaacacccagaagccagccctgctgagcagcaccctgagcagcggcaaggcccggagcaagaagtgcaagcatgagagcggggacagcagcggctgcatcaagccacccaagagccccctgagccctgagctgatccaggtggaggacctgaccctggtgtcccagctgagcagcagcgtcatcaacaagaccagccccccccagcctgtgaaccccccccggcccttcaagcacagcgagaggagaagaagaagccagaggctggccaccctgcccatgccagatgattctgtggagaaggtgagcagccccagccctgccacagatggcaaggtgttcagcatcagcagccagaaccagcaggagagctctgtgcctgaggtgcctgatgtggcccacctgcccctggagaagctgggcccctgcctgcccctggacctgagccggggcagcgaggtgacagcccctgtggccagtgacagcagctacagaaatgaatgtcccagggctgagaaggaggacacccagatgctgcccaaccccagcagcaaggccatcgcagatggccgcggggccccagctgctgctggcatcagcaagacagagaagaaggtgaagctggaggacaagagcagcacagccttcggcaagaggaaggagaaggacaaggagcggcgggagaagagggacaaggaccactaccggcccaagcagaagaagaagaagaagaagaagaagaagagcaagcagcacgactacagcgactatgaggacagcagcctggagttcctggagcgctgcagcagccccctgaccaggagcagcggcagcagcctggccagccgctccatgttcacagagaagaccaccacctaccagtacccccgggccatcctgtctgtggacctgagcggggagaacctgagtgatgtggacttcctggatgacagcagcacagagagcctgctgctgtctggagatgagtacaaccaggactttgacagcaccaactttgaggagagccaggatgaagatgatgccctgaatgaaattgtgcgctgcatctgtgagatggatgaagaaaatggcttcatgatccagtgtgaggagtgcctgtgctggcagcacagcgtgtgcatgggcctgctggaggagagcatccctgagcagtacatctgctacatctgccgggaccccccaggccagcgctggagcgccaagtaccgctatgacaaggagtggctgaacaatggaaggatgtgtggcctgtccttcttcaaggagaactacagccacctgaatgccaagaagatcgtgtccacccaccacctgctggctgatgtgtatggagtgacagaggtgctgcacggcctgcagctgaagattggcatcctgaagaacaagcaccacccagacctgcacctgtgggcctgcagcggcaagaggaaggaccaggaccagatcatcgccggcgtggagaagaagatcgcccaggacacagtgaaccgggaggagaagaagtatgtgcagaaccacaaggagcccccccggctgcccctgaagatggagggcacctacatcaccagcgagcacagctaccagaagccccagagctttggccaggactgcaagagcctggccgaccccggcagcagtgatgatgatgatgtgagcagcctggaggaggagcaggagttccacatgaggagcaagaacagcctgcagtacagcgccaaggagcacggcatgcctgagaagaacccagctgagggcaacacagtgtttgtgtacaatgacaagaagggcacagaggaccccggggacagccacctgcagtggcagctgaacctgctgacccacattgaaaatgtgcagaatgaggtgaccagcaggatggacctgattgagaaggaggtggatgtgctggagagctggctggacttcaccggggagctggagcccccagaccccctggcccggctgccccagctgaagaggcacatcaagcagctgctgattgacatgggcaaggtgcagcagatcgccaccctgtgcagcgtgtag

SEQ ID NO: 40633 - DNA, 1596 bp, Artificial Sequence
  Description of Artificial Sequence: Synthetic coding sequence
atggagctgcagagcaggcctgaggccctggccgtggagctggcccggcaccagaatggagacctgaagaagcagctgcacgagcggcagcccagaattgctgccctgagtgacaagcaggccctgggcaccatcacagctgtgcctgtgacaggcccccaggtgagcagcctgcagaggctggccggccagggcgctgctgtgctgccccaggtgcggcccaagaccctcatcccagacagcctgcctgtggcccctggccgggacaggcctcccaagcagccccccaccttccagaaggccaccgtggtgtctgtgaagaaccccagccctgccctgcccacagccaacaacacagtgagccacgtgcctgcccctggcagccagccccaggccctggccgagcctgctgccctggccagccccctgagcagcgctggggtggcctatgccatcatcagcaccagccccagcaatgctgctgccatggcccccagcacagctgtgtctgtggtgtctgacagcatcaaggtgcagcccctgctgatctctgctgacaacaagcccccaccccggctgctgagcagcccccacccagccacccaccactgccccctgcaccccagcagcctgcccctgaccccacccagccccagcctgagccccagccccctgcacggcatcttccaggtgatcatcatccagccccaggtgcagacccagcctgagagcacagctgagagccggcccccaacagaggagcccagccagggcgcccaggccaccaagaagaagaaggaggaccggccccccacccaggagaaccctgagaagatcgccttcatggtggccctgggcctggtgaccacagagcacctggaggagatccagagcaagaggcaggagaggaagagaagaagcacagccaacccagcctacagcggcctgctggagacagagaggaagaggctggccagcaactacctgaacaaccccctcttcctgacagcccgggccaatgaagacccctgctggaagaatgagatcacccatgatgagcactgtgccgcctgcaagagaggagccaacctgcagccctgtggcacctgccctggggcctaccacctgagctgcctggagccccccctgaagacagcccccaagggcgtgtgggtgtgcccccgctgccagcagaaggccctgaagaaggatgagggcgtgccctggacaggcatgctggccatcgtgcacagctatgtgacccacaagacagtgaaggaggaggagaagcagaagctgctgcagaggggcagcgagctgcagaatgagcaccagcagctggaggagcgggaccggcggctggccagcgctgtgcagaagtgcctggagctgaagaccagcctgctggcccggcagaggggcacccagagcagcctggaccggctgcgggccctgctgcggctcatccagggcgagcagctgctgcaggtgaccatgaccaccaccagccctgcccccctgctggccggcccctggaccaagcccagcgtggccgccacccaccccaccgtgcagcacccccagggccacaactag

SEQ ID NO: 40634 - DNA, 1470 bp, Artificial Sequence
  Description of Artificial Sequence: Synthetic coding sequence
atggagctgcagagcaggcctgaggccctggccgtggagctggcccggcaccagaatggagacctgaagaagcagctgcacgagcggcagcccagaattgctgccctgagtgacaagcaggccctgggcaccatcacagctgtgcctgtgacaggcccccaggtgagcagcctgcagaggctggccggccagggcgctgctgtgctgccccaggtgcggcccaagaccctcatcccagacagcctgcctgtggcccctggccgggacaggcctcccaagcagccccccaccttccagaaggccaccgtggtgtctgtgaagaaccccagccctgccctgcccacagccaacaacacagtgagccacgtgcctgcccctggcagccagccccaggccctggccgagcctgctgccctggccagccccctgagcagcgctggggtggcctatgccatcatcagcaccagccccagcaatgctgctgccatggcccccagcacagctgtgtctgtggtgtctgacagcatcaaggtgcagcccctgctgatctctgctgacaacaaggtgatcatcatccagccccaggtgcagacccagcctgagagcacagctgagagccggcccccaacagaggagcccagccagggcgcccaggccaccaagaagaagaaggaggaccggccccccacccaggagaaccctgagaagatcgccttcatggtggccctgggcctggtgaccacagagcacctggaggagatccagagcaagaggcaggagaggaagagaagaagcacagccaacccagcctacagcggcctgctggagacagagaggaagaggctggccagcaactacctgaacaaccccctcttcctgacagcccgggccaatgaagacccctgctggaagaatgagatcacccatgatgagcactgtgccgcctgcaagagaggagccaacctgcagccctgtggcacctgccctggggcctaccacctgagctgcctggagccccccctgaagacagcccccaagggcgtgtgggtgtgcccccgctgccagcagaaggccctgaagaaggatgagggcgtgccctggacaggcatgctggccatcgtgcacagctatgtgacccacaagacagtgaaggaggaggagaagcagaagctgctgcagaggggcagcgagctgcagaatgagcaccagcagctggaggagcgggaccggcggctggccagcgctgtgcagaagtgcctggagctgaagaccagcctgctggcccggcagaggggcacccagagcagcctggaccggctgcgggccctgctgcggctcatccagggcgagcagctgctgcaggtgaccatgaccaccaccagccctgcccccctgctggccggcccctggaccaagcccagcgtggccgccacccaccccaccgtgcagcacccccagggccacaactag

SEQ ID NO: 40635 - DNA, 1434 bp, Artificial Sequence
  Description of Artificial Sequence: Synthetic coding sequence
atgaggcggcagccccagaatggagacctgaagaagcagctgcacgagcggcagcccagaattgctgccctgagtgacaagcaggccctgggcaccatcacagctgtgcctgtgacaggcccccaggtgagcagcctgcagaggctggccggccagggcgctgctgtgctgccccaggtgcggcccaagaccctcatcccagacagcctgcctgtggcccctggccgggacaggcctcccaagcagccccccaccttccagaaggccaccgtggtgtctgtgaagaaccccagccctgccctgcccacagccaacaacacagtgagccacgtgcctgcccctggcagccagccccaggccctggccgagcctgctgccctggccagccccctgagcagcgctggggtggcctatgccatcatcagcaccagccccagcaatgctgctgccatggcccccagcacagctgtgtctgtggtgtctgacagcatcaaggtgcagcccctgctgatctctgctgacaacaaggtgatcatcatccagccccaggtgcagacccagcctgagagcacagctgagagccggcccccaacagaggagcccagccagggcgcccaggccaccaagaagaagaaggaggaccggccccccacccaggagaaccctgagaagatcgccttcatggtggccctgggcctggtgaccacagagcacctggaggagatccagagcaagaggcaggagaggaagagaagaagcacagccaacccagcctacagcggcctgctggagacagagaggaagaggctggccagcaactacctgaacaaccccctcttcctgacagcccgggccaatgaagacccctgctggaagaatgagatcacccatgatgagcactgtgccgcctgcaagagaggagccaacctgcagccctgtggcacctgccctggggcctaccacctgagctgcctggagccccccctgaagacagcccccaagggcgtgtgggtgtgcccccgctgccagcagaaggccctgaagaaggatgagggcgtgccctggacaggcatgctggccatcgtgcacagctatgtgacccacaagacagtgaaggaggaggagaagcagaagctgctgcagaggggcagcgagctgcagaatgagcaccagcagctggaggagcgggaccggcggctggccagcgctgtgcagaagtgcctggagctgaagaccagcctgctggcccggcagaggggcacccagagcagcctggaccggctgcgggccctgctgcggctcatccagggcgagcagctgctgcaggtgaccatgaccaccaccagccctgcccccctgctggccggcccctggaccaagcccagcgtggccgccacccaccccaccgtgcagcacccccagggccacaactag

SEQ ID NO: 40636 - DNA, 873 bp, Artificial Sequence
  Description of Artificial Sequence: Synthetic coding sequence
atgaggcggcagccccagaatggagacctgaagaagcagctgcacgagcggcagcccagaattgctgccctgagtgacaagcaggccctgggcaccatcacagctgtgcctgtgacaggcccccaggtgagcagcctgcagaggctggccggccagggcgctgctgtgctgccccaggtgcggcccaagaccctcatcccagacagcctgcctgtggcccctggccgggacaggcctcccaagcagccccccaccttccagaaggccaccgtggtgtctgtgaagaaccccagccctgccctgcccacagccaacaacacagtgagccacgtgcctgcccctggcagccagccccaggccctggccgagcctgctgccctggccagccccctgagcagcgctggggtggcctatgccatcatcagcaccagccccagcaatgctgctgccatggcccccagcacagctgtgtctgtggtgtctgacagcatcaaggtgcagcccctgctgatctctgctgacaacaaggtgatcatcatccagccccaggtgcagacccagcctgagagcacagctgagagccggcccccaacagaggagcccagccagggcgcccaggccaccaagaagaagaaggaggaccggccccccacccaggagaaccctgagaagatcgccttcatggtggccctgggcctggtgaccacagagcacctggaggagatccagagcaagaggcaggagaggaagagaagaagcacagccaacccagcctacagcggcctgctggagacagagaggaagaggctggccagcaactacctgaacaaccccctcttcctgacagcccgggagcgggaccaccccaggtag

SEQ ID NO: 40637 - DNA, 1743 bp, Artificial Sequence
  Description of Artificial Sequence: Synthetic coding sequence
atggactaccccaagatggactacttcctggatgtggagagcgcccaccggctgctggatgtggagagcgcccagcgcttcttctacagccagggcgcccaggcccggcgggccaccctgctgctgccccccaccctgatggccgccagcagtgaagatgacatcgacagaagacccatcagaagagtgcgcagcaagagtgacaccccctacctggccgaggcccgcatctccttcaacctgggcgctgctgaggaggtggagcggctggccgccatgagaagtgacagcctggtgcccggcacccacaccccacccatcagaagaagaagcaagtttgccaacctgggccgcatcttcaagccctggaagtggaggaagaagaagtctgagaagttcaagcacaccagcgctgccctggagaggaagatctccatgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgaccccggggcccctgtgaagctgccctgcctgcctgtgaagctgagcccccccctgccccccaagaaggtgatgatctgcatgcctgtgggcggccctgacctgagcctggtgtcctacacagcccagaagagcggccagcagggcgtggcccagcaccaccacacagtgctgcccagccagatccagcaccagctgcagtatggcagccacggccagcacctgcccagcaccaccggcagcctgcccatgcaccccagcggctgcaggatgattgatgagctgaacaagaccctggccatgaccatgcagaggctggagagcagcgagcagagggtgccctgcagcaccagctaccacagcagcggcctgcacagcggagatggagtgaccaaggccggccccatgggcctgcctgagatccggcaggtgcccaccgtggtgattgaatgtgatgacaacaaggaaaatgtgccccatgaaagtgactatgaggacagcagctgcctgtacacccgggaggaggaggaggaggaggaggatgaagatgatgacagcagcctgtacaccagcagcctggccatgaaggtgtgcaggaaggacagcctggccatcaagctgagcaaccggcccagcaagcgggagctggaggagaagaacatcctgccccggcagacagatgaggagcggctggagctgcggcagcagatcggcaccaagctgacccggcggctgagccagaggcccacagctgaggagctggagcagaggaacatcctgaagcccagaaatgagcaggaggagcaggaggagaagcgggagatcaagaggcggctgaccaggaagctgagccagaggcccaccgtggaggagctgcgggagaggaagatcctgatccgcttcagtgactatgtggaggtggctgatgcccaggactatgaccggcgggctgacaagccctggacccggctgacagctgctgacaaggccgccatcaggaaggagctgaatgagttcaagagcacagagatggaggtgcatgagctgagccgccacctgaccagcttccgcttcccctag

SEQ ID NO: 40638 - DNA, 423 bp, Artificial Sequence
  Description of Artificial Sequence: Synthetic coding sequence
atgtacctgcagggccccaggaagctgatgacccagggcggctatgacatggtgcagaagctgttcctggacttcttcagaagaaggctgagccagaggcccacagctgaggagctggagcagaggaacatcctgaagcccagaaatgagcaggaggagcaggaggagaagcgggagatcaagaggcggctgaccaggaagctgagccagaggcccaccgtggaggagctgcgggagaggaagatcctgatccgcttcagtgactatgtggaggtggctgatgcccaggactatgaccggcgggctgacaagccctggacccggctgacagctgctgacaaggtgtccagaggagagtgctggagggtgggcggccgcacagtgtgctgggtgtccctgggcagccccctgggctctgtgtag

SEQ ID NO: 40639 - DNA, 435 bp, Artificial Sequence
  Description of Artificial Sequence: Synthetic coding sequence
atgtacctgcagggccccaggaagctgatgacccagggcggctatgacatggtgcagaagctgttcctggacttcttcagaagaaggctgagccagaggcccacagctgaggagctggagcagaggaacatcctgaagcccagaaatgagcaggaggagcaggaggagaagcgggagatcaagaggcggctgaccaggaagctgagccagaggcccaccgtggaggagctgcgggagaggaagatcctgatccgcttcagtgactatgtggaggtggctgatgcccaggactatgaccggcgggctgacaagccctggacccggctgacagctgctgacaaggccgccatcaggaaggagctgaatgagttcaagagcacagagatggaggtgcatgagctgagccgccacctgacccgcttccaccggccctag

SEQ ID NO: 40640 - DNA, 600 bp, Artificial Sequence
  Description of Artificial Sequence: Synthetic coding sequence
atgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgtgtctgaggagagccccagcgccagcgagagcggcgtgctgctgagccaggaccccagcgccaagcctgtgctgctgctgccccccaagaagccagctgccttccctggggaccacgaggagacccctgtgaagcagctgcccctgctgaagcagcccccagccctgccccccaagcccaccacccgcatcgccaaccacctgacagactggcaccaggcccaccaggtgggccagaggcaccccctgcccccctggcagtgggccttcagcagccctggcagcagcaagaggatccagagcaggcctggagctgtggcctatgcctgcaaccccagcaccctgggcggccggggccgctggatcacctag

SEQ ID NO: 40641 - DNA, 510 bp, Artificial Sequence
  Description of Artificial Sequence: Synthetic coding sequence
atggactaccccaagatggactacttcctggatgtggagagcgcccaccggctgctggatgtggagagcgcccagcgcttcttctacagccagggcgcccaggcccggcgggccaccctgctgctgccccccaccctgatggccgccagcagtgaagatgacatcgacagaagacccatcagaagagtgcgcagcaagagtgacaccccctacctggccgaggcccgcatctccttcaacctgggcgccggcgtgtccctgtttggagacatggatgaggccaggatgggccctgctgtgcccaccctgggccggcccctgggcctggagctgtgcagcctggagaaccacggcctgctgaagacagcccccacctacaccaccagcgcccacatctgcagcggccccagcactggaggccagttcagcacccagggcatgagccctgtgcagggcgccaagagaagaagagtggtgtggctgcccctggagggggaggagtttggatag

SEQ ID NO: 40642 - DNA, 1455 bp, Artificial Sequence
  Description of Artificial Sequence: Synthetic coding sequence
atggactaccccaagatggactacttcctggatgtggagagcgcccaccggctgctggatgtggagagcgcccagcgcttcttctacagccagggcgcccaggcccggcgggccaccctgctgctgccccccaccctgatggccgccagcagtgaagatgacatcgacagaagacccatcagaagagtgcgcagcaagagtgacaccccctacctggccgaggcccgcatctccttcaacctgggcgctgctgaggaggtggagcggctggccgccatgagaagtgacagcctggtgcccggcacccacaccccacccatcagaagaagaagcaagtttgccaacctgggccgcatcttcaagccctggaagtggaggaagaagaagtctgagaagttcaagcacaccagcgctgccctggagaggaagatctccatgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgaccccggggcccctgtgaagctgccctgcctgcctgtgaagctgagcccccccctgccccccaagaaggtgatgatctgcatgcctgtgggcggccctgacctgagcctggtgtcctacacagcccagaagagcggccagcagggcgtggcccagcaccaccacacagtgctgcccagccagatccagcaccagctgcagtatggcagccacggccagcacctgcccagcaccaccggcagcctgcccatgcaccccagcggctgcaggatgattgatgagctgaacaagaccctggccatgaccatgcagaggctggagagcagcgagcagagggtgccctgcagcaccagctaccacagcagcggcctgcacagcggagatggagtgaccaaggccggccccatgggcctgcctgagatccggcaggtgcccaccgtggtgattgaatgtgatgacaacaaggaaaatgtgccccatgaaagtgactatgaggacagcagctgcctgtacacccgggaggaggaggaggaggaggaggatgaagatgatgacagcagcctgtacaccagcagcctggccatgaaggtgtgcaggaaggacagcctggccatcaagctgagcaaccggcccagcaagcgggagctggaggagaagaacatcctgccccggcagacagatgaggagcggctggagctgcggcagcagatcggcaccaagctgacccggcggctgagccagaggcccacagctgaggagctggagcagaggaacatcctgaagaggaagtag

SEQ ID NO: 40643 - DNA, 798 bp, Artificial Sequence
  Description of Artificial Sequence: Synthetic coding sequence
tgaagccccttcacccccttcagccccctgctgtccttcttcctgagccccttcttcttcctgttccccagcctgagccacagcctgcccacccccagcctgcccctgcccagccccttccccagccccagccctgtgcgggagcccctgcccctgcccagcagccccttccggctgagccccagccccagcgtgtccttcagcctgagcgcccggcgggccaccctgctgctgccccccaccctgatggccgccagcagtgaagatgacatcgacagaagacccatcagaagagtgcgcagcaagagtgacaccccctacctggccgaggcccgcatctccttcaacctgggcgctgctgaggaggtggagcggctggccgccatgagaagtgacagcctggtgcccggcacccacaccccacccatcagaagaagaagcaagtttgccaacctgggccgcatcttcaagccctggaagtggaggaagaagaagtctgagaagttcaagcacaccagcgctgccctggagaggaagatctccatgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgtgtctgaggagagccccagcgcctag

SEQ ID NO: 40644 - DNA, 1248 bp, Artificial Sequence
  Description of Artificial Sequence: Synthetic coding sequence
tgaggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgaccccggggcccctgtgaagctgccctgcctgcctgtgaagctgagcccccccctgccccccaagaaggtgatgatctgcatgcctgtgggcggccctgacctgagcctggtgtcctacacagcccagaagagcggccagcagggcgtggcccagcaccaccacacagtgctgcccagccagatccagcaccagctgcagtatggcagccacggccagcacctgcccagcaccaccggcagcctgcccatgcaccccagcggctgcaggatgattgatgagctgaacaagaccctggccatgaccatgcagaggctggagagcagcgagcagagggtgccctgcagcaccagctaccacagcagcggcctgcacagcggagatggagtgaccaaggccggccccatgggcctgcctgagatccggcaggtgcccaccgtggtgattgaatgtgatgacaacaaggaaaatgtgccccatgaaagtgactatgaggacagcagctgcctgtacacccgggaggaggaggaggaggaggaggatgaagatgatgacagcagcctgtacaccagcagcctggccatgaaggtgtgcaggaaggacagcctggccatcaagctgagcaaccggcccagcaagcgggagctggaggagaagaacatcctgccccggcagacagatgaggagcggctggagctgcggcagcagatcggcaccaagctgacccggcggctgagccagaggcccacagctgaggagctggagcagaggaacatcctgaagcccagaaatgagcaggaggagcaggaggagaagcgggagatcaagaggcggctgaccaggaagctgagccagaggcccaccgtggaggagctgcgggagaggaagatcctgatccgcttcagtgactatgtggaggtggctgatgcccaggactatgacagaagagctgacaagccctggacccggctgacagctgctgacaaggccgccatcaggaaggagctgaatgagttcaagagcacagagatggaggtgcatgagctgagccgccacctgacccgcttccaccggccctag

SEQ ID NO: 40645 - DNA, 1644 bp, Artificial Sequence
  Description of Artificial Sequence: Synthetic coding sequence
atggactaccccaagatggactacttcctggatgtggagagcgcccaccggctgctggatgtggagagcgcccagcgcttcttctacagccagggcgcccaggcccggcgggccaccctgctgctgccccccaccctgatggccgccagcagtgaagatgacatcgacagaagacccatcagaagagtgcgcagcaagagtgacaccccctacctggccgaggcccgcatctccttcaacctgggcgctgctgaggaggtggagcggctggccgccatgagaagtgacagcctggtgcccggcacccacaccccacccatcagaagaagaagcaagtttgccaacctgggccgcatcttcaagccctggaagtggaggaagaagaagtctgagaagttcaagcacaccagcgctgccctggagaggaagatctccatgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgtgtctgaggagagccccagcgccagcgagagcggcgtgctgctgagccaggaccccagcgccaagcctgtgctgctgctgccccccaagaagccagctgccttccctggggaccacgaggagacccctgtgaagcagctgcccctgctgaagcagcccccagccctgccccccaagcccaccaccagaattgccaaccacctgacagaccccggggcccctgtgaagctgccctgcctgcctgtgaagctgagcccccccctgccccccaagaaggtgatgatctgcatgcctgtgggcggccctgacctgagcctggtgtcctacacagcccagaagagcggccagcagggcgtggcccagcaccaccacacagtgctgcccagccagatccagcaccagctgcagtatggcagccacggccagcacctgcccagcaccaccggcagcctgcccatgcaccccagcggctgcaggatgattgatgagctgaacaagaccctggccatgaccatgcagaggctggagagcagcgagcagagggtgccctgcagcaccagctaccacagcagcggcctgcacagcggagatggagtgaccaaggccggccccatgggcctgcctgagatccggcaggtgcccaccgtggtgattgaatgtgatgacaacaaggaaaatgtgccccatgaaagtgactatgaggacagcagctgcctgtacacccgggaggaggaggaggaggaggaggatgaagatgatgacagcagcctgtacaccagcagcctggccatgaaggtgtgcaggaaggacagcctggccatcaagctgagcaaccggcccagcaagcgggagctggaggagaagaacatcctgccccggcagacagatgaggagcggctggagctgcggcagcagatcggcaccaagctgaccaggaacaagttcagaagagactttggccggcagctggagggcaagtag

SEQ ID NO: 40646 - DNA, 693 bp, Artificial Sequence
  Description of Artificial Sequence: Synthetic coding sequence
aacctgggccgcatcttcaagccctggaagtggaggaagaagaagtctgagaagttcaagcacaccagcgctgccctggagaggaagatctccatgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgtgtctgaggagagccccagcgccagcgagagcggcgtgctgctgagccaggaccccagcgccaagcctgtgctgctgctgccccccaagaagccagctgccttccctggggaccacgaggagacccctgtgaagcagctgcccctgctgaagcagcccccagccctgccccccaagcccaccaccagaattgccaaccacctgacagactggcaccaggcccaccaggtgggccagaggcaccccctgcccccctggcagtgggccttcagcagccctggcagcagcaagaggatccagagcaggcctggagctgtggcctatgcctgcaaccccagcaccctgggcggccggggccgctggatcacctag

SEQ ID NO: 40647 - DNA, 1308 bp, Artificial Sequence
  Description of Artificial Sequence: Synthetic coding sequence
atgaggcagagccgggaggagctgatcaagaggggcgtgctgaaggagatctatgacaaggatggagagctgagcatcagcaatgaggaggacagcctggagaatggccagagcctgagcagcagccagctgagcctgcctgccctgtctgagatggagcctgtgcccatgccccgggacccctgcagctatgaggtgctgcagcccagcgacatcatggatggccctgaccccggggcccctgtgaagctgccctgcctgcctgtgaagctgagcccccccctgccccccaagaaggtgatgatctgcatgcctgtgggcggccctgacctgagcctggtgtcctacacagcccagaagagcggccagcagggcgtggcccagcaccaccacacagtgctgcccagccagatccagcaccagctgcagtatggcagccacggccagcacctgcccagcaccaccggcagcctgcccatgcaccccagcggctgcaggatgattgatgagctgaacaagaccctggccatgaccatgcagaggctggagagcagcgagcagagggtgccctgcagcaccagctaccacagcagcggcctgcacagcggagatggagtgaccaaggccggccccatgggcctgcctgagatccggcaggtgcccaccgtggtgattgaatgtgatgacaacaaggaaaatgtgccccatgaaagtgactatgaggacagcagctgcctgtacacccgggaggaggaggaggaggaggaggatgaagatgatgacagcagcctgtacaccagcagcctggccatgaaggtgtgcaggaaggacagcctggccatcaagctgagcaaccggcccagcaagcgggagctggaggagaagaacatcctgccccggcagacagatgaggagcggctggagctgcggcagcagatcggcaccaagctgacccggcggctgagccagaggcccacagctgaggagctggagcagaggaacatcctgaagcccagaaatgagcaggaggagcaggaggagaagcgggagatcaagaggcggctgaccaggaagctgagccagaggcccaccgtggaggagctgcgggagaggaagatcctgatccgcttcagtgactatgtggaggtggctgatgcccaggactatgacagaagagctgacaagccctggacccggctgacagctgctgacaaggccgccatcaggaaggagctgaatgagttcaagagcacagagatggaggtgcatgagctgagccgccacctgaccagcttccgcttcccctag

SEQ ID NO: 40648 - DNA, 1665 bp, Artificial Sequence
  Description of Artificial Sequence: Synthetic coding sequence
atggacaatgctgtggatggcctggacaaggccagcatcgccaacagtgatggccccacagctggcagccagaccccacccttcaagaggaagggcaagctgagcaccatcggcaagatcttcaagccctggaagtggaggaagaagaagaccagtgacaagttccgggagaccagcgctgtgctggagaggaagatcagcacccggcagagccgggaggagctgatcagaagaggagtgctgaaggagctgcctgaccaggatggagatgtgacagtgaactttgagaacagcaatggccacatgatccccatcggggaggagagcacccgggaggagaatgtggtgaagtctgaggagggcaatggatctgtgtctgagaagaccccacccctggaggagcaggccgaggacaagaaggccggcagcagccacagcaagaagaccaccggcagcaaggccagcgccagccccagcaccagcagcaccagcagccggcccaaggccagcaaggagaccgtgagcagcaaggccggcaccgtgggcaccaccaagggcaagaggaagacagacaagcagcccatcaccagccacctgagcagtgacaccaccaccagcggcaccagtgacctgaagggggagcctgctgagaccagggtggagagcttcaagctggagcagacagtgcctggagctgaggagcagaacacaggcaagttcaagtccatggtgcccccacctcctgtggccccagcccccagccccctggccccacccctgcccctggaggaccagtgcatcacagccagtgacacccctgtggtgctggtgtctgtgggcgctgacctgcctgtgtctgccctggaccccagccagctgctgtgggccgaggagcccaccaacagaaccaccctgtacagcggcaccggcctgtctgtgaaccgggagaatgccaagtgcttcaccaccaaggaggagctgggcaagacagtgccccagctgctgaccccaggcctgatgggagagagcagcgagagcttcagcgcctctgaagatgagggccaccgggagtaccaggccaatgacagcgacagtgatggccccatcctgtacacagatgatgaagatgaagatgaagatgaagatggcagcggggagagcgccctggccagcaagatcagaagaagagacaccctggccatcaagctgggcaaccggcccagcaagaaggagctggaggacaagaacatcctgcagaggaccagcgaggaggagcggcaggagatccggcagcagatcggcaccaagctggtgcggcggctgagccagaggcccaccacagaggagctggagcagaggaacatcctgaagcagaagaatgaggaggaggagcaggaggccaagatggagctgaagaggcggctgagcaggaagctgagcctgcggcccaccgtggccgagctgcaggcccggcgcatcctgcgcttcaatgaatatgtggaggtgacagacagcccagactatgaccggcgggctgacaagccctgggcccggctgaccccagctgacaaggccgccatcaggaaggagctgaatgagttcaagagcacagagatggaggtgcatgaggagagccggcagttcacccgcttccaccggccctag

SEQ ID NO: 40649 - DNA, 1698 bp, Artificial Sequence
  Description of Artificial Sequence: Synthetic coding sequence
atgggccagacctctgtgtccaccctgagcccccagcccggctctgtggatggcctggacaaggccagcatcgccaacagtgatggccccacagctggcagccagaccccacccttcaagaggaagggcaagctgagcaccatcggcaagatcttcaagccctggaagtggaggaagaagaagaccagtgacaagttccgggagaccagcgctgtgctggagaggaagatcagcacccggcagagccgggaggagctgatccggcggggcgtgctgaaggagctgcctgaccaggatggagatgtgacagtgaactttgagaacagcaatggccacatgatccccatcggggaggagagcacccgggaggagaatgtggtgaagtctgaggagggcaatggatctgtgtctgagaagaccccacccctggaggagcaggccgaggacaagaaggccggcagcagccacagcaagaagaccaccggcagcaaggccagcgccagccccagcaccagcagcaccagcagccggcccaaggccagcaaggagaccgtgagcagcaaggccggcaccgtgggcaccaccaagggcaagaggaagacagacaagcagcccatcaccagccacctgagcagtgacaccaccaccagcggcaccagtgacctgaagggggagcctgctgagaccagggtggagagcttcaagctggagcagacagtgcctggagctgaggagcagaacacaggcaagttcaagtccatggtgcccccacctcctgtggccccagcccccagccccctggccccacccctgcccctggaggaccagtgcatcacagccagtgacacccctgtggtgctggtgtctgtgggcgctgacctgcctgtgtctgccctggaccccagccagctgctgtgggccgaggagcccaccaacagaaccaccctgtacagcggcaccggcctgtctgtgaacagagaaaatgccaagtgcttcaccaccaaggaggagctgggcaagacagtgccccagctgctgaccccaggcctgatgggagagagcagcgagagcttcagcgcctctgaagatgagggccaccgggagtaccaggccaatgacagcgacagtgatggccccatcctgtacacagatgatgaagatgaagatgaagatgaagatggcagcggggagagcgccctggccagcaagatcagaagaagagacaccctggccatcaagctgggcaaccggcccagcaagaaggagctggaggacaagaacatcctgcagaggaccagcgaggaggagcggcaggagatccggcagcagatcggcaccaagctggtgcggcggctgagccagaggcccaccacagaggagctggagcagaggaacatcctgaagcagaagaatgaggaggaggagcaggaggccaagatggagctgaagaggcggctgagcaggaagctgagcctgcggcccaccgtggccgagctgcaggcccggcgcatcctgcgcttcaatgaatatgtggaggtgacagacagcccagactatgacagaagagctgacaagccctgggcccggctgaccccagctgacaaggccgccatcaggaaggagctgaatgagttcaagagcacagagatggaggtgcatgaggagagccggcagttcacccgcttccaccggccctag

SEQ ID NO: 40650 - DNA, 537 bp, Artificial Sequence
  Description of Artificial Sequence: Synthetic coding sequence
atgggccagacctctgtgtccaccctgagcccccagcccggctctgtggatggcctggacaaggccagcatcgccaacagtgatggccccacagctggcagccagaccccacccttcaagaggaagggcaagctgagcaccatcggcaagatcttcaagccctggaagtggaggaagaagaagaccagtgacaagttccgggagaccagcgctgtgctggagaggaagatcagcacccggcagagccgggaggagctgatccggcggggcgtgctgaaggagctgcctgaccaggccggcagcagccacagcaagaagaccaccggcagcaaggccagcgccagccccagcaccagcagcaccagcagccggcccaaggccagcaaggagaccgtgagcagcaaggccggcaccgtgggcaccaccaagggcaagaggaagacagacaagcagcccatcaccagccacctgagcagtgacaccaccaccagcggcaccagtgacctgaagggggagcctgctgagaccagggtgtag

SEQ ID NO: 40651 - DNA, 1905 bp, Artificial Sequence
  Description of Artificial Sequence: Synthetic coding sequence
atggacaatgctgtggatggcctggacaaggccagcatcgccaacagtgatggccccacagctggcagccagaccccacccttcaagaggaagggcaagctgagcaccatcggcaagatcttcaagccctggaagtggaggaagaagaagaccagtgacaagttccgggagaccagcgctgtgctggagaggaagatcagcacccggcagagccgggaggagctgatcagaagaggagtgctgaaggagctgcctgaccaggatggagatgtgacagtgaactttgagaacagcaatggccacatgatccccatcggggaggagagcacccgggaggagaatgtggtgaagtctgaggagggcaatggatctgtgtctgagaagaccccacccctggaggagcaggccgaggacaagaaggaaaatacagagaaccacagcgagaccccagctgccccagccctgccccccagcgccccacccaagccccggcccaagcccaagcccaagaagagccctgtgccccccaagggggccacagctggggccagccacaagggagatgaggtgccccccatcaagaagaacaccaaggcccctgggaagcaggcccctgtgcccccacccaagccagccagcaggaacaccacccgggaggccgccggcagcagccacagcaagaagaccaccggcagcaaggccagcgccagccccagcaccagcagcaccagcagccggcccaaggccagcaaggagaccgtgagcagcaaggccggcaccgtgggcaccaccaagggcaagaggaagacagacaagcagcccatcaccagccacctgagcagtgacaccaccaccagcggcaccagtgacctgaagggggagcctgctgagaccagggtggagagcttcaagctggagcagacagtgcctggagctgaggagcagaacacaggcaagttcaagtccatggtgcccccacctcctgtggccccagcccccagccccctggccccacccctgcccctggaggaccagtgcatcacagccagtgacacccctgtggtgctggtgtctgtgggcgctgacctgcctgtgtctgccctggaccccagccagctgctgtgggccgaggagcccaccaacagaaccaccctgtacagcggcaccggcctgtctgtgaaccgggagaatgccaagtgcttcaccaccaaggaggagctgggcaagacagtgccccagctgctgaccccaggcctgatgggagagagcagcgagagcttcagcgcctctgaagatgagggccaccgggagtaccaggccaatgacagcgacagtgatggccccatcctgtacacagatgatgaagatgaagatgaagatgaagatggcagcggggagagcgccctggccagcaagatcagaagaagagacaccctggccatcaagctgggcaaccggcccagcaagaaggagctggaggacaagaacatcctgcagaggaccagcgaggaggagcggcaggagatccggcagcagatcggcaccaagctggtgcggcggctgagccagaggcccaccacagaggagctggagcagaggaacatcctgaagcagaagaatgaggaggaggagcaggaggccaagatggagctgaagaggcggctgagcaggaagctgagcctgcggcccaccgtggccgagctgcaggcccggcgcatcctgcgcttcaatgaatatgtggaggtgacagacagcccagactatgaccggcgggctgacaagccctgggcccggctgaccccagctgacaaggccgccatcaggaaggagctgaatgagttcaagagcacagagatggaggtgcatgaggagagccggcagttcacccgcttccaccggccctag

SEQ ID NO: 40652 - DNA, 1938 bp, Artificial Sequence
  Description of Artificial Sequence: Synthetic coding sequence
atgggccagacctctgtgtccaccctgagcccccagcccggctctgtggatggcctggacaaggccagcatcgccaacagtgatggccccacagctggcagccagaccccacccttcaagaggaagggcaagctgagcaccatcggcaagatcttcaagccctggaagtggaggaagaagaagaccagtgacaagttccgggagaccagcgctgtgctggagaggaagatcagcacccggcagagccgggaggagctgatccggcggggcgtgctgaaggagctgcctgaccaggatggagatgtgacagtgaactttgagaacagcaatggccacatgatccccatcggggaggagagcacccgggaggagaatgtggtgaagtctgaggagggcaatggatctgtgtctgagaagaccccacccctggaggagcaggccgaggacaagaaggagaacacagagaaccacagcgagaccccagctgccccagccctgcccccatctgccccacccaagccccggcccaagcccaagcccaagaagagccctgtgccccccaagggggccacagctggggccagccacaagggagatgaggtgccccccatcaagaagaacaccaaggcccctgggaagcaggcccctgtgcccccacccaagccagccagcaggaacaccacccgggaggccgccggcagcagccacagcaagaagaccaccggcagcaaggccagcgccagccccagcaccagcagcaccagcagccggcccaaggccagcaaggagaccgtgagcagcaaggccggcaccgtgggcaccaccaagggcaagaggaagacagacaagcagcccatcaccagccacctgagcagtgacaccaccaccagcggcaccagtgacctgaagggggagcctgctgagaccagggtggagagcttcaagctggagcagacagtgcctggagctgaggagcagaacacaggcaagttcaagtccatggtgcccccacctcctgtggccccagcccccagccccctggccccacccctgcccctggaggaccagtgcatcacagccagtgacacccctgtggtgctggtgtctgtgggcgctgacctgcctgtgtctgccctggaccccagccagctgctgtgggccgaggagcccaccaacagaaccaccctgtacagcggcaccggcctgtctgtgaacagagaaaatgccaagtgcttcaccaccaaggaggagctgggcaagacagtgccccagctgctgaccccaggcctgatgggagagagcagcgagagcttcagcgcctctgaagatgagggccaccgggagtaccaggccaatgacagcgacagtgatggccccatcctgtacacagatgatgaagatgaagatgaagatgaagatggcagcggggagagcgccctggccagcaagatcagaagaagagacaccctggccatcaagctgggcaaccggcccagcaagaaggagctggaggacaagaacatcctgcagaggaccagcgaggaggagcggcaggagatccggcagcagatcggcaccaagctggtgcggcggctgagccagaggcccaccacagaggagctggagcagaggaacatcctgaagcagaagaatgaggaggaggagcaggaggccaagatggagctgaagaggcggctgagcaggaagctgagcctgcggcccaccgtggccgagctgcaggcccggcgcatcctgcgcttcaatgaatatgtggaggtgacagacagcccagactatgacagaagagctgacaagccctgggcccggctgaccccagctgacaaggccgccatcaggaaggagctgaatgagttcaagagcacagagatggaggtgcatgaggagagccggcagttcacccgcttccaccggccctag

SEQ ID NO: 40653 - DNA, 2139 bp, Artificial Sequence
  Description of Artificial Sequence: Synthetic coding sequence
atgggccaggctgatgtgtccaggcctgtgaacccagatgctgtggaggaggccgaccagcccaccacagagcccggcatggtgctggacagcgtggaggccggggacaccaccccacccaccaagaggaagagcaagttcagcggctttgggaagatcttcaagccctggaagtggaggaagaagaagagcagtgacaagttcaaggagaccagcgaggtgctggagaggaagatctccatgaggaagccccgggaggagctggtgaagaggggcgtgctgctggaggaccctgagcagggcggagaagatcctgggaagcccagtgatgccatgctgaagaatggccacaccacccccatcggaaatgcccggagcagcagccctgtgcaggtggaggaggagcctgtgcggctggccagcctgaggaaggccatccctgaggaggacctgaagaagaggctgggcagcacaggcagccagcccaacagcgaggccgagagcgtgcctgaaaatgtgcccaagccacccctgctgccccccaagaggcccctgagcagcagccatgaggccagcgagggccaggccaaggatgccaccagcagcggcggcacagcccgcttcatcatcagcaccagcatcaccacagccccagctgccaccacagctgccaccagcctggccaagacagtgaacctgtctgtgacccccagccctgcccccaggaccctgcctgctgccccagccagcaccaacaccacagccacccccagcctgacccacatggtgcctgccaagcagccccccatccccccacccaagccagcccacaggaacagcaaccctgtgattgctgagctgagccaggccatcaacagcggcaccctgctgagcaagcccagcccccccctgccccccaagaggggcatccccagcacctctgtgcccaccctggagagcgctgctgccatcaccaccaagacccccagtgatgagcgggagaagagcacctgcagcatgggcagcgagctgctgcccatgatcagccccaggagccccagcccccccctgcccacccacatccccccagagccccccaggaccccacccttccctgccaagaccttccaggtggtgcctgagattgagttcccccccagcctggacctgcaccaggagatcccccagcaggaggaccagaagaaggaggtgcccaagaggatcctggaccagaactttggagagccccacatccccagccggctgccccccctgcccctgcacatccgcatccagcaggccctgaccagccccctgcccatgacccccatcctggagggcagccaccgggcccacagcctgctgtttgaaaattctgacagcttcagcgaggacagcagcaccctgggccgcaccaggagcctgcccatcaccatcgagatgctgaaggtgcctgatgatgaggaggaggaggagcagacctgccccagcaccttcagcgaggagatgacccccaccagcgtcatccccaagctgccccagtgcctgcgggaggaggaggagaaggagagtgacagcgacagcgagggccccatccagtacagagatgaggaggatgaagatgagagctaccagagcgccctggccaacaaggtgaagaggaaggacaccctggccatgaagctgaaccaccggcccagcgagcctgagctgaacctgaacagctggccctgcaagagcaaggaggagtggaatgagatccgccaccagatcggcaacaccctcatccggcggctgagccagaggcccaccccagaggagctggagcagaggaacatcctgcagcccaagaatgaggccgaccggcaggccgagaagcgggagatcaagaggcggctgaccaggaagctgagccagaggcccaccgtggccgagctgctggccaggaagatcctgcgcttcaatgaatatgtggaggtgacagatgcccaggactatgaccggcgggctgacaagccctggaccaagctgaccccagctgacaaggccgccatcaggaaggagctgaatgagttcaagagcagcgagatggaggtgcatgaggagagcaagcacttcacccgctaccaccggccctag

SEQ ID NO: 40654 - DNA, 1938 bp, Artificial Sequence
  Description of Artificial Sequence: Synthetic coding sequence
gagaggcctgctgaggaggccgaccagcccaccacagagcccggcatggtgctggacagcgtggaggccggggacaccaccccacccaccaagaggaagagcaagttcagcggctttgggaagatcttcaagccctggaagtggaggaagaagaagagcagtgacaagttcaaggagaccagcgaggtgctggagaggaagatctccatgaggaagccccgggaggagctggtgaagaggggcgtgctgctggaggaccctgagcagggcggggaggaccccgggaagcccagtgatgccatgctgaagaatggccacaccacccccatcggaaatgcccggagcagcagccctgtgcaggtggaggaggagcctgtgcggctggccagcctgaggaaggccatccctgaggaggacctgaagaagaggctgggcagcacaggcagccagcccaacagcgaggccgagagcgtgcctgaaaatgtgcccaagccacccctgctgccccccaagaggcccctgagcagcagccatgaggccagcgagggccaggccaaggatgccaccagcagcggcggcacagcccgcttcatcatcagcaccagcatcaccacagccccagctgccaccacagctgccaccagcctggccaagacagtgaacctgtctgtgacccccagccctgcccccaggaccctgcctgctgccccagccagcaccaacaccacagccacccccagcctgacccacatggtgcctgccaagcagccccccatccccccacccaagccagcccacaggaacagcaaccctgtgattgctgagctgagccaggccatcaacagcggcaccctgctgagcaagcccagcccccccctgccccccaagaggggcatccccagcacctctgtgcccaccctggagagcgctgctgccatcaccaccaagacccccagtgatgagcgggagaagagcacctgcagcatgggcagcgagctgctgcccatgatcagccccaggagccccagcccccccctgcccacccacatccccccagagccccccaggaccccacccttccctgccaagaccttccaggtggtgcctgagattgagttcccccccagcctggacctgcaccaggagatcccccagcaggaggaccagaagaaggaggtgcccaagaggatcctggaccagaactttggagagccccacatccccagccggctgccccccctgcccctgcacatccgcatccagcaggccctgaccagccccctgcccatgacccccatcctggagggcagccaccgggcccacagcctgctgtttgagaacagcgacagcttcagcgaggacagcagcaccctgggccgcaccaggagcctgcccatcaccatcgagatgctgaaggtgcctgatgatgaggaggaggaggagcagacctgccccagcaccttcagcgaggagatgacccccaccagcgtcatccccaagctgccccagtgcctgcgggaggaggaggagaaggagagtgacagcgacagcgagggccccatccagtacagagatgaagaagatgaagatgagagctaccagagcgccctggccaacaaggtgaagaggaaggacaccctggccatgaagctgaaccaccggcccagcgagcctgagctgaacctgaacagctggccctgcaagagcaaggaggagtggaatgagatccgccaccagatcggcaacaccctcatccggcggctgagccagaggcccaccccagaggagctggagcagaggaacatcctgcagcagtacagagtgaagtttggcctgaagagcctgctgacagagaaggtgtgggccagcctgggcctgtttgtgtccatgttcagcctgaccaaccccagccctgtgctgagcgccctgctgggctag

SEQ ID NO: 40655 - DNA, 2109 bp, Artificial Sequence
  Description of Artificial Sequence: Synthetic coding sequence
atggaggacccctttgaggaggccgaccagcccaccacagagcccggcatggtgctggacagcgtggaggccggggacaccaccccacccaccaagaggaagagcaagttcagcggctttgggaagatcttcaagccctggaagtggaggaagaagaagagcagtgacaagttcaaggagaccagcgaggtgctggagaggaagatctccatgaggaagccccgggaggagctggtgaagaggggcgtgctgctggaggaccctgagcagggcggagaagatcctgggaagcccagtgatgccatgctgaagaatggccacaccacccccatcggaaatgcccggagcagcagccctgtgcaggtggaggaggagcctgtgcggctggccagcctgaggaaggccatccctgaggaggacctgaagaagaggctgggcagcacaggcagccagcccaacagcgaggccgagagcgtgcctgaaaatgtgcccaagccacccctgctgccccccaagaggcccctgagcagcagccatgaggccagcgagggccaggccaaggatgccaccagcagcggcggcacagcccgcttcatcatcagcaccagcatcaccacagccccagctgccaccacagctgccaccagcctggccaagacagtgaacctgtctgtgacccccagccctgcccccaggaccctgcctgctgccccagccagcaccaacaccacagccacccccagcctgacccacatggtgcctgccaagcagccccccatccccccacccaagccagcccacaggaacagcaaccctgtgattgctgagctgagccaggccatcaacagcggcaccctgctgagcaagcccagcccccccctgccccccaagaggggcatccccagcacctctgtgcccaccctggagagcgctgctgccatcaccaccaagacccccagtgatgagcgggagaagagcacctgcagcatgggcagcgagctgctgcccatgatcagccccaggagccccagcccccccctgcccacccacatccccccagagccccccaggaccccacccttccctgccaagaccttccaggtggtgcctgagattgagttcccccccagcctggacctgcaccaggagatcccccagcaggaggaccagaagaaggaggtgcccaagaggatcctggaccagaactttggagagccccacatccccagccggctgccccccctgcccctgcacatccgcatccagcaggccctgaccagccccctgcccatgacccccatcctggagggcagccaccgggcccacagcctgctgtttgaaaattctgacagcttcagcgaggacagcagcaccctgggccgcaccaggagcctgcccatcaccatcgagatgctgaaggtgcctgatgatgaggaggaggaggagcagacctgccccagcaccttcagcgaggagatgacccccaccagcgtcatccccaagctgccccagtgcctgcgggaggaggaggagaaggagagtgacagcgacagcgagggccccatccagtacagagatgaggaggatgaagatgagagctaccagagcgccctggccaacaaggtgaagaggaaggacaccctggccatgaagctgaaccaccggcccagcgagcctgagctgaacctgaacagctggccctgcaagagcaaggaggagtggaatgagatccgccaccagatcggcaacaccctcatccggcggctgagccagaggcccaccccagaggagctggagcagaggaacatcctgcagcccaagaatgaggccgaccggcaggccgagaagcgggagatcaagaggcggctgaccaggaagctgagccagaggcccaccgtggccgagctgctggccaggaagatcctgcgcttcaatgaatatgtggaggtgacagatgcccaggactatgaccggcgggctgacaagccctggaccaagctgaccccagctgacaaggccgccatcaggaaggagctgaatgagttcaagagcagcgagatggaggtgcatgaggagagcaagcacttcacccgctaccaccggccctag

SEQ ID NO: 40656 - DNA, 804 bp, Artificial Sequence
  Description of Artificial Sequence: Synthetic coding sequence
atgagcggctgcttccctgtgtctggcctgcgctgcctgagcagagatggccgcatggccgcccagggcgccccccgcttcctgctgacctttgattttgatgagaccatcgtggatgagaacagtgatgacagcatcgtgcgggccgcccctggccagaggctgcctgagagcctgcgggccacctaccgggagggcttctacaatgagtacatgcagagggtcttcaagtacctgggggagcagggcgtgcggccccgggacctgagcgccatctatgaggccatccccctgagccctggcatgtctgacctgctgcagtttgtggccaagcagggcgcctgctttgaggtgatcctgatcagtgatgccaacacctttggagtggagagcagcctgcgggccgccggccaccacagcctcttccgccgcatcctgagcaaccccagcggcccagatgcccggggcctgctggccctgcggcccttccacacccacagctgtgcccgctgcccagccaacatgtgcaagcacaaggtgctgagtgactacctgcgggagcgggcccatgatggagtgcactttgagcggctcttctacgtgggagatggagccaatgacttctgccccatgggcctgctggccggaggagatgtggccttcccccggcggggctaccccatgcacaggctcatccaggaggcccagaaggccgagcccagcagcttccgggcctctgtggtgccctgggagacagctgctgatgtgcggctgcacctgcagcaggtgctgaagagctgctag

SEQ ID NO: 40657 - DNA, 879 bp, Artificial Sequence
  Description of Artificial Sequence: Synthetic coding sequence
atgtgccagaggctgtggccctggccagccaaccagcccctgcccggcggcctgctgccccggcccctgagcctggcccccagcagcagcagcagctgctgcagccccccctgcagccaggacggccgcatggccgcccagggcgccccccgcttcctgctgacctttgattttgatgagaccatcgtggatgaaaattctgatgacagcatcgtgcgggccgcccctggccagaggctgcctgagagcctgcgggccacctaccgggagggcttctacaatgagtacatgcagagggtcttcaagtacctgggggagcagggcgtgcggccccgggacctgagcgccatctatgaggccatccccctgagccctggcatgtctgacctgctgcagtttgtggccaagcagggcgcctgctttgaagtcatcctgatcagtgatgccaacaccttcggcgtggagagcagcctgcgggctgctggccaccacagcctcttccgccgcatcctgagcaaccccagcggcccagatgcccggggcctgctggccctgcggcccttccacacccacagctgtgcccgctgcccagccaacatgtgcaagcacaaggtgctgagtgactacctgcgggagcgggcccatgatggagtgcactttgagcggctcttctacgtgggagatggagccaatgacttctgccccatgggcctgctggccggaggagatgtggccttcccccggcggggctaccccatgcacaggctcatccaggaggcccagaaggccgagcccagcagcttccgggcctctgtggtgccctgggagacagctgctgatgtgcggctgcacctgcagcaggtgctgaagagctgctag

SEQ ID NO: 40658 - DNA, 615 bp, Artificial Sequence
  Description of Artificial Sequence: Synthetic coding sequence
atgagcggctgcttccctgtgtctggcctgcgctgcctgagcagagatggccgcatggccgcccagggcgccccccgcttcctgctgacctttgattttgatgagaccatcgtggatgagaacagtgatgacagcatcgtgcgggccgcccctggccagaggctgcctgagagcctgcgggccacctaccgggagggcttctacaatgagtacatgcagagggtcttcaagtacctgggggagcagggcgtgcggccccgggacctgagcgccatctatgaggccatccccctgagccctggcatgtctgacctgctgcagtttgtggccaagcagggcgcctgctttgaggtgatcctgatcagtgatgccaacacctttggagtggagagcagcctgcgggccgccggccaccacagcctcttccgccgcatcctgagcaaccccagcggcccagatgcccggggcctgctggccctgcggcccttccacacccacagctgtgcccgctgcccagccaacatgtgcaagcacaaggtgctgagtgactacctgcgggagcgggcccatgatggagtgcactttgagcggctcttctacgtgggagatggatag

SEQ ID NO: 40659 - DNA, 336 bp, Artificial Sequence
  Description of Artificial Sequence: Synthetic coding sequence
atgtgccagaggctgtggccctggccagccaaccagcccctgcccggcggcctgctgccccggcccctgagcctggcccccagcagcagcagcagctgctgcagccccccctgcagccaggacggccgcatggccgcccagggcgccccccgcttcctgctgacctttgattttgatgagaccatcgtggatgaaaattctgatgacagcatcgtgcgggccgcccctggccagaggctgcctgagagcctgcgggccacctaccgggagggcttctacaatgagtacatgcagagggtcttcaagtacctgggggagcagggcgtgcggccctag

SEQ ID NO: 40660 - DNA, 879 bp, Artificial Sequence; identical to SEQ ID NO: 40657
  Description of Artificial Sequence: Synthetic coding sequence

SEQ ID NO: 40661 - DNA, 726 bp, Artificial Sequence
  Description of Artificial Sequence: Synthetic coding sequence
atgaagatcctgctggtgtttgattttgacaacaccatcattgatgacaacagcgacacctggatcgtgcagtgtgcccccaacaagaagctgcccatcgagctgcgggacagctacaggaagggcttctggacagagttcatgggccgggtcttcaagtacctgggggacaagggcgtgcgggagcacgagatgaagagagctgtgaccagcctgcccttcaccccaggcatggtggagctgttcaacttcatcaggaagaacaaggacaagtttgactgcatcatcatcagtgacagcaacagcgtcttcatcgactgggtgctggaggccgccagcttccatgacatctttgacaaggtgttcaccaacccagctgccttcaacagcaatggccacctgactgtggagaactaccacacccacagctgcaaccgctgccccaagaacctgtgcaagaaggtggtgctgattgaatttgtggacaagcagctgcagcagggcgtgaactacacccagatcgtgtacatcggagatggcggcaatgatgtgtgccctgtgaccttcctgaagaatgatgatgtggccatgcccaggaagggctacaccctgcagaagaccctgagcaggatgagccagaacctggagcccatggagtacagcgtggtggtgtggagcagtggagtggacatcatcagccacctgcagttcctgatcaaggactag

SEQ ID NO: 40662 - DNA, 411 bp, Artificial Sequence
  Description of Artificial Sequence: Synthetic coding sequence
atgaagatcctgctggtgtttgattttgacaacaccatcattgatgacaacagcgacacctggatcgtgcagtgtgcccccaacaagaagctgcccatcgagctgcgggacagctacaggaagggcttctggacagagttcatgggccgggtcttcaagtacctgggggacaagggcgtgcgggagcacgagatgaagagagctgtgaccagcctgcccttcaccccaggcatggtggagctgttcaacttcatcaggaagaacaaggacaagtttgactgcatcatcatcagtgacagcaacagcgtcttcatcgactgggtgctggaggccgccagcttccatgacatctttgacaaggtgttcaccaacccagctgccttcaacagcaatggccacctgactgtgtag

SEQ ID NO: 40663 - DNA, 171 bp, Artificial Sequence
  Description of Artificial Sequence: Synthetic coding sequence
atgaagatcctgctggtgtttgattttgacaacaccatcattgatgacaacagcgacacctggatcgtgcagtgtgcccccaacaagaagctgcccatcgagctgcgggacagctacaggaagggcttctggacagagttcatgggccgggtcttcaagtacctgggctag

SEQ ID NO: 40664 - DNA, 150 bp, Artificial Sequence
  Description of Artificial Sequence: Synthetic coding sequence
atgaagatcctgctggtgtttgattttgacaacaccatcattgatgacaacagcgacacctggatcgtgcagtgtgcccccaacaagaagctgcccatcgagctgcgggacagctacaggaagggcttctggacagagttcatgggctag

SEQ ID NO: 40665 - DNA, 936 bp, Artificial Sequence
  Description of Artificial Sequence: Synthetic coding sequence
atggtgcaggccatcaagtgggtggatgaggtggtgcctgctgccccctacgtgaccaccctggagaccctggacaagtacaactgtgacttctgtgtgcacggcaatgacatcaccctgactgtggatggccgggacacctatgaggaggtgaagcaggccggccgctaccgggagtgcaagaggacccagggcgtgtccaccacagacctggtgggccgcatgctgctggtgaccaaggcccaccacagcagccaggagatgagcagcgagtaccgggagtatgctgacagctttggaaaatgtcctgggggcaggaacccctggacaggagtgtcccagttcctgcagaccagccagaagatcatccagtttgccagcggcaaggagccccagcctggagagaccgtcatctacgtggccggggcctttgacctcttccacatcggccacgtggacttcctggagaaggtgcaccggctggccgagcggccctacatcatcgccggcctgcactttgaccaggaggtgaaccactacaagggcaagaactaccccatcatgaacctgcacgagaggaccctgtctgtgctggcctgccgctacgtgtctgaggtggtgattggagccccctatgctgtgacagctgagctgctgagccacttcaaggtggacctggtgtgccacggcaagacagagatcatcccagacagagatggcagtgacccctaccaggagcccaagagaagaggcatcttccggcagattgacagcggcagcaacctgaccacagacctgattgtgcagaggatcatcaccaaccggctggagtatgaggccaggaaccagaagaaggaggccaaggagctggccttcctggaggccgcccggcagcaggccgcccagcccctgggggagagagatggagacttctag

SEQ ID NO: 40666 - DNA, 1224 bp, Artificial Sequence
  Description of Artificial Sequence: Synthetic coding sequence
atgatcagaaatggccgcggggctgctggaggagctgagcagcccggccctgggggccggcgggctgtgcgggtgtggtgtgatggctgctatgacatggtgcactacggccacagcaaccagctgcggcaggcccgggccatgggagactacctgattgtgggcgtgcacacagatgaggagatcgccaagcacaagggcccccctgtgttcacccaggaggagcgctacaagatggtgcaggccatcaagtgggtggatgaggtggtgcctgctgccccctacgtgaccaccctggagaccctggacaagtacaactgtgacttctgtgtgcacggcaatgacatcaccctgactgtggatggccgggacacctatgaggaggtgaagcaggccggccgctaccgggagtgcaagaggacccagggcgtgtccaccacagacctggtgggccgcatgctgctggtgaccaaggcccaccacagcagccaggagatgagcagcgagtaccgggagtatgctgacagctttgggaagccaccccaccccatcccagctggggacatcctgagcagcgagggctgcagccagtgccctgggggcaggaacccctggacaggagtgtcccagttcctgcagaccagccagaagatcatccagtttgccagcggcaaggagccccagcctggagagaccgtcatctacgtggccggggcctttgacctcttccacatcggccacgtggacttcctggagaaggtgcaccggctggccgagcggccctacatcatcgccggcctgcactttgaccaggaggtgaaccactacaagggcaagaactaccccatcatgaacctgcacgagaggaccctgtctgtgctggcctgccgctacgtgtctgaggtggtgattggagccccctatgctgtgacagctgagctgctgagccacttcaaggtggacctggtgtgccacggcaagacagagatcatcccagacagagatggcagtgacccctaccaggagcccaagagaagaggcatcttccggcagattgacagcggcagcaacctgaccacagacctgattgtgcagaggatcatcaccaaccggctggagtatgaggccaggaaccagaagaaggaggccaaggagctggccttcctggaggccgcccggcagcaggccgcccagcccctgggggagagagatggagacttctag

SEQ ID NO: 40667 - DNA, 1170 bp, Artificial Sequence
  Description of Artificial Sequence: Synthetic coding sequence
atgatcagaaatggccgcggggctgctggaggagctgagcagcccggccctgggggccggcgggctgtgcgggtgtggtgtgatggctgctatgacatggtgcactacggccacagcaaccagctgcggcaggcccgggccatgggagactacctgattgtgggcgtgcacacagatgaggagatcgccaagcacaagggcccccctgtgttcacccaggaggagcgctacaagatggtgcaggccatcaagtgggtggatgaggtggtgcctgctgccccctacgtgaccaccctggagaccctggacaagtacaactgtgacttctgtgtgcacggcaatgacatcaccctgactgtggatggccgggacacctatgaggaggtgaagcaggccggccgctaccgggagtgcaagaggacccagggcgtgtccaccacagacctggtgggccgcatgctgctggtgaccaaggcccaccacagcagccaggagatgagcagcgagtaccgggagtatgctgacagctttggaaaatgtcctgggggcaggaacccctggacaggagtgtcccagttcctgcagaccagccagaagatcatccagtttgccagcggcaaggagccccagcctggagagaccgtcatctacgtggccggggcctttgacctcttccacatcggccacgtggacttcctggagaaggtgcaccggctggccgagcggccctacatcatcgccggcctgcactttgaccaggaggtgaaccactacaagggcaagaactaccccatcatgaacctgcacgagaggaccctgtctgtgctggcctgccgctacgtgtctgaggtggtgattggagccccctatgctgtgacagctgagctgctgagccacttcaaggtggacctggtgtgccacggcaagacagagatcatcccagacagagatggcagtgacccctaccaggagcccaagagaagaggcatcttccggcagattgacagcggcagcaacctgaccacagacctgattgtgcagaggatcatcaccaaccggctggagtatgaggccaggaaccagaagaaggaggccaaggagctggccttcctggaggccgcccggcagcaggccgcccagcccctgggggagagagatggagacttctag

SEQ ID NO: 40668 - DNA, 1515 bp, Artificial Sequence
  Description of Artificial Sequence: Synthetic coding sequence
atgtctgagaagcagatgaaggaggcctttgtgagcaacctgaatggcaccaccgtgctggagatcacccagggcctgtgcttccctgccttctgcatcctgtgccggggcttcctgatcatcttcagccagtacctgtgcagcttcagccccacctggaagacccgcttcctgacagactttgtggtgctgattgtgcccatggtggccaccctgaccatctgggccagcttcatcctgctggagctgctgggcgtcatcatctttggagctggcctgctgtaccagatctacagaagaaggacctgctacgcccggctgcccttcctgaagatcctggagaagttcctgaacatcagcctggagagcgagtacaacccagccatcagctgcttccgggtcatcaccagcgccttcaccgccatcgccatcctggccgtggacttccccctcttccccaggagatttgccaagacagagctgtatggcaccggggccatggactttggagtgggcggctttgtgtttggcagcgccatggtgtgcctggaggtgagaagaaggaagtacatggagggcagcaagctgcactacttcaccaacagcctgtacagcgtgtggcccctggtgttcctgggcatcggccgcctggccatcatcaagagcatcggctaccaggagcacctgacagaatatggagtgcactggaacttcttcttcaccatcatcgtggtgaagctgatcacccccctgctgctgatcatcttccccctgaacaagtcctggatcatcgccctgggcatcaccgtgctgtaccagctggccctggacttcaccagcctgaagaggctcatcctgtatggaacagatggcagcggcaccagggtgggcctgctgaatgccaaccgggagggcatcatcagcaccctgggctacgtggccatccacatggccggcgtgcagacaggcctgtacatgcacaagaacagaagccacatcaaggacctgatcaaggtggcctgcttcctgctgctggccgccatcagcctcttcatcagcctgtatgtggtgcaggtgaatgtggaggccgtgtccaggaggatggccaacctggccttctgcatctggatcgtggccagcagcctcatcctgctgagcagcctgctgctgggggacatcatcctgagctttgccaagttcctgatcaagggggccctggtgccctgctcctggaagctgatccagagccctgtgaccaacaagaagcacagcgagagcctggtgcctgaggccgagaggatggagcccagcctgtgcctgatcacagccctgaacaggaagcagctgatcttcttcctgctgagcaacatcaccaccggcctcatcaacctgatggtggacaccctgcacagcagcaccctgtgggccctgtttgtggtgaacctgtacatgttcagcaactgcctgattgtgtatgtgctgtacctgcaggacaagacagtgcagttctggtag

SEQ ID NO: 40669 - DNA, 807 bp, Artificial Sequence
  Description of Artificial Sequence: Synthetic coding sequence
atgctgctgaaggagtaccgcatctgcatgcccctgactgtggatgagtacaagattggccagctgtacatgatcagcaagcacagccatgagcagagcgacagaggagagggcgtggaggtggtgcagaatgagccctttgaggacccccaccacggcaatggccagttcacagagaagagggtgtacctgaacagcaagctgcccagctgggcccgggctgtggtgcccaagatcttctacgtgacagagaaggcctggaactactacccctacaccatcacagagtacacctgcagcttcctgcccaagttcagcatccacatcgagaccaagtatgaggacaacaagggcagcaatgacaccatctttgacaatgaggccaaggatgtggagcgggaggtgtgcttcatcgacatcgcctgtgatgagatccctgagcgctactacaaggagagcgaggaccccaagcacttcaagtctgagaagacaggccggggccagctgcgggagggctggagggacagccaccagcccatcatgtgcagctacaagctggtgacagtgaagtttgaggtgtggggcctgcagaccagggtggagcagtttgtgcacaaggtggtgcgggacatcctgctgattggccaccggcaggcctttgcctgggtggatgagtggtatgacatgaccatggatgatgtgcgggagtatgagaagaacatgcatgagcagaccaacatcaaggtgtgcaaccagcacagcagccctgtggatgacatcgagagccacgcccagaccagcacctag

SEQ ID NO: 40670 - DNA, 807 bp, Artificial Sequence
  Description of Artificial Sequence: Synthetic coding sequence
atgctgctgaaggagtaccgcatctgcatgcccctgactgtggatgagtacaagattggccagctgtacatgatcagcaagcacagccatgagcagagcgacagaggagagggcgtggaggtggtgcagaatgagccctttgaggacccccaccacggcaatggccagttcacagagaagagggtgtacctgaacagcaagctgcccagctgggcccgggctgtggtgcccaagatcttctacgtgacagagaaggcctggaactactacccctacaccatcacagagtacaagtgcagcttcctgcccaagttcagcatccacatcgagaccaagtatgaggacaacaagggcagcaatgacaccatctttgacaatgaggccaaggatgtggagcgggaggtgtgcttcatcgacatcgcctgtgatgagatccctgagcgctactacaaggagagcgaggaccccaagcacttcaagtctgagaagacaggccggggccagctgcgggagggctggagggacagccaccagcccatcatgtgcagctacaagctggtgacagtgaagtttgaggtgtggggcctgcagaccagggtggagcagtttgtgcacaaggtggtgcgggacatcctgctgattggccaccggcaggcctttgcctgggtggatgagtggtatgacatgaccatggatgatgtgcgggagtatgagaagaacatgcatgagcagaccaacatcaaggtgtgcaaccagcacagcagccctgtggatgacatcgagagccacgcccagaccagcacctag

SEQ ID NO: 40671 - DNA, 999 bp, Artificial Sequence
  Description of Artificial Sequence: Synthetic coding sequence
atgctgctgaaggagtaccgcatctgcatgcccctgactgtggatgagtacaagattggccagctgtacatgatcagcaagcacagccatgagcagagcgacagaggagagggcgtggaggtggtgcagaatgagccctttgaggacccccaccacggcaatggccagttcacagagaagagggtgtacctgaacagcaagctgcccagctgggcccgggctgtggtgcccaagatcttctacgtgacagagaaggcctggaactactacccctacaccatcacagagtacaagtgcagcttcctgcccaagttcagcatccacatcgagaccaagtatgaggacaacaagggcagcaatgacaccatctttgacaatgaggccaaggatgtggagcgggaggtgtgcttcatcgacatcgcctgtgatgagatccctgagcgctactacaaggagagcgaggaccccaagcacttcaagtctgagaagacaggccggggccagctgcgggagggctggagggacagccaccagcccatcatgtgcagctacaagctggtgacagtgaagtttgaggtgtggggcctgcagaccagggtggagcagtttgtgcacaaggtggtgcgggacatcctgctgattggccaccggcaggcctttgcctgggtggatgagtggtatgacatgaccatggatgaggtgcgggagtttgagcgggccacccaggaggccaccaacaagaagattggcatcttccccccagccatcagcatcagcagcatccccctgctgcccagctctgtgcgcagcgcccccagcagcgcccccagcacccccctgagcacagatgcccctgagttcctgtctgtgcccaaggaccggcccaggaagaagagcgcccctgagaccctgaccctgcctgaccctgagaagaaggccaccctgaacctgcccggcatgcacagcagtgacaagccctgccggcccaagtctgagtag

SEQ ID NO: 40672 - DNA, 801 bp, Artificial Sequence
  Description of Artificial Sequence: Synthetic coding sequence
atgcacaacatcctgaagaagtaccaccagtacatcgtggagtgccacggcatcaccctgctgccccagttcctgggcatgtaccgcctgaatgtggatggagtggagatctacgtgattgtgaccagaaatgtgttcagccaccggctgtctgtgtacagaaaatatgacctgaagatggccaacctgaaggccaccttcaccttccccaagcccaccggcagcacagtggcccgggaggccagtgacaaggagaaggccaaggagctgcccaccctgaaggacaatgacttcatcaatgaaggccagaagatctacattgatgacaacaacaagaaggtgttcctggagaagctgaagaaggatgtggagttcctggcccagctgaagctgatggactacagcctgctggtgggcatccatgatgtggagcgggcagagcaggaggaggtggagtgtgaagaaaatgatggagaggaggagggggagagtgatggcacccaccctgtgggcaccccaccagacagccctggcaacaccctgaacagcagcccccccctggcccctggagaatttgaccccaacattgatgtgtatggcatcaagtgccacgagaacagccccaggaaggaggtgtacttcatggccatcatcgacatcctgacccactatgatgccaagaagaaggccgcccatgctgccaagacagtgaagcatggagctggagctgagatcagcacagtgaaccctgagcagtacagcaagcgcttcctggacttcatcggccacatcctgacctag

SEQ ID NO: 40673 - DNA, 669 bp, Artificial Sequence
  Description of Artificial Sequence: Synthetic coding sequence
atgtggggcgtgaaccacagcatcaatgagctgagccacgtgcagatccctgtgatgctgatgccagatgacttcaaggcctacagcaagatcaaggtggacaaccacctgttcaacaaggagaacatgcccagccacttcaagttcaaggagtactgccccatggtgttcaggaacctgcgggagcgcttcggcattgatgaccaggacttccagaacagcctgaccaggtctgcccccctgcccaatgacagccaggcccggagcggggcccgcttccacaccagctatgacaagcgctacatcatcaagaccatcaccagtgaagatgtggccgagatgcacaacatcctgaagaagtaccaccagtacatcgtggagtgccacggcatcaccctgctgccccagttcctgggcatgtaccgcctgaatgtggatggagtggagatctacgtgattgtgaccagaaatgtgttcagccaccggctgtctgtgtacagaaaatatgacctgaagggcagcacagtggcccgggaggccagtgacaaggagaagagccccaccccagccatcgtggtgctgcctgtgccccacagcgctgccaccagcgagaagcactgcatcgaccccatgagggtgctgctgcacttcagcagcagcaactgctag

SEQ ID NO: 40674 - DNA, 1221 bp, Artificial Sequence
  Description of Artificial Sequence: Synthetic coding sequence
atggccaccccaggcaacctgggcagctctgtgctggccagcaagaccaagaccaagaagaagcactttgtggcccagaaggtgaagctgttccgggccagtgaccccctgctgtctgtgctgatgtggggcgtgaaccacagcatcaatgagctgagccacgtgcagatccctgtgatgctgatgccagatgacttcaaggcctacagcaagatcaaggtggacaaccacctgttcaacaaggagaacatgcccagccacttcaagttcaaggagtactgccccatggtgttcaggaacctgcgggagagatttggaattgatgaccaggacttccagaacagcctgaccaggtctgcccccctgcccaatgacagccaggcccggagcggggcccgcttccacaccagctatgacaagcgctacatcatcaagaccatcaccagtgaagatgtggccgagatgcacaacatcctgaagaagtaccaccagtacatcgtggagtgccacggcatcaccctgctgccccagttcctgggcatgtaccgcctgaatgtggatggagtggagatctacgtgattgtgaccagaaatgtgttcagccaccggctgtctgtgtacagaaaatatgacctgaagggcagcacagtggcccgggaggccagtgacaaggagaaggccaaggagctgcccaccctgaaggacaatgacttcatcaatgaaggccagaagatctacattgatgacaacaacaagaaggtgttcctggagaagctgaagaaggatgtggagttcctggcccagctgaagctgatggactacagcctgctggtgggcatccatgatgtggagcgggcagagcaggaggaggtggagtgtgaagaaaatgatggagaggaggagggggagagtgatggcacccaccctgtgggcaccccaccagacagccctggcaacaccctgaacagcagcccccccctggcccctggagaatttgaccccaacattgatgtgtatggcatcaagtgccacgagaacagccccaggaaggaggtgtacttcatggccatcatcgacatcctgacccactatgatgccaagaagaaggccgcccatgctgccaagacagtgaagcatggagctggagctgagatcagcacagtgaaccctgagcagtacagcaagcgcttcctggacttcatcggccacatcctgacctag

SEQ ID NO: 40675 - DNA, 648 bp, Artificial Sequence
  Description of Artificial Sequence: Synthetic coding sequence
atcaatgagctgagccacgtgcagatccctgtgatgctgatgccagatgacttcaaggcctacagcaagatcaaggtggacaaccacctgttcaacaaggagaacatgcccagccacttcaagttcaaggagtactgccccatggtgttcaggaacctgcgggagagatttggaattgatgaccaggacttccagaacagcctgaccaggtctgcccccctgcccaatgacagccaggcccggagcggggcccgcttccacaccagctatgacaagcgctacatcatcaagaccatcaccagtgaagatgtggccgagatgcacaacatcctgaagaagtaccaccagtacatcgtggagtgccacggcatcaccctgctgccccagttcctgggcatgtaccgcctgaatgtggatggagtggagatctacgtgattgtgaccagaaatgtgttcagccaccggctgtctgtgtacagaaaatatgacctgaagggcagcacagtggcccgggaggccagtgacaaggagaagagccccaccccagccatcgtggtgctgcctgtgccccacagcgctgccaccagcgagaagcactgcatcgaccccatgagggtgctgctgcacttcagcagcagcaactgctag

SEQ ID NO: 40676 - DNA, 228 bp, Artificial Sequence
  Description of Artificial Sequence: Synthetic coding sequence
atcaatgagctgagccacgtgcagatccctgtgatgctgatgccagatgacttcaaggcctacagcaagatcaaggtggacaaccacctgttcaacaaggagaacatgcccagccacttcaagttcaaggagtactgccccatggtgttcaggaacctgcgggagagatttggaattgatgaccaggacttccaggtgtcctgtgtgtgcaacatctgcttccagtag

SEQ ID NO: 40677 - DNA, 1044 bp, Artificial Sequence
  Description of Artificial Sequence: Synthetic coding sequence
atgctgatgccagatgacttcaaggcctacagcaagatcaaggtggacaaccacctgttcaacaaggagaacatgcccagccacttcaagttcaaggagtactgccccatggtgttcaggaacctgcgggagcgcttcggcattgatgaccaggacttccagaacagcctgaccaggtctgcccccctgcccaatgacagccaggcccggagcggggcccgcttccacaccagctatgacaagcgctacatcatcaagaccatcaccagtgaagatgtggccgagatgcacaacatcctgaagaagtaccaccagtacatcgtggagtgccacggcatcaccctgctgccccagttcctgggcatgtaccgcctgaatgtggatggagtggagatctacgtgattgtgaccagaaatgtgttcagccaccggctgtctgtgtacagaaaatatgacctgaagggcagcacagtggcccgggaggccagtgacaaggagaaggccaaggagctgcccaccctgaaggacaatgacttcatcaatgaaggccagaagatctacattgatgacaacaacaagaaggtgttcctggagaagctgaagaaggatgtggagttcctggcccagctgaagctgatggactacagcctgctggtgggcatccatgatgtggagagagctgagcaggaggaggtggagtgtgaggagaatgatggagaggaggagggggagagtgatggcacccaccctgtgggcaccccaccagacagccctggcaacaccctgaacagcagcccccccctggcccctggagaatttgaccccaacattgatgtgtatggcatcaagtgccacgagaacagccccaggaaggaggtgtacttcatggccatcatcgacatcctgacccactatgatgccaagaagaaggccgcccacgccgccaagacagtgaagcacggggccggggctgagatcagcacagtgaaccctgagcagtacagcaagcgcttcctggacttcatcggccacatcctgacctag

SEQ ID NO: 40678 - DNA, 972 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctgcatcaccaggcctgtggtgctgaagtggagcgtgacccaggccctggatgtgacagagcagctggatgctggggtgcgctacctggacctgagaattgcccacatgctggagggcagcgagaagaacctgcactttgtgcacatggtgtacaccacagccctggtggaggacaccctgacagagatcagcgagtggctggagcggcacccccgggaggtggtgatcctggcctgcaggaactttgagggcctgtctgaggacctgcacgagtacctggtggcctgcatcaagaacatctttggagacatgctgtgccccagaggagaggtgcccaccctgcggcagctgtggagccggggccagcaggtgattgtgtcctatgaagatgagagcagcctgcggcggcaccacgagctgtggccaggagtgccctactggtggggcaacagagtgaagacagaggccctgatccgctacctggagaccatgaagagctgtggccggcctgggggcctgtttgtggccggcatcaacctgacagagaacctgcagtatgtgctggcccaccccagcgagagcctggagaagatgaccctgcccaacctgccccggctgagcgcctgggtgcgggagcagtgccccggccctggcagccgctgcaccaacatcatcgccggggacttcatcggggctgatggctttgtgtctgatgtgattgccctgaaccagaagctgctgtggtgctag

SEQ ID NO: 40679 - DNA, 972 bp, Artificial Sequence; identical to SEQ ID NO: 40678
  Description of Artificial Sequence: Synthetic coding sequence

SEQ ID NO: 40680 - DNA, 972 bp, Artificial Sequence; identical to SEQ ID NO: 40678
  Description of Artificial Sequence: Synthetic coding sequence

SEQ ID NO: 40681 - DNA, 537 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctgcatcaccaggcctgtggtgctgaagtggagcgtgacccaggccctggatgtgacagagcagctggatgctggggtgcgctacctggacctgagaattgcccacatgctggagggcagcgagaagaacctgcactttgtgcacatggtgtacaccacagccctggtggaggacaccctgacagagatcagcgagtggctggagcggcacccccgggaggtggtgatcctggcctgcaggaactttgagggcctgtctgaggacctgcacgagtacctggtggcctgcatcaagaacatctttggagacatgtag

SEQ ID NO: 40682 - DNA, 183 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccactag

SEQ ID NO: 40683 - DNA, 525 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctgcatcaccaggcctgtggtgctgaagtggagcgtgacccaggccctggatgtgacagagcagctggatgctggggtgcgctacctggacctgagaattgcccacatgctggagggcagcgagaagaacctgcactttgtgcacatggtgtacaccacagccctggtggaggacaccctgacagagatcagcgagtggctggagcggcacccccgggaggtggtgatcctggcctgcaggaactttgagggcctgtctgaggacctgcacgagtacctggtggcctgcatcaagaacatctag

SEQ ID NO: 40684 - DNA, 225 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctag

SEQ ID NO: 40685 - DNA, 267 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctgcatcaccaggcctgtggtgctgaagtggagcgtgacccagtag

SEQ ID NO: 40686 - DNA, 525 bp, Artificial Sequence; identical to SEQ ID NO: 40683
  Description of Artificial Sequence: Synthetic coding sequence

SEQ ID NO: 40687 - DNA, 375 bp, Artificial Sequence
  Description of Artificial Sequence: Synthetic coding sequence
atgggcggccaggtgtctgccagcaacagcttcagccggctgcactgcagaaatgccaatgaagactggatgtctgccctgtgcccccggctgtgggatgtgcccctgcaccacctgagcatccctggcagccatgacaccatgacctactgcctgaacaagaagagccccatcagccatgaggagagccggctgctgcagctgctgaacaaggccctgccctgcatcaccaggcctgtggtgctgaagtggagcgtgacccaggccctggatgtgacagagcagctggatgctggggtgcgctacctggacctgagaattgcccacatgctggagggcagcgagaagaacctgcactttgtgcacatggtgtag

SEQ ID NO: 40688 - DNA, 915 bp, Artificial Sequence
  Description of Artificial Sequence: Synthetic coding sequence
atgctggccgtgaggaaggcccggaggaagctgaggatgggcaccatctgcagccccaaccccagcggcaccaagaccagcagcgaggtgtgcaatgctgactggatggccagcctgcccccccacctgcacaacctgcccctgagcaacctggccatccctggcagccatgacagcttctcctactgggtggatgagaagagccctgtgggccctgaccagacccaggccatcaagaggctggcccgcatcagcctggtgaagaagctgatgaagaagtggagcgtgacccagaacctgaccttccgggagcagctggaggccggcatccgctactttgacctgcgggtgagcagcaagccaggagatgctgaccaggagatctacttcatccacggcctgtttggcatcaaggtgtgggatggcctgatggagattgacagcttcctgacccagcacccccaggagatcatcttcctggacttcaaccacttctacgccatggatgagacccaccacaagtgcctggtgctgcgcatccaggaggccttcggcaacaagctgtgcccagcctgcagcgtggagagcctgaccctgcggaccctgtgggagaagaactgccaggtgctgatcttctaccactgccccttctacaagcagtaccccttcctgtggccaggcaagaagatcccagccccctgggccaacaccacctctgtgaggaagctgatcctcttcctggagaccaccctgtctgagcgggccagccggggcagcttccacgtgtcccaggccatcctgaccccccgggtgaagaccatcgcccggggcctggtgggcggcctgaagaacaccctggtgcaccggctggccctgatccctgtgtaccccctgcgcttcagccgccgctcctag

SEQ ID NO: 40689 - DNA, 918 bp, Artificial Sequence
  Description of Artificial Sequence: Synthetic coding sequence
atgctggccgtgaggaaggcccggaggaagctgaggatgggcaccatctgcagccccaaccccagcggcaccaagaccagcagcgaggtgtgcaatgctgactggatggccagcctgcccccccacctgcacaacctgcccctgagcaacctggccatccctggcagccatgacagcttctcctactgggtggatgagaagagccctgtgggccctgaccagacccaggccatcaagaggctggcccgcatcagcctggtgaagaagctgatgaagaagtggagcgtgacccagaacctgaccttccgggagcagctggaggccggcatccgctactttgacctgcgggtgagcagcaagccaggagatgctgaccaggagatctacttcatccacggcctgtttggcatcaaggtgtgggatggcctgatggagattgacagcttcctgacccagcacccccaggagatcatcttcctggacttcaaccacttctacgccatggatgagacccaccacaagtgcctggtgctgcgcatccaggaggccttcggcaacaagctgtgcccagcctgcagcgtggagagcctgaccctgcggaccctgtgggagaagaactgccaggtgctgatcttctaccactgccccttctacaagcagtaccccttcctgtggccaggcaagaagatcccagccccctgggccaacaccacctctgtgaggaagctgatcctcttcctggagaccaccctgtctgagcgggccagccggggcagcttccacgtgtcccaggccatcctgaccccccgggtgaagaccatcgcccggggcctggtgggcggcctgaagaacaccctggtgcacagcaaccgctggaacagccacggccccagcctgctgagccaggagaggagctag

SEQ ID NO: 40690 - DNA, 966 bp, Artificial Sequence
  Description of Artificial Sequence: Synthetic coding sequence
atggccagcagccagggcaagaatgagctgaagctggccgactggatggccaccctgcctgagagcatgcacagcatccccctgaccaacctggccatccctggcagccatgacagcttctccttctacattgatgaggccagccctgtgggccctgagcagcctgagaccgtgcagaactttgtgtctgtgtttggaacagtggccaagaagctgatgaggaagtggctggccacccagaccatgaacttcaccggccagctgggcgccggcatccgctactttgacctgcgcatcagcaccaagccccgggaccctgacaatgagctgtactttgcccacggcctcttcagcgccaaggtgaatgaaggcctggaggagatcaatgccttcctgacagaccaccacaaggaggtggtgttcctggacttcaaccacttctacggcatgcagaagtaccaccacgagaagctggtgcagatgctgaaggacatctacggcaacaagatgtgcccagccatctttgcccaggaggtgtccctgaagtacctgtgggagaaggactaccaggtgctggtgttctaccacagccctgtggccctggaggtgcccttcctgtggccaggccagatgatgcctgccccctgggccaacaccacagatcctgagaagctgatccagttcctgcaggccagcatcacagagaggaggaagaagggcagcttcttcatcagccaggtggtgctgacccccaaggccagcacagtggtgaagggcgtggccagcggcctgcgggagaccatcacagagcgggccctgcctgccatgatgcagtgggtgaggacccagaagccaggagagagcggcatcaacatcgtgacagctgactttgtggagctgggggacttcatcagcaccgtcatcaagctgaactacgtgtttgatgaaggagaggccaacacctag

SEQ ID NO: 40691 - DNA, 966 bp, Artificial Sequence; identical to SEQ ID NO: 40690
  Description of Artificial Sequence: Synthetic coding sequence

SEQ ID NO: 40692 - DNA, 351 bp, Artificial Sequence
  Description of Artificial Sequence: Synthetic coding sequence
atgggccccaaggaccacatggtgaccagcagcttctgctgccagagtgatggctgcaacagcgccttcctgtctgtgcccctgaccaacctgacagaaaatggcctgatgtgcccagcctgcacagccagcttccgggacaagtgcatgggccccatgacccactgcaccgggaaggagaaccactgtgtgtccctgagcggccacgtgcaggccggcatcttcaagcccaggtttgccatgaggggctgtgccacagagagcatgtgcttcaccaagccaggagctgaggtgcccaccggcaccaacgtgctcttcctgcaccacattgaatgtacccacagcccctag

SEQ ID NO: 40693 - DNA, 615 bp, Artificial Sequence
  Description of Artificial Sequence: Synthetic coding sequence
atgaggctgagcagaagacctgagaccttcctgctggcctttgtgctgctgtgcaccctgctgggcctgggctgccccctgcactgtgagatctgcacagctgctggcagccgctgccacggccagatgaagacctgcagcagtgacaaggacacctgtgtgctgctggtgggcaaggccaccagcaagggcaaggagctggtgcacacctacaagggctgcatccgcagccaggactgctacagcggggtcatcagcaccaccatgggccccaaggaccacatggtgaccagcagcttctgctgccagagtgatggctgcaacagcgccttcctgtctgtgcccctgaccaacctgacagaaaatggcctgatgtgcccagcctgcacagccagcttccgggacaagtgcatgggccccatgacccactgcaccgggaaggagaaccactgtgtgtccctgagcggccacgtgcaggccggcatcttcaagcccaggtttgccatgaggggctgtgccacagagagcatgtgcttcaccaagccaggagctgaggtgcccaccggcaccaacgtgctcttcctgcaccacattgaatgtacccacagcccctag

SEQ ID NO: 40694 - DNA, 2520 bp, Artificial Sequence
  Description of Artificial Sequence: Synthetic coding sequence
atgagggccaagtgcatcacagagcctgtgggcatcgagctggccccctgcctgcaggcccccagcgtgcctgagacagacctgaagggcgtggtgcaggcccggggcggcggggcctctgtgctggagaagccccgggagggcttcaagagagctgagcaggtgcctgtgtcccagacagactgctttgtgtccctgtggctgcccacagccagccagaagaagctgcggaccaggaccatcagcaactgccccaaccctgagtggaatgaaagcttcaacttccagatccagagccgggtgaagaatgtgctggagctgtctgtgtgtgatgaggacacagtgaccccagatgaccacctgctgactgtgctgtatgacctgaccaagctgtgcttcaggaagaagacccacgtgaagttccccctgaacccccagggcatggaggagctggaggtggagttcctgctggaggagagccccagccccccagagaccctggtgaccaacggggtgctggtgtcccggcaggtgtcctgcctggaggtgcacgcccagagcagaagaagaaggaagcgggagaagatgaaggacctgctggtgatggtgaatgaaagctttgagaacacccagagggtgcggccctgcctggagccctgctgccccaccagcgcctgcttccagacagctgcctgcttccactaccccaagtacttccagagccaggtgcacgtggaggtgcccaagagccactggagctgtggcctgtgctgccgcagcaggaagaagggccccatcagccagcccctggactgcctgagtgatggccaggtgatgaccctgcctgtgggggagagctatgagctgcacatgaagagcaccccctgcccagagaccctggatgtgcggctgggcttcagcctgtgcccagctgagctggagttcctgcagaagaggaaggtggtggtggccaaggccctgaagcaggtgctgcagctggaggaggacctgcaggaggatgaggtgcccctgattgccatcatggccaccggcggcggcaccaggtccatgacctccatgtatggccacctgctgggcctgcagaagctgaacctgctggactgtgccagctacatcaccggcctgagcggggccacctggaccatggccaccctgtacagagatcctgactggagcagcaagaacctggagcccgccatctttgaggccaggagacatgtggtgaaggacaagctgcccagcctcttcccagaccagctgaggaagttccaggaggagctgcggcagaggagccaggagggctacagagtgaccttcacagacttctggggcctgctgattgagacctgcctgggagatgaaagaaatgaatgcaagctgagtgaccagagagctgccctgagctgtggccagaaccccctgcccatctacctgaccatcaacgtgaaggatgatgtgagcaaccaggacttccgggagtggtttgagttcagcccctatgaggtgggcctgcagaagtacggggccttcatccccagcgagctgtttggaagtgagttcttcatgggccgcctggtgaagagaattcctgagagccgcatctgctacatgctgggcctgtggagcagcatcttcagcctgaacctgctggatgcctggaacctgagccacaccagcgaggagttcttccaccgctggacccgggagaaggtgcaggacattgaagatgagcccatcctgcctgagatccccaagtgtgatgccaacatcctggagaccaccgtggtgattcctggctcctggctgagcaacagcttccgggagatcctgacccacaggagctttgtgtctgagttccacaacttcctgagcggcctgcagctgcacaccaactacctgcagaatggccagttcagccgctggaaggacacagtgctggatggcttccccaaccagctgacagaaagtgccaaccacctgtgcctgctggacacagccttctttgtgaacagcagctacccacccctgctgcggcctgagaggaaggctgacctgatcatccacctgaactactgtgccggcagccagaccaagcccctgaagcagacctgtgagtactgcaccgtgcagaacatccccttccccaagtatgagctgcctgatgaaaatgaaaacctgaaggagtgctacctgatggagaacccccaggagccagatgcccccatcgtgaccttcttccccctcatcaatgacaccttcaggaagtacaaggcccctggggtggagaggagccctgaggagctggagcagggccaggtggacatctacggccccaagaccccctatgccaccaaggagctgacctacacagaggccacctttgacaagctggtgaagctgtctgagtacaacatcctgaacaacaaggacaccctgctgcaggccctgcggctggccgtggagaagaagaagaggctgaagggccagtgccccagctag

SEQ ID NO: 40695 - DNA, 2388 bp, Artificial Sequence
  Description of Artificial Sequence: Synthetic coding sequence
atgaccagcggggccacccgctaccgcctgagctgcagcctgcggggccacgagctggatgtgcggggcctggtgtgctgtgcctacccacctggggcctttgtgtctgtgtcccgggacaggaccacccggctgtgggccccagacagccccaacagaagcttcacagagatgcactgcatgagcggccacagcaactttgtgtcctgtgtgtgcatcatccccagcagtgacatctacccccacggcctgattgccactggaggaaatgaccacaacatctgcatcttcagcctggacagccccatgcccctgtacatcctgaagggccacaagaacacagtgtgcagcctgagcagcggcaagtttggcaccctgctgagcggctcctgggacaccacagccaaggtgtggctgaatgacaagtgcatgatgaccctgcagggccacacagctgctgtgtgggccgtgaagatcctgcctgagcagggcctgatgctgaccggcagcgctgacaagacagtgaagctgtggaaggccggccgctgtgagaggaccttcagcggccacgaggactgtgtgcggggcctggccatcctgtctgaaacagagttcctgagctgtgccaatgatgccagcatccgccgctggcagatcaccggggagtgcctggaggtgtactacggccacaccaactacatctacagcatcagcgtcttccccaactgccgggactttgtgaccacagcagaagatagaagcctgcgcatctggaagcacggggagtgtgcccagaccatccggctgcctgcccagagcatctggtgctgctgcgtgctggacaacggggacatcgtggtgggcgccagtgatggcatcatccgggtcttcacagaaagtgaggacagaacagccagcgctgaggagatcaaggcctttgagaaggagctgagccacgccaccatcgacagcaagacaggagacctgggggacatcaatgctgagcagctgcccggccgggagcacctgaatgagcccggcacccgggagggccagaccaggctcatcagagatggagagaaggtggaggcctaccagtggagcgtgtctgagggccgctggatcaagattggagatgtggtgggcagcagcggggccaaccagcagaccagcggcaaggtgctgtatgagggcaaggagtttgattatgtgttcagcattgatgtgaatgaaggaggccccagctacaagctgccctacaacaccagtgatgacccctggctgacagcctacaacttcctgcagaagaatgacctgaaccccatgttcctggaccaggtggccaagttcatcatcgacaacaccaagggccagatgctgggcctgggcaaccccagcttcagtgaccccttcaccggcggcggccgctacgtgcccggcagcagcggcagcagcaacaccctgcccacagctgaccccttcaccggggccggccgctacgtgcccggcagcgcctccatgggcaccaccatggccggcgtggaccccttcaccggcaacagcgcctacagatctgctgccagcaagaccatgaacatctacttccccaagaaggaggccgtgacctttgaccaggccaaccccacccagatcctgggcaagctgaaggagctgaatggaacagcccctgaggagaagaagctgacagaagatgacctgatcctgctggagaagatcctgagcctcatctgcaacagcagcagcgagaagcccaccgtgcagcagctgcagatcctgtggaaggccatcaactgcccagaagatattgtgtttcctgccctggacatcctgcggctgagcatcaagcaccccagcgtgaatgaaaacttctgcaatgagaaggagggcgcccagttcagcagccacctgatcaacctgctgaaccccaagggcaagccagccaaccagctgctggccctgcggaccttctgcaactgctttgtgggccaggccggccagaagctgatgatgagccagcgggagagcctgatgagccacgccatcgagctgaagagcggcagcaacaagaacatccacatcgccctggccaccctggccctgaactacagcgtgtgcttccacaaggaccacaacatcgagggcaaggcccagtgcctgagcctcatcagcaccatcctggaggtggtgcaggacctggaggccaccttccggctgctggtggccctgggcaccctcatcagtgatgacagcaatgctgtgcagctggccaagagcctgggcgtggacagccagatcaagaagtacagctctgtgtctgagcccgccaaggtgtctgagtgctgccgcttcatcctgaacctgctgtag

SEQ ID NO: 40696 - DNA, 2367 bp, Artificial Sequence
  Description of Artificial Sequence: Synthetic coding sequence
atgctgtgtggccgctggaggcgctgccggcggcccccagaggagccccctgtggccgcccaggtggccgcccaggtggccgcccctgtggccctgcccagcccccccacccccagtgatggcggcaccaagaggcctggcctgcgggccctgaagaagatgggcctgacagaagatgaagatgtgcgggccatgctgcggggcagccggctgaggaagatccgcagcaggacctggcacaaggagcggctgtaccgcctgcaggaggatggcctgtctgtgtggttccagaggcgcatcccccgggcccccagccagcacatcttctttgtgcagcacatcgaggccgtgcgggagggccaccagagcgagggcctgcggagatttggaggagcctttgccccagcccgctgcctgaccatcgccttcaagggccgcaggaagaacctggacctggccgcccccacagctgaggaggcccagcgctgggtgcggggcctgaccaagctgcgggcccggctggatgccatgagccagcgggagcggctggacccctggatccacagctacctgcacagagctgacagcaaccaggacagcaagatgtccttcaaggagatcaagagcctgctgaggatggtgaatgtggacatgaatgacatgtatgcctacctgctcttcaaggaatgtgaccacagcaacaatgaccggctggagggcgctgagattgaggagttcctgcggcggctgctgaagaggcctgagctggaggagatcttccaccagtacagcggggaggacagagtgctgagcgcccctgagctgctggagttcctggaggaccagggcgaggagggcgccaccctggcccgggcccagcagctgatccagacctatgagctgaatgaaacagccaagcagcacgagctgatgaccctggatggcttcatgatgtacctgctgagccctgagggcgccgccctggacaacacccacacctgtgtgttccaggacatgaaccagcccctggcccactacttcatcagcagcagccacaacacctacctgacagacagccagattggaggccccagcagcacagaggcctatgaccgggcctttgcccagggctgccgctgtgtggagctggactgctgggagggccctggaggagagcctgtgatctaccacggccacaccctgaccagcaagatcctcttcagagatgtggtgcaggccgtgcgggaccacgccttcaccctgagcccctaccctgtgatcctgagcctggagaaccactgcggcctggagcagcaggccgccatggcccggcacctgtgcaccatcctgggggacatgctggtgacccaggccctggacagccccaaccctgaggagctgcccagccctgagcagctgaagggccgggtgctggtgaagggcaagaagctgcctgctgcccggagtgaagatggccgggccctgagtgaccgggaggaggaggaggaggatgatgaggaggaggaggaggaggtggaggccgccgcccagaggcggctggccaagcagatcagccctgagctgagcgccctggccgtgtactgccacgccacccggctgcggctgcacccagccccaaatgccccccagccctgccaggtgagcagcctgtctgagaggaaggccaagaagctgatccgggaggccggcaacagctttgtgcgccacaatgcccggcagctgaccagggtgtaccccctgggcctgaggatgaacagcgccaactacagcccccaggagatgtggaacagcggctgccagctggtggccctgaacttccagaccccaggctatgagatggacctgaatgccggccgcttcctggtgaatggccagtgtggctacgtgctgaagccagcctgcctgcggcagcctgacagcacctttgatcctgagtacccaggcccccccaggaccaccctgagcatccaggtgctgacagcccagcagctgcccaagctgaatgctgagaagccccacagcatcgtggaccccctggtgagaattgagatccacggcgtgcctgctgactgtgcccggcaggagacagattatgtgctgaacaacggcttcaacccccgctggggccagaccctgcagttccagctgcgggcccctgagctggccctggtgcgctttgtggtggaggactatgatgccaccagccccaatgactttgtgggccagttcaccctgcccctgagcagcctgaagcagggctaccgccacatccacctgctgagcaaggatggagccagcctgagccctgccaccctcttcatccagatccgcatccagaggagctag

SEQ ID NO: 40697 - DNA, 144 bp, Artificial Sequence
  Description of Artificial Sequence: Synthetic coding sequence
atgagccagcagaagtgcatcgtcatctttgccctggtgtgctgctttgccatcctggtggccctgatcttctctgctgtggacatcatgggagaagatgaagatggcctgtctgagaagaactgccagaacaagtgcaggtag

SEQ ID NO: 40698 - DNA, 816 bp, Artificial Sequence
  Description of Artificial Sequence: Synthetic coding sequence
atggccagcaaggatgcccagaaccagaggcggggcctgcccggcttcctgcccggggccccagaccctgaccagagcctgcctgccagcagcaaccctggcaaccaggcctggcagctgagcctgcccctgcccagcagcttcctgcccaccgtgtccctgcccccaggcctggagtacctgagccagctggacctgatcatcatccaccagcaggtggagctgctgggcatgatcctgggcacagagaccagcaacaagtatgagatcaagaacagcctgggccagaggatctactttgctgtggaggagagcatctgcttcaacagaaccttctgcagcaccctgcggagctgcaccctgcgcatcacagacaacagcggccgggaggtgatcaccgtgaaccggcccctgcgctgcaacagctgctggtgcccctgctacctgcaggagctggagatccaggcccctcctggcaccatcgtgggctacgtgacccagaagtgggaccccttcctgcccaagttcaccatccagaatgccaacaaggaggacatcctgaagatcgtgggcccctgtgtgacctgtggctgctttggagatgtggactttgaggtgaagaccatcaatgagaagctgaccatcggcaagatcagcaagtactggagcggctttgtgaatgatgtgttcaccaatgctgacaactttggcatccacgtgcctgctgacctggatgtgacagtgaaggccgccatgattggagcctgcttcctgtttgacttcatgttctttgagcacagcctggccggcctgtag

SEQ ID NO: 40699 - DNA, 816 bp, Artificial Sequence; identical to SEQ ID NO: 40698
  Description of Artificial Sequence: Synthetic coding sequence

SEQ ID NO: 40700 - DNA, 3033 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtctgctgacttccctgccctggtggtgaaggccagcggcctggccgccggcaagggcgtgattgtggccaagagcaaggaggaggcctgcaaggctgtgcaggagatcatgcaggagaaggccttcggggctgctggggagaccatcgtgattgaggagctgctggatggagaggaggtgtcctgcctgtgcttcacagatggcaagacagtggcccccatgcccccagcccaggaccacaagaggctgctggagggagatggcggccccaacacaggaggcatgggcgcctactgcccagccccccaggtgtccaatgacctgctgctgaagatcaaggacacagtgctgcagaggacagtggatggcatgcagcaggagggcaccccctacacaggcatcctgtatgccggcatcatgctgaccaagaatggccccaaggtgctggagttcaactgccgctttggagaccctgagtgccaggtgatcctgcccctgctgaagagtgacctgtatgaggtgatccagagcaccctggatggcctgctgtgcaccagcctgcctgtgtggctggagaaccacacagccctgactgtggtgatggccagcaagggctacccaggggactacaccaagggcgtggagatcaccggcttccctgaggcccaggccctgggcctggaggtgttccacgccggcacagccctgaagaatggcaaggtggtgacccacggcggccgggtgctggccgtgacagccatccgggagaacctgatcagcgccctggaggaggccaagaagggcctggccgccatcaagtttgagggcgccatctacaggaaggatgtgggcttccgggccatcgccttcctgcagcagcccaggagcctgacctacaaggagagcggcgtggacattgctgctggcaacatgctggtgaagaagatccagcccctggccaaggccaccagccgcagcggctgcaaggtggacctgggcggctttgctggcctgtttgacctgaaggccgccggcttcaaggaccccctgctggccagcggcacagatggagtgggcaccaagctgaagatcgcccagctgtgcaacaagcatgacaccatcggccaggacctggtggccatgtgtgtgaatgacatcctggcccagggcgctgagcccctcttcttcctggactacttcagctgtgggaagctggacctgtctgtgacagaggccgtggtggccggcatcgccaaggcctgtgggaaggccggctgtgccctgctgggcggggagacagctgagatgccagacatgtacccacctggagaatatgacctggccggctttgctgtgggcgccatggagcgggaccagaagctgccccacctggagcgcatcacagaaggagatgtggtggtgggcatcgccagcagcggcctgcacagcaatggcttcagcctggtgaggaagatcgtggccaagagcagcctgcagtacagcagccctgccccagatggctgtggggaccagaccctgggggacctgctgctgacccccacccgcatctacagccacagcctgctgcctgtgctgcggagcggccacgtgaaggcctttgcccacatcaccggcggcggcctgctggagaacatcccccgggtgctgcctgagaagctgggcgtggacctggatgcccagacctggaggatccccagggtcttctcctggctgcagcaggagggccacctgtctgaggaggagatggcccggaccttcaactgtggggtgggcgctgtgctggtggtgtccaaggagcagacagagcagatcctgcgggacatccagcagcacaaggaggaggcctgggtgattggctctgtggtggcccgggcagagggcagcccccgggtgaaggtgaagaacctgattgagagcatgcagatcaatggatctgtgctgaagaatggcagcctgaccaaccacttctcctttgagaagaagaaggcccgggtggccgtgctgatctctggaacaggcagcaacctgcaggccctgattgacagcacccgggagcccaacagcagcgcccagattgatattgtcatcagcaacaaggctgctgtggccggcctggacaaggccgagcgggccggcatccccaccagggtcatcaaccacaagctgtacaagaacagagtggagtttgacagcgccatcgacctggtgctggaggagttcagcattgatattgtgtgcctggccggcttcatgaggatcctgagcggcccctttgtgcagaagtggaatggcaagatgctgaacatccaccccagcctgctgcccagcttcaagggcagcaatgcccacgagcaggccctggagaccggggtgacagtgacaggctgcaccgtgcactttgtggccgaggatgtggatgctggccagatcatcctgcaggaggccgtgcctgtgaagagaggagacacagtggccaccctgtctgagcgggtgaagctggccgagcacaagatcttccctgctgccctgcagctggtggccagcggcaccgtgcagctgggggagaatggcaagatctgctgggtgaaggaggagtag

SEQ ID NO: 40701 - DNA, 3033 bp, Artificial Sequence; identical to SEQ ID NO: 40700
  Description of Artificial Sequence: Synthetic coding sequence

SEQ ID NO: 40702 - DNA, 3033 bp, Artificial Sequence; identical to SEQ ID NO: 40700
  Description of Artificial Sequence: Synthetic coding sequence

SEQ ID NO: 40703 - DNA, 993 bp, Artificial Sequence
  Description of Artificial Sequence: Synthetic coding sequence
atggagctgctgagcaccccccacagcattgagatcaacaacatcacctgtgacagcttccgcatctcctgggccatggaggacagcgacctggagcgggtgacccactacttcatcgacctgaacaagaaggagaacaagaacagcaacaagttcaagcacagagatgtgcccaccaagctggtggccaaggctgtgcccctgcccatgacagtgcggggccactggttcctgagccccaggacagagtacagcgtggccgtgcagacagctgtgaagcagagtgatggagagtacctggtgtctggctggagcgagaccgtggagttctgcaccggggactatgccaaggagcacctggcccagctgcaggagaaggccgagcagattgctggccgcatgctgcgcttcagcgtcttctacagaaaccaccacaaggagtacttccagcacgcccggacccactgcggcaacatgctgcagccctacctgaaggacaacagcggcagccacggcagccccaccagcggcatgctgcacggcgtcttcttcagctgcaacacagagttcaacacaggccagcccccccaggacagcccctacggccgctggaggttccagatcccagcccagaggctcttcaaccccagcaccaacctgtactttgctgacttctactgcatgtacacagcctaccactacgccatcctggtgctggcccccaagggcagcctgggggaccgcttctgccgggaccggctgcccctgctggacatcgcctgcaacaagttcctgacctgcagcgtggaggatggagagctggtgttcagacatgcccaggacctgatcctggagatcatctacacagagcctgtggacctgagcctgggcaccctgggggagatcagcggccaccagctgatgagcctgagcacagcagatgccaagaaggaccccagctgcaagacctgcaacatctctgtgggccgctag

SEQ ID NO: 40704 - DNA, 714 bp, Artificial Sequence
  Description of Artificial Sequence: Synthetic coding sequence
atggagctgctgagcaccccccacagcattgagatcaacaacatcacctgtgacagcttccgcatctcctgggccatggaggacagcgacctggagcgggtgacccactacttcatcgacctgaacaagaaggagaacaagaacagcaaccaccacaaggagtacttccagcacgcccggacccactgcggcaacatgctgcagccctacctgaaggacaacagcggcagccacggcagccccaccagcggcatgctgcatggagtcttcttcagctgcaacacagagttcaacacaggccagcccccccaggacagcccctacggccgctggaggttccagatcccagcccagaggctcttcaaccccagcaccaacctgtactttgctgacttctactgcatgtacacagcctaccactacgccatcctggtgctggcccccaagggcagcctgggggaccgcttctgccgggaccggctgcccctgctggacatcgcctgcaacaagttcctgacctgcagcgtggaggatggagagctggtgttcagacatgcccaggacctgatcctggagatcatctacacagagcctgtggacctgagcctgggcaccctgggggagatcagcggccaccagctgatgagcctgagcacagcagatgccaagaaggaccccagctgcaagacctgcaacatctctgtgggccgctag

SEQ ID NO: 40705 - DNA, 993 bp, Artificial Sequence; identical to SEQ ID NO: 40703
  Description of Artificial Sequence: Synthetic coding sequence

SEQ ID NO: 40706 - DNA, 894 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagggcagcacagactacttcctgagcagcggggacaagatccgcttcttctttgagaagggcgtgtttgatgagaagggcaacttcctggtgcccccagagaagagcatcaacaagattggacatgccctgcacgcccatgaccccgtcttcaagagcatcacccacagcttcaaggtgcagaccctggcccggagcctgggcctgcagatgcctgtggtggtgcagagcatgtacatcttcaagagccccctcatccgcaccccacccagctgcaccaggagcccctgggccggctgctgggcctgtggcagccagtggaggatgccccgctggaggacagctgtgtctggcagcagcctggcccccacccctgtggtgtgccaggagggctggagcggccccctgctggcccagaggctggtgcctgccagcctgggccagagccagcccggcatcacagccagcctgtgccccccccagtgccgggagggcccctggagcagctccatggagaagtggtacacccgggccagcaggaccagcctgacagcccgggcccggcccaccctgagcacctcctggaggcccctggcccctcctggggccaggagaacaggcagcagccagcagctgaactgccccttccccaactgcacccccaagggcagccggcgggccggggccctggcccctcctggatag

SEQ ID NO: 40707 - DNA, 813 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagggcagcacagactacttcctgagcagcggggacaagatccgcttcttctttgagaagggcgtgtttgatgagaagggcaacttcctggtgcccccagagaagagcatcaacaagattggacatgccctgcacgcccatgaccccgtcttcaagagcatcacccacagcttcaaggtgcagcagccccactttggaggagaggtgagcccccaccaggatgccagcttcctgtacacagagcccctgggccgggtgctgggcgtgtggattgctgtggaggatgccaccctggagaatggctgcctgtggttcatccctggcagccacaccagcggcgtgtccaggaggatggtgcgggcccctgtgggcagcgcccctggcaccagcttcctgggcagcgagcccgcccgggacaacagcctgtttgtgcccacccctgtgcagagaggagccctggtgctgatccacggggaggtggtgcacaagagcaagcagaacctgagtgacaggagccggcaggcctacaccttccacctgatggaggccagcggcaccacctggagccctgagaactggctgcagcccacagctgagctgcccttcccccagctgtacacctag

SEQ ID NO: 40708 - DNA, 876 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagggcagcacagactacttcctgagcagcggggacaagatccgcttcttctttgagaagggcgtgtttgatgagaagggcaacttcctggtgcccccagagaagagcatcaacaagattggacatgccctgcacgcccatgaccccgtcttcaagagcatcacccacagcttcaaggtgcagaccctggcccggagcctgggcctgcagatgcctgtggtggtgcagagcatgtacatcttcaagcagccccactttggaggagaggtgagcccccaccaggatgccagcttcctgtacacagagcccctgggccgggtgctgggcgtgtggattgctgtggaggatgccaccctggagaatggctgcctgtggttcatccctggcagccacaccagcggcgtgtccaggaggatggtgcgggcccctgtgggcagcgcccctggcaccagcttcctgggcagcgagcccgcccgggacaacagcctgtttgtgcccacccctgtgcagagaggagccctggtgctgattcatggagaggtggtgcacaagagcaagcagaacctgagtgacaggagccggcaggcctacaccttccacctgatggaggccagcggcaccacctggagccctgagaactggctgcagcccacagctgagctgcccttcccccagctgtacacctag

SEQ ID NO: 40709 - DNA, 201 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagggcagctag

SEQ ID NO: 40710 - DNA, 813 bp, Artificial Sequence; identical to SEQ ID NO: 40707
  Description of Artificial Sequence: Synthetic coding sequence

SEQ ID NO: 40711 - DNA, 534 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagggcagcacagactacttcctgagcagcggggacaagatccgcttcttctttgagaagggcgtgtttgatgagaagggcaacttcctggtgcccccagagaagagcatcaacaagattggacatgccctgcacgcccatgaccccgtcttcaagagcatcacccacagcttcaaggtgcagaccctggcccggagcctgggcctgcagatgcctgtggtggtgcagagcatgtacatcttcaagcagccccactttggaggagaggtgagcccccaccaggatgccagcttcctgtacacagagcccctgggccgggtgctgggcgtgtggattgctgtgtag

SEQ ID NO: 40712 - DNA, 195 bp, Artificial Sequence
  Description of Artificial Sequence: Synthetic coding sequence
atggcctgcctgagccccagccagctgcagaagttccagcaggacggcttcctggtgctggagggcttcctgtctgctgaggagtgtgtggccatgcagcagagaattggagaaattgtggccgagatggatgtgcccctgcactgcaggacagagttcagcacccaggaggaggagcagctgcgggcccagtag

SEQ ID NO: 40713 - DNA, 1779 bp, Artificial Sequence
  Description of Artificial Sequence: Synthetic coding sequence
atggccagcaccagcagagatgtgattgctggccggggcatccacagcaaggtgaagagcgccaagctgctggaggtgctgaatgccatggaggaggaggagagcaacaacaaccgggaggagatcttcatcgcccccccagacaatgctgctggggagttcacagatgaagattctggagatgaggacagccagagaggagcccacctgcccggctctgtgctgcacgcctctgtgctgtgtgaggacagcggcaccggggaggacaatgatgacctggagctgcagcctgccaagaagaggcagaaggctgtggtgaagccccagaggatctggaccaagagggacatccggccagactttggctcctggacagccagtgacccccacatcgaggacctgaagagccaggagctgagccctgtgggcctgtttgagctgttctttgatgagggcaccatcaacttcatcgtgaatgagaccaacagatatgcctggcagaagaatgtgaacctgagcctgacagcccaggagctgaagtgtgtgctgggcatcctgatcctgagcggctacatctcctaccccaggaggaggatgttctgggagaccagcccagacagccaccaccacctggtggctgatgccatcagaagagacagatttgagctgatcttctcctacctgcactttgctgacaacaatgagctggatgccagtgacagatttgccaaggtgcggcccctcatcatccgcatgaactgcaacttccagaagcacgcccccctggaggagttctacagctttggagagagcatgtgtgagtacttcggccaccggggcagcaagcagctgcaccggggcaagcctgtgcggctgggctacaagatctggtgtggcaccaccagccggggctacctggtgtggtttgagcccagccagggcaccctcttcaccaagccagacaggagcctggacctgggcggctccatggtgatcaagtttgtggatgccctgcaggagcggggcttcctgccctaccacatcttctttgacaaggtgttcacctctgtgaagctgatgagcatcctgaggaagaagggcgtgaaggccactggaacagtgcgggagtacagaacagagcgctgccccctgaaggaccccaaggagctgaagaagatgaagaggggcagctttgactacaaggtggatgaaagtgaggagatcatcgtgtgccgctggcatgacagctctgtggtgaacatctgcagcaatgctgtgggcatcgagcctgtgcggctgaccagccgccacagcggggccgccaagaccaggacccaggtgcaccagcccagcctggtgaagctgtaccaggagaaggtgggcggcgtgggccgcatggaccagaacatcgccaagtacaaggtgaagatccggggcatgaagtggtacagcagcttcatcggctacgtgattgatgctgccctgaacaatgcctggcagctgcaccgcatctgctgccaggatgcccaggtggacctgctggccttccgccgctacatcgcctgtgtgtacctggagagcaatgctgacaccaccagccagggccgccgcagccggcggctggagacagagagcagatttgacatgattggccactggatcatccaccaggacaagaggacccgctgtgccctgtgccacagccagaccaacacccgctgtgagaagtgccagaagggcgtgcacgccaagtgcttccgggagtaccacatcagatag

SEQ ID NO: 40714 - DNA, 1026 bp, Artificial Sequence
  Description of Artificial Sequence: Synthetic coding sequence
atgaactgcaacttccagaagcacgcccccctggaggagttctacagctttggagagagcatgtgtgagtacttcggccaccggggcagcaagcagctgcaccggggcaagcctgtgcggctgggctacaagatctggtgtggcaccaccagccggggctacctggtgtggtttgagcccagccagggcaccctcttcaccaagccagacaggagcctggacctgggcggctccatggtgatcaagtttgtggatgccctgcaggagcggggcttcctgccctaccacatcttctttgacaaggtgttcacctctgtgaagctgatgagcatcctgaggaagaagggcgtgaaggccaccggcaccgtgcgggagtacagaacagagcgctgccccctgaaggaccccaaggagctgaagaagatgaagaggggcagctttgactacaaggtggatgagagcgaggagatcatcgtgtgccgctggcatgacagctctgtggtgaacatctgcagcaatgctgtgggcatcgagcctgtgcggctgaccagccgccacagcggggccgccaagaccaggacccaggtgcaccagcccagcctggtgaagctgtaccaggagaaggtgggcggcgtgggccgcatggaccagaacatcgccaagtacaaggtgaagatccggggcatgaagtggtacagcagcttcatcggctacgtgattgatgctgccctgaacaatgcctggcagctgcaccgcatctgctgccaggatgcccaggtggacctgctggccttccgccgctacatcgcctgtgtgtacctggagagcaatgctgacaccaccagccagggcagaagaagccggcggctggagacagagagcagatttgacatgattggccactggatcatccaccaggacaagaggacccgctgtgccctgtgccacagccagaccaacacccgctgtgagaagtgccagaagggcgtgcacgccaagtgcttccgggagtaccacatcagatag

SEQ ID NO: 40715 - DNA, 1770 bp, Artificial Sequence
  Description of Artificial Sequence: Synthetic coding sequence
atgggcagagatgtgattgctggccggggcatccacagcaaggtgaagagcgccaagctgctggaggtgctgaatgccatggaggaggaggagagcaacaacaaccgggaggagatcttcatcgcccccccagacaatgctgctggggagttcacagatgaggacagcggagatgaggacagccagagaggagcccacctgcccggctctgtgctgcacgcctctgtgctgtgtgaagattctggaactggagaagataatgatgacctggagctgcagcctgccaagaagaggcagaaggctgtggtgaagccccagaggatctggaccaagagggacatccggccagactttggctcctggacagccagtgacccccacatcgaggacctgaagagccaggagctgagccctgtgggcctgtttgagctgttctttgatgagggcaccatcaacttcatcgtgaatgagaccaacagatatgcctggcagaagaatgtgaacctgagcctgacagcccaggagctgaagtgtgtgctgggcatcctgatcctgagcggctacatctcctaccccaggaggaggatgttctgggagaccagcccagacagccaccaccacctggtggctgatgccatccggcgggacagatttgagctgatcttctcctacctgcactttgctgacaacaatgagctggatgccagtgacagatttgccaaggtgcggcccctcatcatccgcatgaactgcaacttccagaagcacgcccccctggaggagttctacagctttggagagagcatgtgtgagtacttcggccaccggggcagcaagcagctgcaccggggcaagcctgtgcggctgggctacaagatctggtgtggcaccaccagccggggctacctggtgtggtttgagcccagccagggcaccctcttcaccaagccagacaggagcctggacctgggcggctccatggtgatcaagtttgtggatgccctgcaggagcggggcttcctgccctaccacatcttctttgacaaggtgttcacctctgtgaagctgatgagcatcctgaggaagaagggcgtgaaggccaccggcaccgtgcgggagtacagaacagagcgctgccccctgaaggaccccaaggagctgaagaagatgaagaggggcagctttgactacaaggtggatgagagcgaggagatcatcgtgtgccgctggcatgacagctctgtggtgaacatctgcagcaatgctgtgggcatcgagcctgtgcggctgaccagccgccacagcggggccgccaagaccaggacccaggtgcaccagcccagcctggtgaagctgtaccaggagaaggtgggcggcgtgggccgcatggaccagaacatcgccaagtacaaggtgaagatccggggcatgaagtggtacagcagcttcatcggctacgtgattgatgctgccctgaacaatgcctggcagctgcaccgcatctgctgccaggatgcccaggtggacctgctggccttccgccgctacatcgcctgtgtgtacctggagagcaatgctgacaccaccagccagggcagaagaagccggcggctggagacagagagcagatttgacatgattggccactggatcatccaccaggacaagaggacccgctgtgccctgtgccacagccagaccaacacccgctgtgagaagtgccagaagggcgtgcacgccaagtgcttccgggagtaccacatcagatag

SEQ ID NO: 40716 - DNA, 1782 bp, Artificial Sequence
  Description of Artificial Sequence: Synthetic coding sequence
atgcccaggaccctgagcctgcacgagatcacagacctgctggagacagatgacagcattgaggccagcgccatcgtcatccagcccccagaaaatgccacagcccctgtgtctgatgaggagagcggagatgaggagggcggcaccatcaacaacctgcccggcagcctgctgcacacagctgcctacctgatccaggacggcagtgatgctgagagtgacagtgatgaccccagctatgcccccaaggatgacagcccagatgaggtgcccagcaccttcaccgtgcagcagcccccacccagcagaagaaggaagatgaccaagatcctgtgcaagtggaagaaggctgacctgactgtgcagcctgtggccggccgggtgacagcccccccaaatgacttcttcaccgtgatgaggacccccacagagatcctggagctgttcctggatgatgaggtgattgagctgattgtgaagtacagcaacctgtatgcctgcagcaaaggagtgcacctgggcctgaccagcagcgagttcaagtgcttcctgggcatcatcttcctgagcggctacgtgtctgtgcccaggaggaggatgttctgggagcagaggacagatgtgcacaacgtgctggtgtctgctgccatgaggcgggacagatttgagaccatcttcagcaacctgcacgtggccgacaatgccaacctggaccctgtggacaagttcagcaagctgcggcccctcatcagcaagctgaatgaacgctgcatgaagtttgtgcccaatgagacctacttctcctttgatgagttcatggtgccctacttcggccgccacggctgcaagcagttcatccggggcaagcccatccgcttcggctacaagttctggtgtggggccacctgcctgggctacatctgctggttccagccctaccagggcaagaaccccaacaccaagcatgaggagtatggagtgggcgccagcctggtgctgcagttcagcgaggccctgacagaggcccaccctggccagtaccactttgtgttcaacaacttcttcaccagcatcgccctgctggacaagctgagctccatgggccaccaggccaccggcaccgtgaggaaggaccacatcgacagagtgcccctggagagtgatgtggccctgaagaagaaggagcggggcacctttgactacagaattgatggcaagggcaacatcgtgtgccgctggaatgacaacagcgtggtgacagtggccagcagcggggccggcatccaccccctgtgcctggtgagccgctacagccagaagctgaagaagaagatccaggtgcagcagcccaacatgatcaaggtgtacaaccagttcatgggcggcgtggacagagcagatgagaacatcgacaagtaccgggccagcatccggggcaagaagtggtacagcagccccctgctcttctgctttgagctggtgctgcagaatgcctggcagctgcacaagacctatgatgagaagcctgtggacttcctggagttcagaagaagagtggtgtgccactacctggagacccacggccaccccccagagcccggccagaagggccggccccagaagaggaacatcgacagccgctatgatggcatcaaccacgtgattgtgaagcagggcaagcagacccgctgtgccgagtgccacaagaacaccaccttccgctgtgagaagtgtgatgtggccctgcacgtgaagtgcagcgtggagtaccacacagaatag

SEQ ID NO: 40717 - DNA, 1782 bp, Artificial Sequence; identical to SEQ ID NO: 40716
  Description of Artificial Sequence: Synthetic coding sequence

SEQ ID NO: 40718 - DNA, 1758 bp, Artificial Sequence
  Description of Artificial Sequence: Synthetic coding sequence
atgagcaaccccaggaagaggagcatccccatgagggacagcaacacaggcctggagcagctgctggccgaggacagctttgatgaaagtgacttcagcgagattgatgacagcgacaacttcagtgacagcgccctggaggccgacaagatccggcccctgagccacctggagagtgatggcaagagcagcaccagcagtgacagcggccgctccatgaagtggagcgcccgggccatgatcccccggcagagatatgacttcaccggcaccccaggcaggaaggtggatgtgtctgacatcacagaccccctgcagtactttgagctgttcttcacagaggagctggtgtccaagatcacccgggagaccaatgcccaggccgccctgctggccagcaagcccccaggccccaagggcttcagcaggatggacaagtggaaggacacagacaatgatgagctgaaggtgttctttgctgtgatgctgctgcagggcatcgtgcagaagccagagctggagatgttctggagcacccggcccctgctggacaccccctacctgcggcagatcatgactggagagcgcttcctgctgctcttccgctgcctgcactttgtgaacaacagcagcatctctgctggccagagcaaggcccagatcagcctgcagaagatcaagcctgtgtttgacttcctggtgaacaagttcagcacagtgtacacccccaacagaaatattgctgtggatgagagcctgatgctgttcaagggccccctggccatgaagcagtacctgcccaccaagagggtgcgcttcggcctgaagctgtatgtgctgtgtgagagccagagcggctacgtgtggaatgccctggtgcacactggacctggcatgaacctgaaggacagcgcagatggcctgaagagcagcagaattgtgctgaccctggtgaatgacctgctgggccagggctactgtgtgttcctggacaacttcaacatcagccccatgctgttccgggagctgcaccagaacagaacagatgctgtgggcacagcccggctgaacaggaagcagatccccaatgacctgaagaagagaattgccaagggcaccaccgtggcccgcttctgtggggagctgatggccctgaagtggtgtgatggcaaggaggtgaccatgctgagcaccttccacaatgacacagtgattgaggtgaacaacagaaatggcaagaagaccaagaggccccgggtgattgtggactacaatgaaaacatgggcgctgtggacagcgctgaccagatgctgaccagctaccccagcgagaggaagaggcacaaggtgtggtacaagaagttcttccaccacctgctgcacatcaccgtgctgaacagctacatcctcttcaagaaggacaaccctgagcacaccatgagccacatcaacttccggctggccctgattgaaagaatgctggagaagcaccacaagccaggccagcagcacctgcggggccggccctgcagtgatgatgtgacccccctgcggctgagcggccgccacttccccaagagcatcccagccaccagcggcaagcagaaccccaccggccgctgcaagatctgctgcagccagtatgacaaggatggcaagaagatcaggaaggagacccgctacttctgtgctgaatgtgatgtgcccctgtgtgtggtgccctgctttgagatctaccacaccaagaagaactactag

SEQ ID NO: 40719 - DNA, 948 bp, Artificial Sequence
  Description of Artificial Sequence: Synthetic coding sequence
atggagaccagcagcaagggcctgctgacccaggtgacccagttctggaacctgctggatgacctggcccagagcgaccctgagggctatgagaagttcatccagcagcagctgaaggagggcaagcagctgtgtgccgcccctgagccccagctgtgcctgcagacccgcatcctgaagcccaaggagaagatcctcttcatcaacctgtgccagtggacccgcatcccagccccccagagcaccacccaccctgtgcccctgactgtgggcaagccagaggacaccacagagatcagtgatgcctacacagtgattgatgtggcctacaacccagatgtgctgcatgctgctgagaaggaccaggtgaagaagaaccagctgatccagatggccatgaagtgcatcgaggagaagttccagttcaccctgagccacagctaccacatcaccaagttccgcatcaagggcagcatccagaggatgaagcagaacctgatgggcatccagacagacagcattgacctgcgggagaagatgagaagagagctgaccctgggccagatccgcagcagcaccatgagcaacccagaccacttcccccagctgctgctgcccaaggaccaggtgtctgggaaggctgtgtgcctgattgaggagatcagcagcacagagatccaggtggagatgaagatgcctgcctatgagctgaagatcgtgcatgaccacagcgagaagcccctgaagattgagctgaaggtggagctgcccggcatcaacagcgtgtccctgtgtgacctgtctgtgtctgaagatgacctgctgattgaggtgtctgagaagtaccgcctgcacctgaacctgcccaagctgattgacacagagatgaccacagccaagttcatcaaggagaagagcaccctcatcatcaccatgcccctggtgtag

SEQ ID NO: 40720 - DNA, 867 bp, Artificial Sequence
  Description of Artificial Sequence: Synthetic coding sequence
atggagaccagcagcaagggcctgctgacccaggtgacccagttctggaacctgctggatgacctggcccagagcgaccctgagggctatgagaagttcatccagcagcagctgaaggagggcaagcagctgtgtgccgcccctgagccccagctgtgcctgcagacccgcatcctgaagcccaaggagaagatcctcttcatcaacctgtgccagtggacccgcatcccagccccccagagcaccacccaccctgtgcccctgactgtgggcaagccagaggacaccacagagatcagtgatgcctacacagtgattgatgtggcctacaacccagatgtgctgcatgctgctgagaaggaccaggtgaagaagaaccagctgatccagatggccatgaagtgcatcgaggagaagttccagttcaccctgagccacagctaccacatcaccaagttccgcatcaagggcagcatccagaggatgaagcagaacctgatgggcatccagacagacagcattgacctgcgggagaagatgagaagagagctgaccctgggccagatccgcagcagcaccatgagcaacccagaccacttcccccagctgctgctgcccaaggaccaggtgtctgggaaggctgtgtgcctgattgaggagatcagcagcacagagatccaggtggagatgaagatgcctgcctatgagctgaagatcgtgcatgaccacagcgagaagcccctgaagattgagctgaaggtggagctgcccggcatcaacagcgtgtccctgtgtgacctgtctgtgtctgagggcaccacagagccccaggccctggccaaggatgagctgagcctgaagttctag

SEQ ID NO: 40721 - DNA, 867 bp, Artificial Sequence; identical to SEQ ID NO: 40720
  Description of Artificial Sequence: Synthetic coding sequence

SEQ ID NO: 40722 - DNA, 948 bp, Artificial Sequence; identical to SEQ ID NO: 40719
  Description of Artificial Sequence: Synthetic coding sequence

SEQ ID NO: 40723 - DNA, 636 bp, Artificial Sequence
  Description of Artificial Sequence: Synthetic coding sequence
atgagccacggccacagccatggaggcggcggctgccgctgtgccgctgagcgggaggagcccccagagcagaggggcctggcctacggcctgtacctgagaattgacctggagcggctgcagtgcctgaatgaaagccgggagggcagcggccggggcgtcttcaagccctgggaggagaggacagacaggagcaagtttgtggagagtgatgctgatgaggagctgctcttcaacatccccttcaccggaaatgtgaagctgaagggcatcatcatcatgggagaagatgatgacagccaccccagcgagatgaggctgtacaagaacatcccccagatgagctttgatgacacagagcgggagccagaccagaccttcagcctgaacagagacctgaccggggagctggagtatgccaccaagatcagccgcttcagcaatgtgtaccacctgagcatccacatcagcaagaactttggagctgacaccaccaaggtgttctacatcggcctgcggggggagtggacagagctgcggagacatgaggtgaccatctgcaactatgaggccagcgccaacccagctgaccaccgggtgcaccaggtgaccccccagacccacttcatctcctag

SEQ ID NO: 40724 - DNA, 297 bp, Artificial Sequence
  Description of Artificial Sequence: Synthetic coding sequence
atgagctttgatgacacagagcgggagccagaccagaccttcagcctgaacagagacctgactggagagctggagtatgccaccaagatcagccgcttcagcaatgtgtaccacctgagcatccacatcagcaagaactttggagctgacaccaccaaggtgttctacatcggcctgcggggggagtggacagagctgcggagacatgaggtgaccatctgcaactatgaggccagcgccaacccagctgaccaccgggtgcaccaggtgaccccccagacccacttcatctcctag

SEQ ID NO: 40725 - DNA, 213 bp, Artificial Sequence
  Description of Artificial Sequence: Synthetic coding sequence
atgggagaagatgatgacagccaccccagcgagatgaggctgtacaagaacatcccccagatgagctttgatgacacagagcgggagccagaccagaccttcagcctgaacagagacctgactggagagctggagtatgccaccaagatcagccgcttcagcaatgtgtaccacctgagcatccacatcagcaagaactttggagctgactag

SEQ ID NO: 40726 - DNA, 903 bp, Artificial Sequence
  Description of Artificial Sequence: Synthetic coding sequence
atggagccccccatggagcccagcggcggggagcaggagcccggggctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgggcccccagatccccagggctgccctggcccggctgctgagagatgctgagggcctgcaggagctggccctggccccctgccacgagtggctgagtgatgaggacctggtgcctgtgctggccaggaacccccagctgcggtctgtggccctgggcggctgcggccagctgagcagaagagccctgggcgccctggccgagggctgcccccggctgcagaggctgagcctggcccactgtgactgggtggatggcctggccctgcggggcctggccgaccgctgcccagccctggaggagctggacctgacagcctgccggcagctgaaggatgaggccatcgtgtacctggcccagaggagaggagctggcctgcggagcctgagcctggccgtgaatgccaacgtgggagatgctgctgtgcaggagctggccaggaactgcccagagctgcaccacctggacctgaccggctgcctgcgggtgggcagtgatggagtgaggaccctggccgagtactgccctgtgctgcggagcctgcgggtgcgccactgccaccacgtggccgagagcagcctgagccggctgaggaagaggggcgtggacattgatgtggagccccccctgcaccaggccctggtgctgctgcaggacatggccggctttgccccctttgtgaacctgcaggtgtag

SEQ ID NO: 40727 - DNA, 3093 bp, Artificial Sequence
  Description of Artificial Sequence: Synthetic coding sequence
atgagaaatgtggccctgcggcgggccgccggccctgtgtgtgccgaggccgctgagaggaggacctgcaccccccagagcgtggccatggagcagtacaagctgggggacaagatccacggcttcaccgtgaaccaggtgacctctgtgcctgagctgttcctgacagctgtgaagctgacccatgatgacacaggagcccgctacctgcacctggcccgggaggacaccaacaacctcttctctgtgcagttccgcaccacccccatggacagcactggagtgccccacatcctggagcacacagtgctgtgtggcagccagaagtacccctgccgggaccccttcttcaagatgctgaacagaagcctgagcaccttcatgaatgccttcaccgccagtgactacaccctgtaccccttcagcacccagaaccccaaggacttccagaacctgctgtctgtgtacctggatgccaccttcttcccctgcctgcgggagctggacttctggcaggagggctggaggctggagcacgagaaccccagcgacccccagacccccctggtgttcaagggcgtggtgttcaatgagatgaagggggccttcacagacaatgaaagaatcttcagccagcacctgcagaaccggctgctgcctgaccacacctacagcgtggtgtctggaggagaccccctgtgcatccctgagctgacctgggagcagctgaagcagttccacgccacccactaccaccccagcaatgcccgcttcttcacctacggcaacttccccctggagcagcacctgaagcagatccacgaggaggccctgagcaagttccagaagattgagcccagcacagtggtgcctgcccagaccccctgggacaagccccgggagttccagatcacctgtggccctgacagctttgccacagaccccagcaagcagaccaccatctctgtgtccttcctgctgcctgacatcacagacacctttgaggccttcaccctgagcctgctgagcagcctgctgaccagcggccccaacagccccttctacaaggccctgattgaaagtggcctgggcacagacttctccccagatgtgggctacaacggctacacccgggaggcctacttctctgtgggcctgcagggcattgctgagaaggacatcgagaccgtgcgcagcctgattgacaggaccattgatgaggtggtggagaagggctttgaagatgaccgcatcgaggccctgctgcacaagattgagatccagatgaagcaccagagcaccagctttggcctgatgctgaccagctacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgacagctggggacatccctgtgcagtactgtgcccagcccaccaacggcatggtgtacttccgggccttcagcagcctgaacaccctgcctgaggagctgcggccctacgtgcccctcttctgcagcgtgctgaccaagctgggctgcggcctgctggactaccgggagcaggcccagcagatcgagctgaagacaggaggcatgtctgccagcccccacgtgctgcctgatgacagccacatggacacctatgagcagggcgtgctcttcagcagcctgtgcctggacaggaacctgcctgacatgatgcagctgtggagcgagatcttcaacaacccctgctttgaggaggaggagcacttcaaggtgctggtgaagatgacagcccaggagctggccaacggcatcccagacagcggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagaggaggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctatggaggaggagccaagctgagccacaacggcatcttcaccctgtacagctacagagaccccaacaccatcgagaccctgcagagctttgggaaggctgtggactgggccaagagcggcaagttcacccagcaggacattgatgaggccaagctgtctgtgttcagcacagtggatgcccctgtggcccccagcgacaagggcatggaccacttcctgtatggcctgagtgatgagatgaagcaggcccaccgggagcagctgtttgctgtgtcccatgacaagctgctggccgtgtctgaccgctacctgggcaccgggaagagcacccacggcctggccatcctgggccctgagaaccccaagatcgccaaggaccccagctggatcatccagtag

SEQ ID NO: 40728 - DNA, 3117 bp, Artificial Sequence
  Description of Artificial Sequence: Synthetic coding sequence
atgtggaggtgtggcggccggcagggcctgtgtgtgctgcggcggctgagcggcggccacgcccaccaccgggcctggcgctggaacagcaacagagcctgtgagcgggccctgcagtacaagctgggggacaagatccacggcttcaccgtgaaccaggtgacctctgtgcctgagctgttcctgacagctgtgaagctgacccatgatgacaccggggcccgctacctgcacctggcccgggaggacaccaacaacctcttctctgtgcagttccgcaccacccccatggacagcactggagtgccccacatcctggagcacacagtgctgtgtggcagccagaagtacccctgccgggaccccttcttcaagatgctgaacagaagcctgagcaccttcatgaatgccttcaccgccagtgactacaccctgtaccccttcagcacccagaaccccaaggacttccagaacctgctgtctgtgtacctggatgccaccttcttcccctgcctgcgggagctggacttctggcaggagggctggaggctggagcacgagaaccccagcgacccccagacccccctggtgttcaagggcgtggtgttcaatgagatgaagggggccttcacagacaatgaaagaatcttcagccagcacctgcagaaccggctgctgcctgaccacacctacagcgtggtgtctggaggagaccccctgtgcatccctgagctgacctgggagcagctgaagcagttccacgccacccactaccaccccagcaatgcccgcttcttcacctacggcaacttccccctggagcagcacctgaagcagatccacgaggaggccctgagcaagttccagaagattgagcccagcacagtggtgcctgcccagaccccctgggacaagccccgggagttccagatcacctgtggccctgacagctttgccacagaccccagcaagcagaccaccatctctgtgtccttcctgctgcctgacatcacagacacctttgaggccttcaccctgagcctgctgagcagcctgctgaccagcggccccaacagccccttctacaaggccctgattgagagcggcctgggcacagacttctccccagatgtgggctacaacggctacacccgggaggcctacttctctgtgggcctgcagggcattgctgagaaggacattgaaacagtgcgcagcctgattgacaggaccattgatgaggtggtggagaagggctttgaagatgacagaattgaggccctgctgcacaagattgagatccagatgaagcaccagagcaccagctttggcctgatgctgaccagctacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgacagctggggacatccctgtgcagtactgtgcccagcccaccaacggcatggtgtacttccgggccttcagcagcctgaacaccctgcctgaggagctgcggccctacgtgcccctcttctgcagcgtgctgaccaagctgggctgcggcctgctggactaccgggagcaggcccagcagatcgagctgaagacaggaggcatgtctgccagcccccacgtgctgcctgatgacagccacatggacacctatgagcaggtgggcgtgctcttcagcagcctgtgcctggacaggaacctgcctgacatgatgcagctgtggagcgagatcttcaacaacccctgctttgaggaggaggagcacttcaaggtgctggtgaagatgacagcccaggagctggccaacggcatcccagacagcggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagaggaggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctatggaggaggagccaagctgagccacaacggcatcttcaccctgtacagctacagagaccccaacaccatcgagaccctgcagagctttgggaaggctgtggactgggccaagagcggcaagttcacccagcaggacattgatgaggccaagctgtctgtgttcagcacagtggatgcccctgtggcccccagcgacaagggcatggaccacttcctgtatggcctgagtgatgagatgaagcaggcccaccgggagcagctgtttgctgtgtcccatgacaagctgctggccgtgtctgaccgctacctgggcaccgggaagagcacccacggcctggccatcctgggccctgagaaccccaagatcgccaaggaccccagctggatcatccagtag

SEQ ID NO: 40729 - DNA, 1788 bp, Artificial Sequence
  Description of Artificial Sequence: Synthetic coding sequence
atgtggaagagcagcttccagtacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgacagctggggacatccctgtgcagtactgtgcccagcccaccaacggcatggtgtacttccgggccttcagcagcctgaacaccctgcctgaggagctgcggccctacgtgcccctcttctgcagcgtgctgaccaagctgggctgcggcctgctggactaccgggagcaggcccagcagatcgagctgaagacaggaggcatgtctgccagcccccacgtgctgcctgatgacagccacatggacacctatgagcagggcgtgctcttcagcagcctgtgcctggacaggaacctgcctgacatgatgcagctgtggagcgagatcttcaacaacccctgctttgaggaggaggagcacttcaaggtgctggtgaagatgacagcccaggagctggccaacggcatcccagattctggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagcggcggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctacggcggcggggccaagctgagccacaacggcatcttcaccctgtacagctacagagaccccaacaccatcgagaccctgcagagctttgggaaggctgtggactgggccaagagcggcaagttcacccagcaggacattgatgaggccaagctgagcgtcttcagcacagtggatgcccctgtggcccccagcgacaagggcatggaccacttcctgtatggcctgagtgatgagatgaagcaggcccaccgggagcagctgtttgctgtgtcccatgacaagctgctggccgtgtctgaccgctacctgggcaccgggaagagcacccacggcctggccatcctgggccctgagaaccccaagatcgccaaggaccccagctggatcatccagtag

SEQ ID NO: 40730 - DNA, 261 bp, Artificial Sequence
  Description of Artificial Sequence: Synthetic coding sequence
gtgaatgccaccccccagcagatgccccagacagagaaggctgtggaggacttcctgcggagcatcggccgcagcaagaaggagaggaggcctgtgcggccccacacagtggagaagcctgtgcccagcagcagtggaggagatgcccacgtgccccacggcagccaggtgatcaggaagctggtgatgtacaccctgcggcaccacgtgaagattggaggcctgcacgtgtccttcaccgtgaggaactgtgtggagtag

SEQ ID NO: 40731 - DNA, 702 bp, Artificial Sequence
  Description of Artificial Sequence: Synthetic coding sequence
tgactgattgaaagtggcctgggcacagacttctccccagatgtgggctacaacggctacacccgggaggcctacttctctgtgggcctgcagggcattgctgagaaggacatcgagaccgtgcgcagcctgattgacaggaccattgatgaggtggtggagaagggctttgaagatgaccgcatcgaggccctgctgcacaagattgagatccagatgaagcaccagagcaccagctttggcctgatgctgaccagctacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgaccggccactgtgaaagatatgccttccctggcagccgggtgccctggggcaactag

SEQ ID NO: 40732 - DNA, 2820 bp, Artificial Sequence
  Description of Artificial Sequence: Synthetic coding sequence
atgagaaatgtggccctgcggcgggccgccggccctgtgtgtgccgaggccgctgagcggcgggtgacctctgtgcctgagctgttcctgacagctgtgaagctgacccatgatgacaccggggcccgctacctgcacctggcccgggaggacaccaacaacctcttctctgtgcagttccgcaccacccccatggacagcactggagtgccccacatcctggagcacacagtgctgtgtggcagccagaagtacccctgccgggaccccttcttcaagatgctgaacagaagcctgagcaccttcatgaatgccttcaccgccagtgactacaccctgtaccccttcagcacccagaaccccaaggacttccagaacctgctgtctgtgtacctggatgccaccttcttcccctgcctgcgggagctggacttctggcaggagggctggaggctggagcacgagaaccccagcgacccccagacccccctggtgttcaagggcgtggtgttcaatgagatgaagggggccttcacagacaatgaaagaatcttcagccagcacctgcagaaccggctgctgcctgaccacacctacagcgtggtgtctggaggagaccccctgtgcatccctgagctgacctgggagcagctgaagcagttccacgccacccactaccaccccagcaatgcccgcttcttcacctacggcaacttccccctggagcagcacctgaagcagatccacgaggaggccctgagcaagttccagaagattgagcccagcacagtggtgcctgcccagaccccctgggacaagccccgggagttccagatcacctgtggccctgacagctttgccacagaccccagcaagcagaccaccatctctgtgtccttcctgctgcctgacatcacagacacctttgaggccttcaccctgagcctgctgagcagcctgctgaccagcggccccaacagccccttctacaaggccctgattgagagcggcctgggcacagacttctccccagatgtgggctacaacggctacacccgggaggcctacttctctgtgggcctgcagggcattgctgagaaggacattgaaacagtgcgcagcctgattgacaggaccattgatgaggtggtggagaagggctttgaagatgacagaattgaggccctgctgcacaagattgagatccagatgaagcaccagagcaccagctttggcctgatgctgaccagctacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgacagctggggacatccctgtgcagtactgtgcccagcccaccaacggcatggtgtacttccgggccttcagcagcctgaacaccctgcctgaggagctgcggccctacgtgcccctcttctgcagcgtgctgaccaacccctgctttgaggaggaggagcacttcaaggtgctggtgaagatgacagcccaggagctggccaacggcatcccagattctggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagcggcggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctacggcggcggggccaagctgagccacaacggcatcttcaccctgtacagctacagagaccccaacaccatcgagaccctgcagagctttgggaaggctgtggactgggccaagagcggcaagttcacccagcaggacattgatgaggccaagctgagcgtcttcagcacagtggatgcccctgtggcccccagcgacaagggcatggaccacttcctgtatggcctgagtgatgagatgaagcaggcccaccgggagcagctgtttgctgtgtcccatgacaagctgctggccgtgtctgaccgctacctgggcaccgggaagagcacccacggcctggccatcctgggccctgagaaccccaagatcgccaaggaccccagctggatcatccagtag

SEQ ID NO: 40733 - DNA, 780 bp, Artificial Sequence
  Description of Artificial Sequence: Synthetic coding sequence
tgattcagcagcctgtgcctggacaggaacctgcctgacatgatgcagctgtggagcgagatcttcaacaacccctgctttgaggaggaggagcacttcaaggtgctggtgaagatgacagcccaggagctggccaacggcatcccagattctggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagcggcggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccaggaagaggcctgtgtgtggcagcggggacctgggcctcatcagcccccgggccagcagccgcagcctgtgcctgtgctgccggcccagccaccactgcctgccccggctgctgtctgaggtggatgtgttctag

SEQ ID NO: 40734 - DNA, 555 bp, Artificial Sequence
  Description of Artificial Sequence: Synthetic coding sequence
aagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctatggaggaggagccaagctgagccacaacggcatcttcaccctgtacagctacagagaccccaacaccatcgagaccctgcagagctttgggaaggctgtggactgggccaagagcggcaagttcacccagcaggacattgatgaggccaagctgtctgtgttcagcacagtggatgcccctgtggcccccagcgacaagggcatcctgagcatcaccgtgcgcatcagcacccacagcctgacagatgatgtggccgtgttccaggtgcccggcatgcacggccaggagcactag

SEQ ID NO: 40735 - DNA, 534 bp, Artificial Sequence
  Description of Artificial Sequence: Synthetic coding sequence
atgaactggtttggcagcaacttcttccgctgcccagaggacctgagcctgctgaacatctacagccccctgctgagccacatgagcagtgaagatgagcacttcatcagcaacctgcggggccacgtgcctgccagcgctgtggtgaagcagcctgtgcggggggccagcggccgcaccaccatcacagccatcgtgcagacaggaggcggctggagcacaggcctcttctctgtgtgccgggaccggcgcatctgcttctgtggcctcttctgccccatgtgcctggagtgtgacatcgcccggcactacggggagtgcctgtgctggcccctgctgcccggcagcacctttgccctgcgcatcggcacccgggagcggcacaagatccagggcaccctgtgtgaggactggctggccgtgcactgctgctgggccttcagcatctgccaggtggcccgggagctgaagatgaggaccagccaggtgtatgagatctgtgctgtgcccatgaccaaggacaccctggtgtag

SEQ ID NO: 40736 - DNA, 348 bp, Artificial Sequence
  Description of Artificial Sequence: Synthetic coding sequence
atgcaggcccaggcccctgtggtggtggtgacccagcccggggtgggccctggccctgccccccagaacagcaactggcagacaggcatgtgtgactgcttcagtgactgtggggtgtgcctgtgtggcaccttctgcttcccctgcctgggctgccaggtggccgctgacatgaatgaatgctgcctgtgtggcacctctgtggccatgaggaccctgtaccgcaccaggtatggcatccctggcagcatctgtgatgactacatggccaccctgtgctgcccccactgcaccctgtgccagatcaagagggacatcaacagaagaagagccatgaggaccttctag

SEQ ID NO: 40737 - DNA, 348 bp, Artificial Sequence; identical to SEQ ID NO: 40736
  Description of Artificial Sequence: Synthetic coding sequence

SEQ ID NO: 40738 - DNA, 348 bp, Artificial Sequence; identical to SEQ ID NO: 40736
  Description of Artificial Sequence: Synthetic coding sequence

SEQ ID NO: 40739 - DNA, 348 bp, Artificial Sequence; identical to SEQ ID NO: 40736
  Description of Artificial Sequence: Synthetic coding sequence

SEQ ID NO: 40740 - DNA, 1893 bp, Artificial Sequence
  Description of Artificial Sequence: Synthetic coding sequence
atggatgagatggccaccacccagatcagcaaggatgagctggatgagctgaaggaggcctttgccaaggtggacctgaacagcaatggcttcatctgtgactatgagctgcacgagctgttcaaggaggccaacatgcccctgcccggctacaaggtgcgggagatcatccagaagctgatgctggatggagacaggaacaaggatggcaagatcagctttgatgaatttgtgtacatcttccaggaggtgaagagcagtgacatcgccaagaccttcaggaaggccatcaacaggaaggagggcatctgtgccctgggcggcaccagcgagctgagcagcgagggcacccagcacagctacagcgaggaggagaagtatgcctttgtgaactggatcaacaaggccctggagaatgaccctgactgcagacatgtgatccccatgaaccccaacacagatgacctcttcaaggctgtgggagatggcatcgtgctgtgcaagatgatcaacctgtctgtgcctgacaccattgatgagcgggccatcaacaagaagaagctgacccccttcatcatccaggagaacctgaacctggccctgaacagcgccagcgccatcggctgccacgtggtgaacatcggggctgaggacctgcgggccggcaagccccacctggtgctgggcctgctgtggcagatcatcaagattggcctgtttgctgacatcgagctgagcagaaatgaggccctggccgccctgctgagagatggagagaccctggaggagctgatgaagctgagccctgaggagctgctgctgcgctgggccaacttccacctggagaacagcggctggcagaagatcaacaacttctctgctgacatcaaggacagcaaggcctacttccacctgctgaaccagatcgcccccaagggccagaaggagggggagcccagaattgacatcaacatgagcggcttcaatgaaacagatgacctgaagagagctgagagcatgctgcagcaggccgacaagctgggctgccggcagtttgtgaccccagcagatgtggtgtctggcaaccccaagctgaacctggcctttgtggccaacctcttcaacaagtacccagccctgaccaagccagagaaccaggacatcgactggaccctgctggagggggagacccgggaggagaggaccttcaggaactggatgaacagcctgggcgtgaacccccacgtgaaccacctgtatgctgacctgcaggatgccctggtgatcctgcagctgtatgagcgcatcaaggtgcctgtggactggagcaaggtgaacaagccaccctaccccaagctgggcgccaacatgaagaagctggagaactgcaactatgctgtggagctgggcaagcacccagccaagttcagcctggtgggcattggaggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggcccggcgcatcggggcccgggtgtatgccctgcctgaggacctggtggaggtgaagcccaagatggtgatgacagtgtttgcctgcctgatgggccggggcatgaagagggtgtag

SEQ ID NO: 40741 - DNA, 3849 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagaggatcaccttcaacttccgggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccccagaggagctgaccctgctgctgatcaagctgcggcggcagcaggccgagctgagcagcatccgggagcacaccctggcccagctgatgcagctgaagctggaggcccacagccccaagaatgagatcctgagccaccacctgcagaggaacaccatctacctggaccaccagatgaaggaaaatgagcccatcatcaccatggtgcacaccatgattgaaaattctgccctgcggccccagctgtaccagcagttcctgcggcagaagagcaagatcagcctgtactgcctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcacgccgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagaatctgctggcatccagagggcccagatccagaaggagctgtggaggatccaggatgtgatggagggcctgagcaagcacaagcagcagaggggcaccacagaaattggcatgattggcagcaagcccttcagcacagtgaagtacaagaatgaggaggaggaggtggtgcccccccggccccccctgcccaggagctatgacttcacagagcagccccccatcatcccccccctgcccagcgacagcagcagcctgctgtgctacagccggggccctgtgcacctgcctgaggagaagaagatgtaccaggtgcagggctaccccagaaatggcagccactgcggccctgactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40742 - DNA, 231 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaactag

SEQ ID NO: 40743 - DNA, 2382 bp, Artificial Sequence
  Description of Artificial Sequence: Synthetic coding sequence
atgcccctgcccggcggcctgtggtggctgctgtgctgccggcggggcttcaccctgctgcaccgggactatggagatggagagctgtctggagatggagatgaagatgaagatgaggagacctttgagctgcggacccccagccctgctgggggcggccggggccccctggaggtgaccctgacccagcctgtgcgcagcggccctgtgagcaaccggctgcagagctgggaggagacctggagcctcatccctgagaagggcctgcctgaagatgatcctgacatcgtggtgaagggctggctgtaccgggagccccggggcggcggggcccggccctggctgcccccccggcgggcctggtttgtgctgacccgggacagcctggaccagttcagcagcagtggaaaaggagcccggcggctgggcagcctggtgctgaccagcctgtgcagcgtgacaggccctgagaggaggaggaaggagaccggcctgtggagcgtgacagtgtctggcaggaagcacagcgtgcggctgtgcagcccccggcaggccgaggccgagcgctggggcgtggccctgcgggaggtgattgccagcaaggcccccctggagacccccacccagctgctgctgcgggacatccaggagagctgtggggaccctgaggccgtggccctgatctacctgaggaaccccatcctgcggcacaccagcggggccctgtatgcccccctgctgcccctgccctatggagtgtctgcccctggccctggctacgcccccctgcgggaggaggccgtgcggctcttcctggccctgcaggccctggagggcgcccggcggcccggccccctgatgcagggcgtgctgcagacctgccgggacctgcctgccctgagagatgagctgttcctgcagctggccaagcagaccagcggccctgctggccccccaggcctgcctgccacccaggaccctgctgccctgcgctactggcagctgctgacctgcatgagctgcaccttccggcctggaggagctgtgcggggccacctgctgggccacctggagaggacagagcaggccctgcctgattctgagctggccgagtatgcccgcttcatcaggaaggccctgggccgcacccggggccgggagctggtgcccagcctggccgagatcagcgccctgagccagaggcaggagctgctgtgcaccgtgcactgccctggagctggggcctgtgctgtggccatcgacagccacaccacagctggggaggtggcccgggagctggtgggccgcctgggcctggcccggagcagaaatgcctttgccctgtatgagcagagaggagcccaggagcgggccctggccggcggcaccctggtggctgatgtgctgaccaggtttgagaacctggccgctgaggaggccggcctggaggacagcccagacagcggctggaggctgtgcctgcggctgcacggccccctgcaccctgagggcctgagcccagatggccacgagctgcccttcctgtttgagcaggcccacgccctgctgctgcggggccggcccccacctccagatgacaccctgcgggccctggccgccctgcggctgcagagcctgcagagggacttcagcccccgggtgcccctgccccggctggaccggctgctgcccccaccagcccccccaagagaagatcctccccggcccaccccccggcccccaccttctgctgccctgctggccggggccctgtggagccctggcctggccaagagaagagctgagcgggccaggagaggaggagctggccgcacagctggcagcatcgcccgggagggcggcggcggggccggcacagctgctgctgtgctgggcggctggaagaggctgcggggcatgggccgggcagaggccatggccgcctacctggccctggccgcccagtgccccggctttggagctgcccgctatgatgtgctggagctgagcacagagcccggccgcggggccccccagaagctgtgcctgggcctgggcgccaaggccatgagcctgagcaggcctggagaaacagagcccatccacagcgtgtcctatggccacgtggccgcctgccagctgatgggcccccacaccctggccctgcgggtgggggagagccagctgctgctgcagagcccccaggtggaggagatcatgcagctggtgaatgcctacctggccaaccccagccctgagcggccctgcagcagcagcagccccccctgccaggacctgcctgacaccagcccccccagccagaggcctggcctggatgagccccagggccagagcggctgcctgggccagctgcaggactag

SEQ ID NO: 40744 - DNA, 450 bp, Artificial Sequence
  Description of Artificial Sequence: Synthetic coding sequence
atgagatacaatgagaaggagctgcaggccctgagccggcagcctgctgagatggctgctgagctgggcatgaggggccccaagaagggctctgtgctgaagaggcggctggtgaagctggtggtgaacttcctgttctacttcagaacagatgaagctgagcctgtgggcgccctgctgctggagcgctgccgggtggtgcgggaggagcccggcaccttcagcatctccttcatcgaggaccctgagaggaagtaccactttgaatgtagcagcgaggagcagtgccaggagtggatggaggccctgcggcgggccagctatgagttcatgaggaggagcctcatcttctacagaaatgagatcaggaaggtgacaggcaaggaccccctggagcagtttggcatcagcgaggaggcccgcttccagctgagcggcctgcaggcctag

SEQ ID NO: 40745 - DNA, 3351 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcaccacagagatcggcatgattggcagcaagcccttcagcacagtgaagtacaagaatgaaggaccagactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40746 - DNA, 1953 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagacctggggccgggagaaggtggccacagccactggagctgctgaggccgtggccagtgacacccacctgcccaggacaggcagcagcagccccagcctgctgtgtgtgtag

SEQ ID NO: 40747 - DNA, 3540 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcaccacagagatcggcatgattggcagcaagcccttcagcacagtgaagtacaagaatgaggaggaggaggtggtgccccccaggcctcccctgcccaggagctatgacttcacagagcagccccccatcatcccccccctgcccagcgacagcagcagcctgctgtgctacagccggggccctgtgcacctgcctgaggagaagaagatgtaccaggtgcagggctaccccagaaatggcagccactgcggccctgactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatcagaagacaccagcaggcctgcctgcgggagaagaagaagggcctgaatgtcatcggggccagtgaccagagccccctgcagagccccagcaacctgcgggacaaccccttccgcaccacccagaccaggagaagagatgacaaggagctggacacagccatccgggagaatgatgtgaagccagaccacgagaccccagccacagagatcgtgcagctgaaggagacagagccccagaatgtggacttcagcaaggagctgaagaagacagagaacatctcctatgagatgctgtttgagcctgagcccaacggggtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40748 - DNA, 3525 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccccagaggagctgaccctgctgctgatcaagctgcggcggcagcaggccgagctgagcagcatccgggagcacaccctggcccagctgatgcagctgaagctggaggcccacagccccaagaatgagatcctgagccaccacctgcagaggaacaccatctacctggaccaccagctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcaccacagagatcggcatgattggcagcaagcccttcagcacagtgaagtacaagaatgaaggaccagactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40749 - DNA, 3183 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcaccacagagatcggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40750 - DNA, 963 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagaagaagaagaagaagaagaagaagtag

SEQ ID NO: 40751 - DNA, 3318 bp, Artificial Sequence
  Description of Artificial Sequence: Synthetic coding sequence
atgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccatgaaggaaaatgagcccatcatcaccatggtgcacaccatgattgaaaattctgccctgcggccccagctgtaccagcagttcctgcggcagaagagcaagatcagcctgtactgcctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcacgccgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagaatctgctggcatccagagggcccagatccagaaggagctgtggaggatccaggatgtgatggagggcctgagcaagcacaagcagcagaggggcatgattggcagcaagcccttcagcacagtgaagtacaagaatgaggaggaggaggtggtgccccccaggcctcccctgcccaggagctatgacttcacagagcagccccccatcatcccccccctgcccagcgacagcagcagcctgctgtgctacagccggggccctgtgcacctgcctgaggagaagaagatgtaccaggtgcagggctaccccagaaatggcagccactgcggccctgactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatcagaagacaccagcaggcctgcctgcgggagaagaagaagggcctgaatgtcatcggggccagtgaccagagccccctgcagagccccagcaacctgcgggacaaccccttccgcaccacccagaccaggagaagagatgacaaggagctggacacagccatccgggagaatgatgtgaagccagaccacgagaccccagccacagagatcgtgcagctgaaggagacagagccccagaatgtggacttcagcaaggagctgaagaagacagagaacatctcctatgagatgctgtttgagcctgagcccaacggggtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40752 - DNA, 3525 bp, Artificial Sequence; identical to SEQ ID NO: 40748
  Description of Artificial Sequence: Synthetic coding sequence

SEQ ID NO: 40753 - DNA, 1194 bp, Artificial Sequence
  Description of Artificial Sequence: Synthetic coding sequence
tacaccctggagcaggccctgctgagcgccagccaggagattgagatgcacgccgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagaatctgctggcatccagagggcccagatccagaaggagctgtggaggatccaggatgtgatggagggcctgagcaagcacaagcagcagaggggcaccacagaaattggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatcagaagacaccagcaggcctgcctgcgggagaagaagaagggcctgaatgtcatcggggccagtgaccagagccccctgcagagccccagcaacctgcgggacaaccccttccgcaccacccagaccaggagaagagatgacaaggagctggacacagccatccgggagaatgatgtgaagccagaccacgagaccccagccacagagatcgtgcagctgaaggagacagagccccagaatgtggacttcagcaaggagctgaagaagacagagaacatctcctatgagatgctgtttgagcctgagcccaacggggtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40754 - DNA, 2625 bp, Artificial Sequence
  Description of Artificial Sequence: Synthetic coding sequence
atgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcaccacagagatcggcatgattggcagcaagcccttcagcacagtgaagtacaagaatgaaggaccagactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40755 - DNA, 3555 bp, Artificial Sequence
  Description of Artificial Sequence: Synthetic coding sequence
atggctgctgacctgaacctggagtggatcagcctgcccaggtcctggacctacggcatcacccggggcggccgggtcttcttcatcaatgaggaggccaagagcaccacctggctgcaccctgtgactggagaggccgtggtgacaggccaccggcggcagagcacagacctgcccaccggctgggaggaggcctacacctttgagggcgcccgctactacatcaaccacaatgaaaggaaggtgacctgcaagcaccctgtgacaggccagcccagccaggacaactgcatctttgtggtgaatgagcagacagtggccaccatgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagaggatcttcttcagtgacttccgggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgagagcggcagcgcctgcccagcccagacagtgcactaccggcccatcaacctgagcagcagcgagaacaagatcgtgaatgtgtccctggccgacctgcggggcggcaaccggcccaacacaggccccctgtacacagaggccgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagagaagatccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgaccggcggcaccgggcccaccaccccaagcacgtgtatgtgcctgacagaagatctgtgcctgctggcctgaccctgcagagcgtgagcccccagagcctgcagggcaagaccccagaggagctgaccctgctgctgatcaagctgcggcggcagcaggccgagctgagcagcatccgggagcacaccctggcccagctgatgcagctgaagctggaggcccacagccccaagaatgagatcctgagccaccacctgcagaggaacaccatctacctggaccaccagatgaaggaaaatgagcccatcatcaccatggtgcacaccatgattgagaacagcgccctgcggccccagctgtaccagcagttcctgcggcagaagagcaagatcagcctgtactgcctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcatgctgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagagagcgctggcatccagagggcccagatccagaaggagctgtggaggatccaggatgtgatggagggcctgagcaagcacaagcagcagaggggcatgattggcagcaagcccttcagcacagtgaagtacaagaatgaggaggaggaggtggtgcccccccggccccccctgcccaggagctatgacttcacagagcagccccccatcatcccccccctgcccagcgacagcagcagcctgctgtgctacagccggggccctgtgcacctgcctgaggagaagaagatgtaccaggtgcagggctaccccagaaatggcagccactgcggccctgactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggactag

SEQ ID NO: 40756 - DNA, 3297 bp, Artificial Sequence
  Description of Artificial Sequence: Synthetic coding sequence
atgaccagcgaggagaagaaggagcggcccatctccatgatcaatgaggccagcaactacaacgtgaccagtgactatgctgtgcaccccatgagccctgtgggccgcaccagccgggccagcaagaaggtgcacaactttgggaagaggagcaacagcatcaagaggaaccccaatgcccctgtggtgcggcggggctggctgtacaagcaggacagcacaggcatgaagctgtggaagaagcgctggtttgtgctgagtgacctgtgcctcttctactacagagatgagaaggaggagggcatcctgggcagcatcctgctgcccagcttccagatcgccctgctgaccagcgaggaccacatcaacagaaaatatgccttcaaggccgcccaccccaacatgaggacctactacttctgcacagacaccgggaaggagatggagctgtggatgaaggccatgctggatgctgccctggtgcagacagagcctgtgaagagggtggacaagatcaccagtgaaaatgcccccaccaaggagaccaacaacatccccaaccaccgggtgctgatcaagccagagatccagaacaaccagaagaacaaggagatgagcaagattgaggagaagaaggccctggaggccgagaagtatggcttccagaaggatggccaggaccggcccctgaccaagatcaacagcgtgaagctgaacagcctgcccagtgaatatgaaagtggcagcgcctgcccagcccagacagtgcactaccggcccatcaacctgagcagcagcgagaacaagatcgtgaatgtgtccctggccgacctgcggggcggcaaccggcccaacacaggccccctgtacacagaagctgacagagtcatccagaggaccaacagcatgcagcagctggagcagtggatcaagatccagaagggccggggccacgaggaggagacccggggcgtcatctcctaccagaccctgcccaggaacatgcccagccaccgggcccagatcatggcccgctacccagagggctaccgcaccctgcccaggaacagcaagaccaggcctgagagcatctgcagcgtgacccccagcacccatgacaagaccctgggccctggagctgaggagaagaggaggtccatgagagatgacaccatgtggcagctgtatgagtggcagcagaggcagttctacaacaagcagagcaccctgcccaggcacagcaccctgagcagccccaagaccatggtgaacatcagtgaccagaccatgcacagcatccccaccagccccagccacggcagcattgctgcctaccagggctacagcccccagaggacctacagaagtgaggtgagcagccccatccagagaggagatgtgaccatcgacagaagacaccgggcccaccaccccaagcacgtgtatgtgcctgaccggcgctctgtgcctgctggcctgaccctgcagagcgtgagcccccagagcctgcagggcaagaccatgaaggaaaatgagcccatcatcaccatggtgcacaccatgattgaaaattctgccctgcggccccagctgtaccagcagctgagccaggatgagggccggggcaccctgtacaagtacagacctgaggaggtggacattgatgccaagctgagccggctgtgtgagcaggacaaggtggtgcacgccctggaggagaagctgcagcagctgcacaaggagaagtacaccctggagcaggccctgctgagcgccagccaggagattgagatgcacgccgacaacccagctgccatccagacagtggtgctgcagagagatgacctgcagaatggcctgctgagcacctgccgggagctgagccgggccacagctgagctggagcgggcctggagagaatatgacaagctggagtatgatgtgacagtgaccaggaaccagatgcaggagcagctggaccacctgggggaggtgcagacagaatctgctggcatccagagggcccagatccagaaggagctgtggaggatccaggatgtgatggagggcctgagcaagcacaagcagcagaggggcaccacagaaattggcatgattggcagcaagcccttcagcacagtgaagtacaagaatgaggaggaggaggtggtgcccccccggccccccctgcccaggagctatgacttcacagagcagccccccatcatcccccccctgcccagcgacagcagcagcctgctgtgctacagccggggccctgtgcacctgcctgaggagaagaagatgtaccaggtgcagggctaccccagaaatggcagccactgcggccctgactaccgcctgtacaagtctgagcctgagctgaccaccgtggccgaggtggatgagagcaatggagaggagaagtctgagcctgtgtctgaaattgagacctctgtggtgaagggcagccacttccctgtgggcgtggtgcccccccgggccaagagccccaccccagagagcagcaccatcgccagctatgtgaccctgaggaagaccaagaagatgatggacctgaggacagagcggcccaggtctgctgtggagcagctgtgcctggccgagagcacccggcccaggatgacagtggaggagcagatggagcgcatccgccgccaccagcaggcctgcctgcgggagaagaagaagggcctgaatgtgattggagccagtgaccagagccccctgcagagccccagcaacctgcgggacaaccccttccgcaccacccagaccaggagaagagatgacaaggagctggacacagccatcagagaaaatgatgtgaagccagaccacgagaccccagccacagaaattgtgcagctgaaggagacagagccccagaatgtggacttcagcaaggagctgaagaagacagagaacatctcctatgagatgctgtttgagcctgagcccaatggagtgaacagcgtggagatgatggacaaggagaggaacaaggacaagatgccagaagatgtgaccttcagcccccaggatgagacccagacagccaaccacaagccagaggagcaccctgaggagaacaccaagaacagcgtggatgagcaggaggagaccgtcatctcctatgagagcaccccagaggtgtcccggggcaaccagaccatggctgtgaagagcctgagccccagccctgagagcagcgccagccctgtgcccagcacccagccccagctgacagagggcagccacttcatgtgtgtgtag

SEQ ID NO: 40757 - DNA, 3147 bp, Artificial Sequence
  Description of Artificial Sequence: Synthetic coding sequence
atgagcaacaagacaggaggcaagaggcctgccaccaccaacagcgacatccccaaccacaacatggtgtctgaggtgcccccagagcggcccagcgtgcgggccaccaggacagccaggaaggctgtggccttcggcaagaggagccacagcatgaagaggaaccccaatgcccctgtgaccaaggccggctggctgttcaagcaggccagcagcggcgtgaagcagtggaacaagcgctggtttgtgctggtggaccgctgcctcttctactacaaggatgagaaggaggagagcatcctgggcagcatccccctgctgtccttccgggtggccgctgtgcagcccagcgacaacatcagcaggaagcacaccttcaaggccgagcacgccggcgtgaggacctacttcttctctgctgagagccctgaggagcaggaggcctggatccaggccatgggagaggccgcccgggtgcagatccccccagcccagaagtctgtgccccaggccgtgcgccacagccatgagaagccagattctgaaaatgtgccccccagcaagcaccaccagcagcccccccacaacagcctgcccaagccagagcctgaggccaagaccagaggagaaggagatggccggggctgtgagaaggccgagaggaggcctgagaggcctgaggtgaagaaggagccccctgtgaaggccaacggcctgcctgctggccctgagcccgccagcgagcccggcagcccctacccagagggcccccgggtgcctgggggcggggagcagcctgcccagcccaacggctggcagtaccacagccccagccggcccggcagcacagccttccccagccaggatggagagaccggcggccaccggcgctccttcccccccaggaccaacccagacaagatcgcccagaggaagagctccatgaaccagctgcagcagtgggtgaacctgcggcggggcgtgcccccacctgaggacctgcggagccccagccgcttctaccctgtgtccagaagagtgcctgagtactacggcccctacagcagccagtacccagatgactaccagtactacccacctggggtgcggcctgagagcatctgcagcatgcctgcctatgaccgcatcagccccccctgggccctggaggacaagagacatgccttcagaaatggaggcggccctgcctaccagctgcgggagtggaaggagcccgccagctatggccggcaggatgccaccgtgtggatccccagccccagccggcagcctgtgtactatgatgagctggatgctgccagcagcagcctgcggcggctgagcctgcagcccaggagccacagcgtgcccaggagccccagccagggcagctacagccgggcccgcatctacagccctgtgcgcagccccagcgccaggtttgagcggctgcccccaagaagtgaggacatctatgctgaccctgctgcctacgtgatgagaagaagcatcagcagccccaaggtgcccccctacccagaggtgttccgggacagcctgcacacctacaagctgaatgagcaggacacagacaagctgctgggcaagctgtgtgagcagaacaaggtggtgcgggagcaggaccggctggtgcagcagctgcgggcagagaaggagagcctggagagcgccctgatgggcacccaccaggagctggagatgtttggcagccagcctgcctacccagagaagctgcggcacaagaaggacagcctgcagaaccagctgatcaacatccgggtggagctgagccaggccaccacagccctgaccaacagcaccattgaatatgagcacctggagagcgaggtgtctgccctgcatgatgacctgtgggagcagctgaacctggacacccagaatgaggtgctgaaccggcagatccagaaggagatctggaggatccaggatgtgatggagggcctgaggaagaacaaccccagccggggcacagacacagccaagcaccggggcggcctgggccccagcgccacctacagcagcaacagccctgccagccccctgagcagcgccagcctgaccagccccctgagccccttcagcctggtgtctggcagccagggcagccccaccaagccaggcagcaatgagcccaaggccaactatgagcagagcaagaaggacccccaccagaccctgcccctggacaccccccgggacatcagcctggtgcccacccggcaggaggtggaggccgagaagcaggccgccctgaacaaggtgggcgtggtgccccccaggaccaagagccccacagatgatgaggtgacccccagcgctgtggtgagaagaaatgccagcggcctgaccaacggcctgagcagccaggagcggcccaagtctgctgtgtttcctggagagggcaaggtgaagatgtctgtggaggagcagattgacaggatgagaagacaccagagcggctccatgagggagaagaggaggagcctgcagctgcctgccagccctgccccagaccccagccccaggcctgcctacaaggtggtgagaagacacaggagcatccacgaggtggacatcagcaacctggaggccgccctgcgggcagaggagcccggcggccacgcctatgagaccccccgggaggagatcgcccggctgaggaagatggagctggagccccagcactatgatgtggacatcaacaaggagctgagcaccccagacaaggtgctgatccctgagcgctacatcgacctggagccagacacccccctgagccctgaggagctgaaggagaagcagaagaaggtggagcgcatcaagaccctcatcgccaagagctccatgcagaatgtggtgcccatcggggagggggacagcgtggatgtgccccaggacagcgagagccagctgcaggagcaggagaagagaattgagatcagctgtgccctggccacagaggccagccggcggggccgcatgctgtctgtgcagtgtgccacccccagcccccccaccagccctgccagccctgcccccccagccaaccccctgagcagcgagagccccagaggagctgacagcagctacaccatgagggtgtag

SEQ ID NO: 40758 - DNA, 321 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagtatgactacctgggggacagaagacctgtgcctgctggcctcttcccctacaactacccacccagccccaccgtgcatgacaagatggtgcccccctacccagaggtgttccgggacagcctgcacacctacaagctgaatgagcaggacacagacaagctgctgggcaagctgtgtgagcagaacaaggtgtag

SEQ ID NO: 40759 - DNA, 3207 bp, Artificial Sequence
  Description of Artificial Sequence: Synthetic coding sequence
atgagcaacaagacaggaggcaagaggcctgccaccaccaacagcgacatccccaaccacaacatggtgtctgaggtgcccccagagcggcccagcgtgcgggccaccaggacagccaggaaggctgtggccttcggcaagaggagccacagcatgaagaggaaccccaatgcccctgtgaccaaggccggctggctgttcaagcaggccagcagcggcgtgaagcagtggaacaagcgctggtttgtgctggtggaccgctgcctcttctactacaaggatgagaaggaggagagcatcctgggcagcatccccctgctgtccttccgggtggccgctgtgcagcccagcgacaacatcagcaggaagcacaccttcaaggtgacagtgtgctgggtggatgaggccgaggccagcagcacccgctgcctgagcccccaggccgagcacgccggcgtgaggacctacttcttctctgctgagagccctgaggagcaggaggcctggatccaggccatgggagaggccgcccgggtgcagatccccccagcccagaagtctgtgccccaggccgtgcgccacagccatgagaagccagattctgaaaatgtgccccccagcaagcaccaccagcagcccccccacaacagcctgcccaagccagagcctgaggccaagaccagaggagaaggagatggccggggctgtgagaaggccgagaggaggcctgagaggcctgaggtgaagaaggagccccctgtgaaggccaacggcctgcctgctggccctgagcccgccagcgagcccggcagcccctacccagagggcccccgggtgcctgggggcggggagcagcctgcccagcccaacggctggcagtaccacagccccagccggcccggcagcacagccttccccagccaggatggagagaccggcggccaccggcgctccttcccccccaggaccaacccagacaagatcgcccagaggaagagctccatgaaccagctgcagcagtgggtgaacctgcggcggggcgtgcccccacctgaggacctgcggagccccagccgcttctaccctgtgtccagaagagtgcctgagtactacggcccctacagcagccagtacccagatgactaccagtactacccacctggggtgcggcctgagagcatctgcagcatgcctgcctatgaccgcatcagccccccctgggccctggaggacaagagacatgccttcagaaatggaggcggccctgcctaccagctgcgggagtggaaggagcccgccagctatggccggcaggatgccaccgtgtggatccccagccccagccggcagcctgtgtactatgatgagctggatgctgccagcagcagcctgcggcggctgagcctgcagcccaggagccacagcgtgcccaggagccccagccagggcagctacagccgggcccgcatctacagccctgtgcgcagccccagcgccaggtttgagcggctgcccccaagaagtgaggacatctatgctgaccctgctgcctacgtgatgagaagaagcatcagcagccccaaggtgcccccctacccagaggtgttccgggacagcctgcacacctacaagctgaatgagcaggacacagacaagctgctgggcaagctgtgtgagcagaacaaggtggtgcgggagcaggaccggctggtgcagcagctgcgggcagagaaggagagcctggagagcgccctgatgggcacccaccaggagctggagatgtttggcagccagcctgcctacccagagaagctgcggcacaagaaggacagcctgcagaaccagctgatcaacatccgggtggagctgagccaggccaccacagccctgaccaacagcaccattgaatatgagcacctggagagcgaggtgtctgccctgcatgatgacctgtgggagcagctgaacctggacacccagaatgaggtgctgaaccggcagatccagaaggagatctggaggatccaggatgtgatggagggcctgaggaagaacaaccccagccggggcacagacacagccaagcaccggggcggcctgggccccagcgccacctacagcagcaacagccctgccagccccctgagcagcgccagcctgaccagccccctgagccccttcagcctggtgtctggcagccagggcagccccaccaagccaggcagcaatgagcccaaggccaactatgagcagagcaagaaggacccccaccagaccctgcccctggacaccccccgggacatcagcctggtgcccacccggcaggaggtggaggccgagaagcaggccgccctgaacaaggtgggcgtggtgccccccaggaccaagagccccacagatgatgaggtgacccccagcgctgtggtgagaagaaatgccagcggcctgaccaacggcctgagcagccaggagcggcccaagtctgctgtgtttcctggagagggcaaggtgaagatgtctgtggaggagcagattgacaggatgagaagacaccagagcggctccatgagggagaagaggaggagcctgcagctgcctgccagccctgccccagaccccagccccaggcctgcctacaaggtggtgagaagacacaggagcatccacgaggtggacatcagcaacctggaggccgccctgcgggcagaggagcccggcggccacgcctatgagaccccccgggaggagatcgcccggctgaggaagatggagctggagccccagcactatgatgtggacatcaacaaggagctgagcaccccagacaaggtgctgatccctgagcgctacatcgacctggagccagacacccccctgagccctgaggagctgaaggagaagcagaagaaggtggagcgcatcaagaccctcatcgccaagagctccatgcagaatgtggtgcccatcggggagggggacagcgtggatgtgccccaggacagcgagagccagctgcaggagcaggagaagagaattgagatcagctgtgccctggccacagaggccagccggcggggccgcatgctgtctgtgcagtgtgccacccccagcccccccaccagccctgccagccctgcccccccagccaaccccctgagcagcgagagccccagaggagctgacagcagctacaccatgagggtgtag

SEQ ID NO: 40760 - DNA, 315 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagatgtctgagagcgagaccctcatctccatggtgaacaggatggtggagaacagcagccccaggagccagctgttcatgcaggtgcccccctacccagaggtgttccgggacagcctgcacacctacaagctgaatgagcaggacacagacaagctgctgggcaagctgtgtgagcagaacaaggtgtag

SEQ ID NO: 40761 - DNA, 456 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagtatgactacctgggggacagaagacctgtgcctgctggcctcttcccctacaactacccacccagccccaccgtgcatgacaagatggatgagctgctggacctgcagctgcagaggaacctggagtacctggaccagcagatgtctgagagcgagaccctcatctccatggtgaacaggatggtggagaacagcagccccaggagccagctgttcatgcaggtgcccccctacccagaggtgttccgggacagcctgcacacctacaagctgaatgagcaggacacagacaagctgctgggcaagctgtgtgagcagaacaaggtgtag

SEQ ID NO: 40762 - DNA, 375 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagtatgactacctgggggacagaagacctgtgcctgctggcctcttcccctacaactacccacccagccccaccgtgcatgacaagatggatgagctgctggacctgcagctgcagaggaacctggagtacctggaccagcaggtgcccccctacccagaggtgttccgggacagcctgcacacctacaagctgaatgagcaggacacagacaagctgctgggcaagctgtgtgagcagaacaaggtgtag

SEQ ID NO: 40763 - DNA, 252 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagtatgactacctgggggacagaagacctgtgcctgctggcctcttcccctacaactacccacccagccccaccgtgcatgacaagatgaagctgctgggcaagctgtgtgagcagaacaaggtgtag

SEQ ID NO: 40764 - DNA, 402 bp, Artificial Sequence
  Description of Artificial Sequence: Synthetic coding sequence
cgggcccgcatctacagccctgtgcgcagccccagcgccaggtttgagcggctgcccccaagaagtgaggacatctatgctgaccctgctgcctacgtgatgagaagaagcatcagcagccccaagtatgactacctgggggacagaagacctgtgcctgctggcctcttcccctacaactacccacccagccccaccgtgcatgacaagatgatgtctgagagcgagaccctcatctccatggtgaacaggatggtggagaacagcagccccaggagccagctgttcatgcaggtgcccccctacccagaggtgttccgggacagcctgcacacctacaagctgaatgagcaggacacagacaagctgctgggcaagctgtgtgagcagaacaaggtgtag

SEQ ID NO: 40765 - DNA, 1386 bp, Artificial Sequence
  Description of Artificial Sequence: Synthetic coding sequence
atgaacaactttggaaatgaggagtttgactgccacttcctggatgagggcttcaccgccaaggacatcctggaccagaagatcaatgaggtgagcagcagtgatgacaaggatgccttctacgtggccgacctgggggacatcctgaagaagcacctgcgctggctgaaggccctgccccgggtgacccccttctatgctgtgaagtgcaatgacagcaaggccatcgtgaagaccctggccgccactggaactggatttgactgtgccagcaagacagagatccagctggtgcagagcctgggcgtgcccccagagcgcatcatctatgccaacccctgcaagcaggtgtcccagatcaagtatgctgccaacaacggggtgcagatgatgacctttgattctgaggtggagctgatgaaggtggcccgggcccaccccaaggccaagctggtgctgagaattgccacagatgacagcaaggctgtgtgccgcctgtctgtgaagtttggagccaccctgcggaccagccggctgctgctggagcgggccaaggagctgaacattgatgtggtgggcgtgtccttccacgtgggcagcggctgcacagatcctgagacctttgtgcaggccatcagtgatgcccgctgtgtgtttgacatgggcgctgaggtgggcttctccatgtacctgctggacatcggcggcggcttccctggctctgaagatgtgaagctgaagtttgaggagatcaccggggtcatcaacccagccctggacaagtacttccccagcgacagcggcgtgcgcatcatcgccgagcccggccgctactacgtggccagcgccttcaccctggccgtgaacatcatcgccaagaagatcgtgctgaaggagcagacaggcagtgatgatgaagatgagagcagcgagcagaccttcatgtactacgtgaatgatggagtgtatggcagcttcaactgcatcctgtatgaccacgcccacgtgaagcccctgctgcagaagaggcccaagccagatgagaagtactacagcagcagcatctggggccccacctgtgatggcctggaccgcatcgtggagcgctgtgacctgcctgagatgcacgtgggggactggatgctgtttgagaacatgggcgcctacacagtggccgccgccagcaccttcaacggcttccagaggcccaccatctactacgtgatgagcggccctgcctggcagctgatgcagcagttccagaacccagacttccccccagaggtggaggagcaggatgccagcaccctgcctgtgtcctgtgcctgggagagcggcatgaagaggcaccgggccgcctgtgccagcgccagcatcaacgtgtag

SEQ ID NO: 40766 - DNA, 930 bp, Artificial Sequence
  Description of Artificial Sequence: Synthetic coding sequence
atggcctttgtgaagagcggctggctgctgcggcagagcaccatcctgaagcgctggaagaagaactggtttgacctgtggagcgatggccacctgatctactatgatgaccagacccggcagaacatcgaggacaaggtgcacatgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctggcctggaagttcaccctgcaggacagcaggaccaacacagcctacgtgggcagcgctgtgatgacagatgagacctctgtggtgagcagccccccaccctacacagcctatgctgccccagcccctgaggagctgcacagcaagggccccaagatccacaccaccaccagcgccaagacccaggccgtgctgcccacccgctgcttcttccccagcgagagccccatcagaagatctgtgcagatctctgtgctgctgcctgctgtgaacatcagaagacgcatcaagctgaccttcccccagcctgcccggccccgggcccccaggagcctgtgcctgtggcagacctggtttgctgggaagagggcccccagcctgcccacagctgccacagccccagccctgcccagctgccccagccccccagcccccagccaggccctgccccccagcctggccggctggaggagccccagcagcgcccccctgcccccagagcaggccctggcccccaggagcttccagctgagcaagcaccaggcccggccccggccccaccggcccggcaccccacctgtgcctgcctggccaggagtgcccccacctcctccagcccggcccccagccctgaggtag

SEQ ID NO: 40767 - DNA, 669 bp, Artificial Sequence
  Description of Artificial Sequence: Synthetic coding sequence
atggcctttgtgaagagcggctggctgctgcggcagagcaccatcctgaagcgctggaagaagaactggtttgacctgtggagcgatggccacctgatctactatgatgaccagacccggcagaacatcgaggacaaggtgcacatgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctggcctggaagttcaccctgcaggacagcaggaccaacacagcctacgtgggcagcgctgtgatgacagatgagacctctgtggtgagcagccccccaccctacacagcctatgctgccccagcccctgagcaggcctacggctacggcccctatggaggagcctacccacctggcacccaggtggtgtatgctgccaacggccaggcctatgctgtgccctaccagtacccctatgccggcctgtatggccagcagcctgccaaccaggtgatcatccgggagcgctacagagacaatgacagcgacctggccctgggcatgctggccggggccgccaccggcatggccctgggcagcctcttctgggtgttctag

SEQ ID NO: 40768 - DNA, 930 bp, Artificial Sequence; identical to SEQ ID NO: 40766
  Description of Artificial Sequence: Synthetic coding sequence

SEQ ID NO: 40769 - DNA, 669 bp, Artificial Sequence; identical to SEQ ID NO: 40767
  Description of Artificial Sequence: Synthetic coding sequence

SEQ ID NO: 40770 - DNA, 669 bp, Artificial Sequence; identical to SEQ ID NO: 40767
  Description of Artificial Sequence: Synthetic coding sequence

SEQ ID NO: 40771 - DNA, 537 bp, Artificial Sequence
  Description of Artificial Sequence: Synthetic coding sequence
atggcctttgtgaagagcggctggctgctgcggcagagcaccatcctgaagcgctggaagaagaactggtttgacctgtggagcgatggccacctgatctactatgatgaccagacccggcagaacatcgaggacaaggtgcacatgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctggcctggaagttcaccctgcaggacagcaggaccaacacagcctacgtgggcagcgctgtgatgacagatgagacctctgtggtgagcagccccccaccctacacagcctatgctgccccagcccctgaggacttcatggacagcagcctgctgaccaagagcagctttgagagcgccatcgagaccaccacagccacctggcactgggcctgctggcaggagcagccccgggcctggccctag

SEQ ID NO: 40772 - DNA, 513 bp, Artificial Sequence
  Description of Artificial Sequence: Synthetic coding sequence
atggcctttgtgaagagcggctggctgctgcggcagagcaccatcctgaagcgctggaagaagaactggtttgacctgtggagcgatggccacctgatctactatgatgaccagacccggcagaacatcgaggacaaggtgcacatgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctgctgatggccatgggccacacagtggtgaggacccggcaggagctgaagctgagcaccctgaggatgggccgcaggatgccctgccccaccagcacccacatgcaggacttcatggacagcagcctgctgaccaagagcagctttgagagcgccatcgagaccaccacagccacctggcactgggcctgctggcaggagcagccccgggcctggccctag

SEQ ID NO: 40773 - DNA, 525 bp, Artificial Sequence
  Description of Artificial Sequence: Synthetic coding sequence
atgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctggcctggaagttcaccctgcaggacagcaggaccaacacagcctacgtgggcagcgctgtgatgacagatgagacctctgtggtgagcagccccccaccctacacagcctatgctgccccagcccctgagcaggcctacggctacggcccctatggaggagcctacccacctggcacccaggtggtgtatgctgccaacggccaggcctatgctgtgccctaccagtacccctatgccggcctgtatggccagcagcctgccaaccaggtgatcatccgggagcgctacagagacaatgacagcgacctggccctgggcatgctggccggggccgccaccggcatggccctgggcagcctcttctgggtgttctag

SEQ ID NO: 40774 - DNA, 1521 bp, Artificial Sequence
  Description of Artificial Sequence: Synthetic coding sequence
atgttcaccagcaagagcaacagcgtgagccccagccccagcctggagcaggccgacagtgatgccctggacatcagcaccaaggtgcagctgtatggagtgctgtggaagaggcccttcggccggcccagcgccaagtggagccgccgcttcttcatcatcaaggagagcttcctgctgtactacagcgagagcgagaagaagagctttgagaccaacaagtacttcaacatccaccccaagggcgtcatccccctgggcggctgcctggtggagcccaaggaggagcccagcatgccctatgccatgaagatcagccaccaggacttccacggcaacatcctgctggccgctgagagcgagtttgagcagacccagtggctggagatgctgcaggagagcggcaaggtgacctggaagaatgcccagctgggggaggccatgatcaagagcctggaggcccagggcctgcagctggccaaggagaagcaggagtacctggacaagctgatggaggagacagaggagctgtgcctgcagcgggagcagcgggaggagctggagcggctgaaccaggtgctggaggccgagaagcagcagtttgaggaggtggtgcaggagctgaggatggagcaggagcagatcaagcgggagctggagctgacagcccgctgcctgaagggcgtggagcaggagaagaaggagctgcggcacctgacagagagcctgcagcagaccctggaggagctgagcattgagaagaagaagaccctggagatgctggaggagaatgaaaaccacctgcagaccctggccaaccagagcgagcagcccccaccttctgggggcctgcacagcaacctgcggcagatcgaggagaagatgcagcagctgctggaggagaagctgctggccgagaagaggatgaaggaaaatgaggagaggagccgggccctggaggaggagcgggagttctacagcagccagagccaggccctgcagaacagcctgcaggagctgacagctgagaagcagcaggccgagcgggagctgaaggccgaggtgaaggtgaggatggacctggagcggcggctgcgggaggccgagggcgccctgcggagcctggagcagggcctgaacagcaaggtgaggaacaaggagaaggaggagaggatgagagcagatgtgagccacctgaagcgcttctttgaggagtgcatcagaaatgctgagctggaggccaagatgcctgtgatcatgaagaacagcgtgtacatccacaaggccgccacccggcgcatcaagagctgccgcttccacagaagaagaagcagcacctcctggaatgacatgaagcccagccagagcttcatgaccagccagctggatgccaacaacatggaggagctgaaggaggtggccaagaggctgagccgggaccagcgcttccgggagagcatctaccacatcatggccacccagcccggggcccccagcgccctgagccggggcggcaagtag

SEQ ID NO: 40775 - DNA, 4158 bp, Artificial Sequence
  Description of Artificial Sequence: Synthetic coding sequence
atggagctgagtgacagcgacaggcctgtgtcctttggcagcaccagcagcagcgccagcagccgggacagccacggcagctttggcagcaggatgaccctggtgagcaacagccacatgggcctcttcaaccaggacaaggaggtgggcgccatcaagctggagctgatcccagcccggcccttcagcagcagcgagctgcagagggacaacccagccaccggccagcagaatgctgatgagggcagcgagcggcccccccgggcccagtggagggtggacagcaatggagcccccaagaccatcgctgacagcgccaccagccccaagctgctgtatgtggacagagtggtgcaggagatcctggagacagagaggacctacgtgcaggacctgaagagcatcgtggaggactacctggactgcatccgggaccagaccaagctgcccctgggcacagaggagaggtctgccctgtttggaaacatccaggacatctaccacttcaacagcgagctgctgcaggacctggagaactgtgaaaatgaccctgtggccatcgcagaatgttttgtgtccaagtctgaggagttccacatctacacccagtactgcaccaactaccccaggtctgtggccgtgctgacagagtgcatgaggaacaagatcctggccaagttcttccgggagcggcaggagaccctgaagcacagcctgcccctgggcagctacctgctgaagcctgtgcagaggatcctgaagtaccacctgctgctgcacgagattgagaaccacctggacaaggacacagagggctatgatgtggtgctggatgccatcgacaccatgcagagggtggcctggcacatcaatgacatgaagaggaagcatgaacatgctgtgcggctgcaggagatccagagcctgctgaccaactggaagggccctgacctgaccagctatggagagctggtgctggagggcaccttccgcatccagagggccaagaatgaaagaaccctcttcctgtttgacaagctgctgctgatcaccaagaagagagatgacaccttcacctacaaggcccacatcctgtgtggcaacctgatgctggtggaggtgatccccaaggagcccctgtccttctctgtgttccactacaagaaccccaagctgcagcacacagtgcaggccaagagccagcaggacaagaggctgtgggtgctgcacctgaagaggctcatcctggagaaccacgccgccaagatcccagccaaggccaagcaggccatcctggagatggatgccatccaccaccctggcttctgctacagccctgagggcggcaccaaggccctgtttggcagcaaggagggcagcgccccctaccgcctgcggaggaagtctgagcccagcagccgcagccacaaggtgctgaagaccagcgagacagcccaggacatccagaaggtgtcccgggaggagggcagcccccagctgagcagcgcccggcccagccctgcccagaggaacagccagcccagcagcagcaccatgatctctgtgctgcgggccggcggggccctgaggaacatctggacagaccaccagatccggcaggccctcttccccagccgccgcagcccccaggagaatgaagatgatgaagatgactaccagatgtttgtgcccagcttcagcagcagtgacctgaacagcacccggctgtgtgaggacagcaccagcagccggccctgctcctggcacatgggccagatggagagcacagagaccagcagcagcggccacagaattgtgagaagagccagcagcgctggggagagcaacacctgccccccagagatcggcaccagtgacaggacccgggagctgcagaacagccccaagacagagggccaggaggagatgacccccttcggcagcagcattgagctgaccattgatgacatcgaccacgtgtatgacaacatctcctatgaggacctgaagctgatggtggccaagcgggaggaggccgagagcacccccagcaagagcgcccgggacagcgtgcggcccaagagcaccccagagctggccttcaccaagaggcaggccggccacagcaagggcagcctgtatgcccagacagatggcaccctgagcggcggggaggccagcagccagagcacccatgagctgcaggccgtggaggagaacatctatgacaccatcggcctgcctgacccccccagcctgggcttcaagtgcagcagcctgaagagggccaagaggagcaccttcctgggcctggaggccgactttgtgtgctgtgacagcctgcggccctttgtgtcccaggacagcctgcagctgtctgaagatgaggccccctaccaccaggccaccccagaccacggctacctgagcctgctgtatgacagccccagcggcaacctgtccatgccccacaagcctgtgtctgacaagctgtctgaggaggtggatgagatctggaatgacctggagaactacatcaagaagaatgaagacaaggcccgggaccggctgctggccgccttccctgtgtccaaggatgatgtgcctgaccggctgcacgccgagagcaccccagagctgagcagagatgtgggccgctctgtgtccaccctgagcctgcctgagagccaggccctgctgacccctgtgaagagcagagctggccgggccagccgggccaactgcccctttgaagaagatctcatcagcaaggagggcagcttcatgagcctgaaccggctgagcctggccagcgagatgcccctgatggacaacccctatgacctggccaacagcggcctgagccagacagatcctgagaacccagacctgggcatggaggccacagacaagaccaagagcagggtcttcatgatggcccggcagtacagccagaagatcaagaaggccaaccagctgctgaaggtgaagagcctggagctggagcagcccccagccagccagcaccagaagtccatgcacaaggacctggccgccatcctggaggagaagaagcagggcggccctgccatcggggccagaattgctgagtacagccagctgtatgaccagatcgtgttccgggagagccccctgaagatccagaaggatggctgggccagcccccaggagagcagcctgctgcggtctgtgagccccagccaggtgcaccacggcagcggggactggctgctgcacagcacctacagcaatggagagctggccgacttctgcctgcccccagagcaggacctgcggagccgctaccccacctttgagatcaacaccaagagcaccccccggcagctgtctgctgcctgcagcgtgcccagcctgcagaccagtgaccccctgcccggctctgtgcagcgctgcagcgtggtggtgtcccagcccaacaaggagaactggtgccaggaccacctgtacaacagcctgggcaggaagggcatcagcgccaagagccagccctaccacaggagccagagcagcagctctgtgctgatcaacaagtccatggacagcatcaactaccccagtgatgtgggcaagcagcagctgctgagcctgcacaggagcagccgctgtgagagccaccaggacctgctgcctgacattgctgacagccaccagcagggcacagagaagctgagtgacctgaccctgcaggacagccagaaggtggtggtggtgaacagaaacctgcccctgaatgcccagatcgccacccagaactacttcagcaacttcaaggagacagatggagatgaagatgattatgtggagatcaagtcagaagaagatgagagcgagctggagctgagccacaacagaagaaggaagagtgacagcaagtttgtggatgctgacttcagtgacaacgtgtgcagcggcaacaccctgcacagcctgaacagccccaggacccccaagaagcctgtgaacagcaagctgggcctgagcccctacctgaccccctacaatgacagcgacaagctgaatgactacctgtggaggggccccagccccaaccagcagaacatcgtgcagagcctgcgggagaagttccagtgcctgagcagcagcagctttgcctag

SEQ ID NO: 40776 - DNA, 141 bp, Artificial Sequence
  Description of Artificial Sequence: Synthetic coding sequence
atggagctgagtgacagcgacaggcctgtgtcctttggcagcaccagcagcagcgccagcagccgggacagccacggcagctttggcagcaggatgaccctggtgagcaacagccacatgggcctcttcaaccaggactag

SEQ ID NO: 40777 - DNA, 4158 bp, Artificial Sequence; identical to SEQ ID NO: 40775
  Description of Artificial Sequence: Synthetic coding sequence

SEQ ID NO: 40778 - DNA, 2859 bp, Artificial Sequence
  Description of Artificial Sequence: Synthetic coding sequence
atggagctgagtgacagcgacaggcctgtgtcctttggcagcaccagcagcagcgccagcagccgggacagccacggcagctttggcagcaggatgaccctggtgagcaacagccacatgggcctcttcaaccaggacaaggaggtgggcgccatcaagctggagctgatcccagcccggcccttcagcagcagcgagctgcagagggacaacccagccaccggccagcagaatgctgatgagggcagcgagcggcccccccgggcccagtggagggtggacagcaatggagcccccaagaccatcgctgacagcgccaccagccccaagctgctgtatgtggacagagtggtgcaggagatcctggagacagagaggacctacgtgcaggacctgaagagcatcgtggaggactacctggactgcatccgggaccagaccaagctgcccctgggcacagaggagaggtctgccctgtttggaaacatccaggacatctaccacttcaacagcgagctgctgcaggacctggagaactgtgaaaatgaccctgtggccatcgcagaatgttttgtgtccaagtctgaggagttccacatctacacccagtactgcaccaactaccccaggtctgtggccgtgctgacagagtgcatgaggaacaagatcctggccaagttcttccgggagcggcaggagaccctgaagcacagcctgcccctgggcagctacctgctgaagcctgtgcagaggatcctgaagtaccacctgctgctgcacgagattgagaaccacctggacaaggacacagagggctatgatgtggtgctggatgccatcgacaccatgcagagggtggcctggcacatcaatgacatgaagaggaagcatgaacatgctgtgcggctgcaggagatccagagcctgctgaccaactggaagggccctgacctgaccagctatggagagctggtgctggagggcaccttccgcatccagagggccaagaatgaaagaaccctcttcctgtttgacaagctgctgctgatcaccaagaagagagatgacaccttcacctacaaggcccacatcctgtgtggcaacctgatgctggtggaggtgatccccaaggagcccctgtccttctctgtgttccactacaagaaccccaagctgcagcacacagtgcaggccaagagccagcaggacaagaggctgtgggtgctgcacctgaagaggctcatcctggagaaccacgccgccaagatcccagccaaggccaagcaggccatcctggagatggatgccatccaccaccctggcttctgctacagccctgagggcggcaccaaggccctgtttggcagcaaggagggcagcgccccctaccgcctgcggaggaagtctgagcccagcagccgcagccacaaggtgctgaagaccagcgagacagcccaggacatccagaaggtgtcccgggaggagggcagcccccagctgagcagcgcccggcccagccctgcccagaggaacagccagcccagcagcagcaccatgatctctgtgctgcgggccggcggggccctgaggaacatctggacagaccaccagatccggcaggccctcttccccagccgccgcagcccccaggagaatgaagatgatgaagatgactaccagatgtttgtgcccagcttcagcagcagtgacctgaacagcacccggctgtgtgaggacagcaccagcagccggccctgctcctggcacatgggccagatggagagcacagagaccagcagcagcggccacagaattgtgagaagagccagcagcgctggggagagcaacacctgccccccagagatcggcaccagtgacaggacccgggagctgcagaacagccccaagacagagggccaggaggagatgacccccttcggcagcagcattgagctgaccattgatgacatcgaccacgtgtatgacaacatctcctatgaggacctgaagctgatggtggccaagcgggaggaggccgagagcacccccagcaagagcgcccgggacagcgtgcggcccaagagcaccccagagctggccttcaccaagaggcaggccggccacagcaagggcagcctgtatgcccagacagatggcaccctgagcggcggggaggccagcagccagagcacccatgagctgcaggccgtggaggagaacatctatgacaccatcggcctgcctgacccccccagcctgggcttcaagtgcagcagcctgaagagggccaagaggagcaccttcctgggcctggaggccgactttgtgtgctgtgacagcctgcggccctttgtgtcccaggacagcctgcagctgtctgaagatgaggccccctaccaccaggccaccccagaccacggctacctgagcctgctgtatgacagccccagcggcaacctgtccatgccccacaagcctgtgtctgacaagctgtctgaggaggtggatgagatctggaatgacctggagaactacatcaagaagaatgaagacaaggcccgggaccggctgctggccgccttccctgtgtccaaggatgatgtgcctgaccggctgcacgccgagagcaccccagagctgagcagagatgtgggccgctctgtgtccaccctgagcctgcctgagagccaggccctgctgacccctgtgaagagcagagctggccgggccagccgggccaactgcccctttgaagaagatctcatcagcaaggagggcagcttcatgagcctgaaccggctgagcctggccagcgagatgaccctgtgccaggccctgtgcagagatgctgcctggtag

SEQ ID NO: 40779 - DNA, 3492 bp, Artificial Sequence
  Description of Artificial Sequence: Synthetic coding sequence
atgcctgtgtccaccagcctgcaccaggacggcagccaggagaggcctgtgtccctgaccagcaccaccagcagcagcggcagcagctgtgacagccgcagcgccatggaggagcccagcagcagcgaggccccagccaagaatggagctggcagcctgcggagccgccacctgcccaacagcaacaacaacagcagctcctggctgaatgtgaagggccccctgagccccttcaacagcagagctgctgctggccctgcccaccacaagctgagctacctgggccgggtggtgcgggagatcgtggagacagagaggatgtatgtgcaggacctgcggagcatcgtggagagccaggagtttgacatctacacccagtactgcaacaactaccccaacagcgtggccgccctgacagagtgcatgagggacaagcagcaggccaagttcttccgggaccggcaggagctgctgcagcacagcctgcccctgggcagctacctgctgaagcctgtgcagaggatcctgaagtaccacctgctgctgcaggagatcgccaagcactttgatgaggaggaggatggctttgaggtggtggaggatgccatcgacaccatgacctgtgtggcctggtacatcaatgacatgaagagaagacatgagcacgctgtgcggctgcaggagatccagagcctgctgatcaactggaagggccctgacctgaccacctacggggagctggtgctggagggcaccttccgggtgcaccgggtgagaaatgaaagaaccttcttcctgtttgacaagaccctgctgatcaccaagaagagaggagaccactttgtgtacaagggcaacatcccctgcagcagcctgatgctgattgagagcacccgggacagcctgtgcttcaccgtgacccactacaagcacagcaagcagcagtacagcatccaggccaagacagtggaggagaagaggaactggacccaccacatcaagaggctcatcctggagaaccaccacgccaccatcccccagaaggccaaggaggccatcctggagatggacagctactaccccaaccgctaccgctgcagccctgagcggctgaagaaggcctggagcagccaggatgaggtgtccaccaacgtgcggcagggccggcggcagagcgagcccaccaagcacctgctgcggcagctgaatgagaaggcccgggctgctggcatgaagggcaagggccggcgggagagcgagagcagccgcagcagccggcggcccagcggccgcagccccaccagcacagagaagaggatgagctttgagagcatcagcagcctgcctgaggtggagccagaccctgaggccggcagcgagcaggaggtgttttctgctgtggagggccccagcgctgaggagacccccagcgacacagagagccctgaggtgctggagacccagctggatgcccaccagggcctgctgggcatggaccccccaggggacatggtggactttgtggccgctgagagcacagaggacctgaaggccctgagcagcgaggaggaggaggagatgggcggggccgcccaggagcctgagagcctgctgcccccatctgtgctggaccaggcctctgtgattgctgagagatttgtgagcagcttcagcagaagaagctctgtggcccaggaggacagcaagagcagcggcttcggcagcccccggctggtgagccgcagcagctctgtgctgagcctggagggcagcgagaagggcctggcccggcacggcagcgccacagacagcctgagctgccagctgagccctgaggtggacatctctgtgggcgtggccacagaggacagccccagcgtgaatggcatggagccccccagccctggctgccctgtggagccagacaggagcagctgcaagaagaaggagagcgccctgagcacccgggaccggctgctgctggacaagatcaagagctactatgaaaatgctgagcaccatgatgctggcttctctgtgagaagaagagagagcctgagctacatccccaagggcctggtgagaaattccatcagccgcttcaacagcctgcccaggccagaccctgagcctgtgccccctgtgggcagcaagaggcaggtgggcagccggcccacctcctgggccctgtttgagctgcccggccccagccaggccgtgaagggggaccccccacccatcagtgatgctgagttccggcccagcagcgagatcgtgaagatctgggagggcatggagagcagcggcggcagccctgggaagggccctggccagggccaggccaacggctttgacctgcacgagcccctcttcatcctggaggagcacgagctgggcgccatcacagaggagagcgccacagccagccctgagagcagcagccccacagagggccgcagccctgcccacctggcccgggagctgaaggagctggtgaaggagctgagcagcagcacccagggcgagctggtggcccccctgcaccccagaattgtgcagctgagccacgtgatggacagccacgtgtctgagcgggtgaagaacaaggtgtaccagctggcccggcagtacagcctgcgcatcaagagcaacaagcctgtgatggcccggccccccctgcagtgggagaaggtggcccctgagagagatggcaagagccccaccgtgccctgcctgcaggaggaggccggggagcccctgggcggcaagggcaagaggaagcctgtgctgagcctgtttgattatgagcagctgatggcccaggagcacagcccccccaagcccagcagcgctggggagatgagcccccagcgcttcttcttcaaccccagcgctgtgtcccagaggaccaccagccctgggggccggcccagcgcccggagccccctgagccccacagagaccttctcctggccagatgtgcgggagctgtgcagcaaatatgccagcagagatgaggcccggcgggccggcggcggccggccccggggcccccctgtgaacagaagccacagcgtgcctgagaacatggtggagccccccctgagcggccgggtgggccgctgccgcagcctgagcaccaagaggggccggggcggcggggaggccgcccagagccctggccccctgccccagagcaagccagatggaggagagaccctgtatgtgacagctgacctgaccctggaggacaacagaagagtgattgtgatggagaagggccccctgcccagccccacagctggcctggaggagagcagcggccagggccccagcagccctgtggccctgctgggccaggtgcaggacttccagcagagcgctgagtgccagcccaaggaggagggcagccgggaccctgctgaccccagccagcagggccgggtgaggaacctgcgggagaagttccaggccctgaacagcgtgggctag

SEQ ID NO: 40780 - DNA, 3660 bp, Artificial Sequence
  Description of Artificial Sequence: Synthetic coding sequence
atgcctgtgtccaccagcctgcaccaggacggcagccaggagaggcctgtgtccctgaccagcaccaccagcagcagcggcagcagctgtgacagccgcagcgccatggaggagcccagcagcagcgaggccccagccaagaatggagctggcagcctgcggagccgccacctgcccaacagcaacaacaacagcagctcctggctgaatgtgaagggccccctgagccccttcaacagcagagctgctgctggccctgcccaccacaagctgagctacctgggccgggtggtgcgggagatcgtggagacagagaggatgtatgtgcaggacctgcggagcatcgtggaggactacctgctgaagatcatcgacaccccaggcctgctgaagccagagcaggtgtctgccctgtttggaaatattgagaacatctatgccctgaacagccagctgctgcgggacctggacagctgcaacagcgaccctgtggccgtggccagctgctttgtggagaggagccaggagtttgacatctacacccagtactgcaacaactaccccaacagcgtggccgccctgacagagtgcatgagggacaagcagcaggccaagttcttccgggaccggcaggagctgctgcagcacagcctgcccctgggcagctacctgctgaagcctgtgcagaggatcctgaagtaccacctgctgctgcaggagatcgccaagcactttgatgaggaggaggatggctttgaggtggtggaggatgccatcgacaccatgacctgtgtggcctggtacatcaatgacatgaagagaagacatgagcacgctgtgcggctgcaggagatccagagcctgctgatcaactggaagggccctgacctgaccacctacggggagctggtgctggagggcaccttccgggtgcaccgggtgagaaatgaaagaaccttcttcctgtttgacaagaccctgctgatcaccaagaagagaggagaccactttgtgtacaagggcaacatcccctgcagcagcctgatgctgattgagagcacccgggacagcctgtgcttcaccgtgacccactacaagcacagcaagcagcagtacagcatccaggccaagacagtggaggagaagaggaactggacccaccacatcaagaggctcatcctggagaaccaccacgccaccatcccccagaaggccaaggaggccatcctggagatggacagctactaccccaaccgctaccgctgcagccctgagcggctgaagaaggcctggagcagccaggatgaggtgtccaccaacgtgcggcagggccggcggcagagcgagcccaccaagcacctgctgcggcagctgaatgagaaggcccgggctgctggcatgaagggcaagggccggcgggagagcgagagcagccgcagcagccggcggcccagcggccgcagccccaccagcacagagaagaggatgagctttgagagcatcagcagcctgcctgaggtggagccagaccctgaggccggcagcgagcaggaggtgttttctgctgtggagggccccagcgctgaggagacccccagcgacacagagagccctgaggtgctggagacccagctggatgcccaccagggcctgctgggcatggaccccccaggggacatggtggactttgtggccgctgagagcacagaggacctgaaggccctgagcagcgaggaggaggaggagatgggcggggccgcccaggagcctgagagcctgctgcccccatctgtgctggaccaggcctctgtgattgctgagagatttgtgagcagcttcagcagaagaagctctgtggcccaggaggacagcaagagcagcggcttcggcagcccccggctggtgagccgcagcagctctgtgctgagcctggagggcagcgagaagggcctggcccggcacggcagcgccacagacagcctgagctgccagctgagccctgaggtggacatctctgtgggcgtggccacagaggacagccccagcgtgaatggcatggagccccccagccctggctgccctgtggagccagacaggagcagctgcaagaagaaggagagcgccctgagcacccgggaccggctgctgctggacaagatcaagagctactatgaaaatgctgagcaccatgatgctggcttctctgtgagaagaagagagagcctgagctacatccccaagggcctggtgagaaattccatcagccgcttcaacagcctgcccaggccagaccctgagcctgtgccccctgtgggcagcaagaggcaggtgggcagccggcccacctcctgggccctgtttgagctgcccggccccagccaggccgtgaagggggaccccccacccatcagtgatgctgagttccggcccagcagcgagatcgtgaagatctgggagggcatggagagcagcggcggcagccctgggaagggccctggccagggccaggccaacggctttgacctgcacgagcccctcttcatcctggaggagcacgagctgggcgccatcacagaggagagcgccacagccagccctgagagcagcagccccacagagggccgcagccctgcccacctggcccgggagctgaaggagctggtgaaggagctgagcagcagcacccagggcgagctggtggcccccctgcaccccagaattgtgcagctgagccacgtgatggacagccacgtgtctgagcgggtgaagaacaaggtgtaccagctggcccggcagtacagcctgcgcatcaagagcaacaagcctgtgatggcccggccccccctgcagtgggagaaggtggcccctgagagagatggcaagagccccaccgtgccctgcctgcaggaggaggccggggagcccctgggcggcaagggcaagaggaagcctgtgctgagcctgtttgattatgagcagctgatggcccaggagcacagcccccccaagcccagcagcgctggggagatgagcccccagcgcttcttcttcaaccccagcgctgtgtcccagaggaccaccagccctgggggccggcccagcgcccggagccccctgagccccacagagaccttctcctggccagatgtgcgggagctgtgcagcaaatatgccagcagagatgaggcccggcgggccggcggcggccggccccggggcccccctgtgaacagaagccacagcgtgcctgagaacatggtggagccccccctgagcggccgggtgggccgctgccgcagcctgagcaccaagaggggccggggcggcggggaggccgcccagagccctggccccctgccccagagcaagccagatggaggagagaccctgtatgtgacagctgacctgaccctggaggacaacagaagagtgattgtgatggagaagggccccctgcccagccccacagctggcctggaggagagcagcggccagggccccagcagccctgtggccctgctgggccaggtgcaggacttccagcagagcgctgagtgccagcccaaggaggagggcagccgggaccctgctgaccccagccagcagggccgggtgaggaacctgcgggagaagttccaggccctgaacagcgtgggctag

SEQ ID NO: 40781 - DNA, 486 bp, Artificial Sequence
  Description of Artificial Sequence: Synthetic coding sequence
atgcctgtgtccaccagcctgcaccaggacggcagccaggagaggcctgtgtccctgaccagcaccaccagcagcagcggcagcagctgtgacagccgcagcgccatggaggagcccagcagcagcgaggccccagccaagaatggagctggcagcctgcggagccgccacctgcccaacagcaacaacaacagcagctcctggctgaatgtgaagggccccctgagccccttcaacagcagagctgctgctggccctgcccaccacaagctgagctacctgggccgggtggtgcgggagatcgtggagacagagaggatgtatgtgcaggacctgcggagcatcgtggaggactacctgctgaagatcatcgacaccccaggcctgctgaagccagagcaggtgtctgccctgtttggaaatattgagaacatctatgccctgaacagccagctgctgcgggacctggacagctgcaacagctag

SEQ ID NO: 40782 - DNA, 567 bp, Artificial Sequence
  Description of Artificial Sequence: Synthetic coding sequence
atgcctgtgtccaccagcctgcaccaggacggcagccaggagaggcctgtgtccctgaccagcaccaccagcagcagcggcagcagctgtgacagccgcagcgccatggaggagcccagcagcagcgaggccccagccaagaatggagctggcagcctgcggagccgccacctgcccaacagcaacaacaacagcagctcctggctgaatgtgaagggccccctgagccccttcaacagcagagctgctgctggccctgcccaccacaagctgagctacctgggccgggtggtgcgggagatcgtggagacagagaggatgtatgtgcaggacctgcggagcatcgtggaggactacctgctgaagatcatcgacaccccaggcctgctgaagccagagcaggtgtctgccctgtttggaaatattgagaacatctatgccctgaacagccagctgctgcgggacctggacagctgcaacagcgaccctgtggccgtggccagctgctttgtggagaggagccaggagtttgacatctacacccagtactgcaacaactacccctag

SEQ ID NO: 40783 - DNA, 3816 bp, Artificial Sequence
  Description of Artificial Sequence: Synthetic coding sequence
atggaggccctgaggaaccccatgcccctgggcagcagcgaggaggccctgggggacctggcctgcagcagcctgaccggggccagccgggacctgggcaccggggctgtggccagcggcacccaggaggagaccagcggccccaggggggacccccagcagacccccagcctggagaaggagcggcacacccccagcaggacaggccctggagctgctggccgcaccctgcccaggaggagccgctcctgggagcgggcccccaggagcagcagaggagcccaggccgccgcctgccacaccagccaccacagcgctggcagcaggcctgggggccacctgggcggccaggccgtgggcacccccaactgtgtgcctgtggagggccctggctgcaccaaggaggaggatgtgctggccagcagcgcctgtgtgtccacagatggcggcagcctgcactgccacaaccccagcggccccagtgatgtgcctgcccggcagccccaccctgagcaggagggctggcccccaggcactggagacttccccagccaggtgcccaagcaggtgctggatgtgtcccaggagctgctgcagagcggcgtggtgaccctgcccggcacccgggacagacatggccgggctgtggtgcaggtgaggaccaggagcctgctgtggacccgggagcacagcagctgtgccgagctgacccggctgctgctgtacttccacagcatccccaggaaggaggtgcgggacctgggcctggtggtgctggtggatgcccggcgcagccctgctgccccagctgtgtcccaggccctgagcggcctgcagaacaacaccagccccatcatccacagcatcctgctgctggtggacaaggagagcgccttccggccagacaaggatgccatcatccagtgtgaggtggtgagcagcctgaaggctgtgcacaagtttgtggacagctgccagctgacagctgacctggatggcagcttcccctacagccatggagactggatctgcttccggcagaggctggagcactttgctgccaactgtgaggaggccatcatcttcctgcagaacagcttctgcagcctgaacacccacaggacccccaggacagcccaggaggtggccgagctgattgaccagcacgagaccatgatgaagctggtgctggaggaccccctgctggtgtccctgcggctggagggcggcaccgtgctggcccggctgcggcgggaggagctgggcacagaggacagccgggacaccctggaggccgccaccagcctgtatgacagagtggatgaggaggtgcaccggctggtgctgaccagcaacaaccggctgcagcagctggagcacctgcgggagctggccagcctgctggagggcaatgaccagcagagctgccagaagggcctgcagctggccaaggagaacccccagaggacagaggagatggtgcaggacttccggcggggcctgtctgctgtggtgtcccaggctgaatgtcgggagggggagctggcccgctggaccaggagcagcgagctgtgtgaaacagtgtcctcctggatgggccccctggaccctgaggcctgccccagcagccctgtggctgaatgtctgcggagctgccaccaggaggccacctctgtggccgctgaggccttccctggagctggggtggccgtgctgaagccccacgccctgggcaagccctgggccagccagcaggacctgtggctgcagtacccccagacccggctgcggctggaggaggccctgtctgaggccgccccagaccccagcctgccccccctggcccagagcccccccaagcatgagcgggcccaggaggccatgagaagacaccagaagccacccagcttccccagcacagacagcggcggcggggcctgggagcccgcccagcccctgagcggcctgcccggccgggccctgctgtgtggccaggatggagagaccctgcggcccggcctgtgtgccctgtgggaccccctgagcctgctgcggggcctgcccggggccggggccaccacagcccacctggaggacagcagcgcctgcagcagcgagcccacccagaccctggccagccggcccaggaagcacccccagaagaagatgatcaagaagacccagagctttgagatcccccagccagattctggcccccgggacagctgccagcctgaccacacctctgtgttcagcaagggcctggaggtgaccagcacagtggccacagagaagaagctgcccctgtggcagcacgcccggagcccccctgtgacccagagccgcagcctgagcagccccagcggcctgcacccagcagaagaagatggccggcagcaggtgggcagcagccggctgcggcacatcatggccgagatgattgccacagagcgggagtacatccgctgcctgggctacgtgattgacaactacttccctgagatggagaggatggacctgccccagggcctgcggggcaagcaccacgtgatcttcggcaacctggagaagctgcatgacttccaccagcagcacttcctgcgggagctggagcgctgccagcactgccccctggccgtgggccgctccttcctgcggcatgaggagcagtttggcatgtatgtgatctacagcaagaacaagccccagagtgatgccctgctgagcagccatggaaatgccttcttcaaggacaagcagcgggagctgggggacaagatggacctggccagctacctgctgcggcctgtgcagagggtggccaagtatgccctgctgctgcaggacctgctgaaggaggccagctgtggcctggcccagggccaggagctgggggagctgcgggctgctgaggtggtggtgtgcttccagctgcggcacggcaatgacctgctggccatggatgccatccggggctgtgatgtgaacctgaaggagcagggccagctgcgctgcagagatgagttcatcgtgtgctgcggcaggaagaagtacctgcggcacgtgttcctgtttgaggacctgatcctcttcagcaagacccagaaggtggagggcagccatgatgtgtacctgtacaagcagagcttcaagacagctgagatcggcatgacagaaaatgtgggggacagcggcctgcgctttgagatctggttcagaagaagaaggaagagccaggacacctacatcctgcaggccagcagcgctgaggtgaagagcgcctggacagatgtgattggccgcatcctgtggaggcaggccctgaagagccgggagctgcgcatccaggagatggcctccatgggcatcggcaaccagcccttcatggatgtgaagccccgggacaggaccccagactgtgctgtgatcagtgaccgggcccccaagtgtgctgtgatgtctgacagagtgcctgacagcatcgtgaagggcacagagagccagatgaggggcagcacagctgtgagcagcagtgaccatgctgcccccttcaagaggccccacagcaccatcagtgacagcagcaccagcagcagcagcagccagagcagcagcatcctgggcagcctgggcctgctggtgagcagcagccctgcccaccctggcctgtggagccctgcccacagcccctggagcagtgacatccgggcctgtgtggaggaggatgagcctgagcctgagctggagaccggcacccaggccgctgtgtgtgagggcgccccagctgtgctgctgagcaggacccggcaggcctag

SEQ ID NO: 40784 - DNA, 1140 bp, Artificial Sequence
  Description of Artificial Sequence: Synthetic coding sequence
atgatcttcatgaacaccctgcgctacctgcagacccatgagtacctgctggatgtggacctgtggaggctgtttgccaacctggaggagctgacccagaccagcctgggctttgtgaacagcctgtttggcatcatcaaggactatgtggatgccagcgagatcagcagcagcctggacttcatctctgtgctgaccaagtacttccggggcagcctgtgccagagccaccagacctactgcctgaactacagcgctgccatcttctacctggagagcctgcggcagagagatgactttggcatctacctgaagtggtgtgagcagaatgagcagtgccggcggctgcacgtgcctgagctgctggtggcccccctgcagaggctgacccgctaccccctgctgctgaagaacatctggaagaggtccatggacagcgctgagaagatcatgatctacagcatcaaggagaaggtggagaagagcatccgggacctggagggcaaggtgaagtggctggacaacttccagaagttccgctacctgcaggagatcatcgtgtggccacccctgtgggaccgggacaagcgcttcttcatccctgagtgcctgaagcacatcttcaaggagcacatggccgagaacatcctgagccccaccagccgccacctgctgtatgagggcaagctgaccctggccgagagcacccgcttcctggatgtgtacctgttcctgttcaatgacttcctgctggtgaccaagaccaagtgcaacaagaagaagctgggcggcagtgaccccggcctgatgtgccccagcctgaccccagagctgcaggccgtcatcaaggagggcggcagctgcaccgtgctggaccagcccatccccctggaccggctggtggtgaagagcattgagcccctgcacgtgtctgtgtttggcctgagaaatgccttcctgatccagcacgagaaccgctaccggcagtgcatcgccgccttcctgctgcaggcccagacagagaacatcaagaagacctggatggcccagatcaccacagccatcagctgcttcaccaagagccaggagaccaagaagatcagcctcttcaccctgcctgctgagagcagcgagatctag

SEQ ID NO: 40785 - DNA, 4095 bp, Artificial Sequence
  Description of Artificial Sequence: Synthetic coding sequence
atggccgagctgaaggtggaggccccagcctctgtggactggcagaagcgctgcctgaccctggagacccagctgttccgcttccggctgcaggccagcaagatccgggagctgctggccgacaagatgcaggagctggagcagaggctgctggaggccgagcagagagcagaaaatgctgagacccaggtgggcgtgatggaggagaaggtgaagctgagcaacctgaagaatgtggacagcgagggcagcctgcacaggaagtaccaggagctgctgaaggccatcaagggcaaggatgagctgatcagccagctggaggcccagctggagaagcagaagcagatgagagctgaggaggccaagacagtgcaggagaaggccgccaagatcaaggagtgggtgaccctgaagctggccaagctggagatggagaaccagcacctgaagagccacaaccagaggctggtggagcaggtgggcagcctgcaggatgccctggaggccatccagatcgcccccagcaggaagctgctggtgcccccctatggagctgctgagcaggacagcgtgcccagcgagcccggcatccagcccatgggccaggacagcggcagccaggcccagggcctgaaggctgctgtgctggcccccagccctggggccctgcagagcaaggacagcgtgtctgaggccgccagccccctggaggacagcagcagcagcacagtgcacagcggggagaccgtggaggccaagcccctgcagccccacctgggccgggagagccccccccaccagccctgcatgaagctgctgaccttccgctgcagcagcgcctcctggggcgagggcctggtgacagcccagaggggcatgctgcccggcaccaagaccagcgcccgggagggcggccctggcagcagcctgaccctgcccaaggtgcgggcccctggcaccccccgggacagcatccagctggccaagaggcaccacagccagccccaggtgggccacggccacttcggccgggtggtgaacatcgagacagaggccttcagcgccctgcaccccagcggcctgcctgagctggagagccgggcccggagccgggaggagcctgagaagatggagatggaggagcccccacctgctgggaagaatgaggagcgggagagccccaaggccctgggcgctgagctggaggaggtggagctgggcaacaagccacccaccccacccctgcaccagttcagctcctgggagagccgcatctatgctgtggccaccagcggcatgaggctgagtgacatgagccccaggagcaacacagcctgctgtgccagcagccccccagccctggtgtccccaggcagcttcagcggcctggtgtacaagaatgtgacagtgcctgtgtacacagccctgaagggccgggccacccagatcagcaacatgcccttcatggatgagagcagcggcagtgatgatgactgcagcagccaggccagcttccgcatctctgtgcccagcagcgagagcaggaagaccagcggcctgggcagcccccgggccatcaagaggggcgtgtccatgagcagcctgagcagcgagggggactatgccatccccccagatgcctgcagcctggacagcgactacagcgagcctgagcacaagctgcagaggaccagcagctacagcacagatggcctgggcctgggcggggagagcctggagaagagcggctacctgctgaagatgggcagccaggtgaagacctggaagaggcgctggtttgtgctgcggcagggccagatcatgtactacaagagccccagtgatgtgatcaggaagccccagggccaggtggacctgaacagccgctgccagatcgtgcggggggagggcagccagaccttccagctgatcagcgagaagaagacctactacctgacagctgacagccccagcctgctggaggagtggatccgggtgctgcagagcctgctgaaggtgcaggccaccggccccccagccctgctgcggggcggcaccaagcccaccgtgaagggctggctgaccaaggtgaagcacggccacagcaaggtggtgtggtgtgccctggtgggcaagatcttctactactaccgcagccatgaggacaagaggcccctgggctgcctgcctgtgagagatgcccacatcgaggaggtggacaggagctgtgacagtgatgaagattatgaagctgggggcacccggcggctgctgagcagccactgcaccctggtgatccaccccacagagcacagccccacctacctgctgattggcaccaagcatgagaaggacacctggctgtaccacctgactgtggccgccggcggcagcagcgccaaggtgggcacagcctatgagcagctgattggcaagctgatggatggagagggggaccctgacagccccctgtggaggcaccccatgctgtgctacagcaaggatggcctgtatgccagcctgaccaccctgcccagcgaggccctgcagacagaggccctgaagctgttcaagagctgccagctgttcatcaacgtgcctgtggaggccgcctctgtggactaccacgtgtccctggcccagacagccctgcaggtgtgcctggtgcaccctgagctgcagagcgagatctactgccagctgatgaagcagaccagctgcaggcctccccagaagtacagcctgatgcagtgctggcagctgctggccctgtgtgcccccctcttcctgccccagcaccacttcctgtggtacgtgaagcagcagctgcagagacatgctgaccccaggagtgaaacaggccagtatgccacctactgccagagagctgtggagaggaccctgaggactggagagcgggaggcccggcccagcaggatggaggtggtgtccatcctgctgaggaaccccttccaccacagcctgcccttcagcatccctgtgcacttcaccaacggcacctaccacgtggtgggctttgatggcagcagcacagtggatgagttcctgcagaggctgaaccaggagatcggcatgaggaagcccagccacagcggctttgccctcttcacagatgaccccagcggccgggacctggagcactgcctgcagggctctgtgaagatctgtgatgccatcagcaagtgggagcaggccatgaaggagctgcaccctgggaagtctgagggcggcaccagggtggtgaagctgatgtacaagaaccggctgtacttccgcagccaggtgaagggggagacagaccgggagcggctgctgctggccagccagaccagccgggagatcgtggccggccgcttccccatcaacaaggagctggccctggagatggccgccctgatggcccaggtggagtatggagacctggagaagccagccctgcccggccctgggggcaccagccctgccaaggcccagcacctgctgcagcaggtgctggaccgcttccacccccggcgctaccgccacggggccccagctgagcagctgcggcacctggccgacatgctgaccaccaagtgggccaccctgcagggctgcagccccccagagtgcatccgcatctacctgactgtggccaggaagtggcccttctttggagccaagctgtttgctgcccagcctgcccagctgagcagcaaagaaaatgccctggtgtggattgctgtgaatgaagatggagtgtccatcctggaccacaacaccatgcaggtgcacatcacctacccctacagctctgtgaccaccttcggcggctgcagagatgacttcatgctggtgatccgcagcatcccagacaagagcagcggcaagagccacatcgagaagctgatcttcaggatggccgcccccaagattgctgaggccaccttcatcatggccagctacatgaaccactgcaccaccaccgtgaacccccccaccaaccccccaggggcctgccagctgtgggagctggatggccggcagttcttcagctctgtgtcctgtgccaccaagggccccaccctgctgtag

SEQ ID NO: 40786 - DNA, 990 bp, Artificial Sequence
  Description of Artificial Sequence: Synthetic coding sequence
atggccgccctgatggcccaggtggagtatggagacctggagaagccagccctgcccggccctgggggcaccagccctgccaaggcccagcacctgctgcagcaggtgctggaccgcttccacccccggcgctacagacatggagccccagctgagcagctgcggcacctggccgacatgctgaccaccaagtgggccaccctgcagggctgcagccccccagagtgcatccgcatctacctgactgtggccaggaagtggcccttcttcggggccaagctgtttgctgcccagcctgcccagctgagcagcaaagaaaatgccctggtgtggattgctgtgaatgaagatggagtgtccatcctggaccacaacaccatgcaggtgcacatcacctacccctacagctctgtgaccacctttggaggctgcagagatgacttcatgctggtgatccgcagcatcccagacaagagcagcggcaagagccacatcgagaagctgatcttcaggatggccgcccccaagccccagcaccacgctgtgctgtcctgggtgctgacctgcagcagcctgccctgcagcagcccccagggccgggctgacagcagcctgcgggccaaccagagcaggaccctgggcctgctcttcagcgagggccactgtgccagcgagcgcatcagccggcccactggagcccacaccaccggccccctgaacagcacagtgatgatccccttcggctacttcctgcctgactgccgcagctacctgcaccacggccagctgtatgagcccctgcactacaactgtgagcccccccaccagcccaccaggagcctgcctgctgtgggcaccggctggaccaccgtgctcttcttctgcttcctgtgctaccagggcgccaacgtggccgtgaacatcagccccacccgcttccccaacaccaccagcgccagcggcttccgggacatctacccccgggtgtag

SEQ ID NO: 40787 - DNA, 2382 bp, Artificial Sequence; identical to SEQ ID NO: 40743
  Description of Artificial Sequence: Synthetic coding sequence

SEQ ID NO: 40788 - DNA, 1851 bp, Artificial Sequence
  Description of Artificial Sequence: Synthetic coding sequence
atgcccctgcccggcggcctgtggtggctgctgtgctgccggcggggcttcaccctgctgcaccgggactatggagatggagagctgtctggagatggagatgaagatgaagatgaggagacctttgagctgcggacccccagccctgctgggggcggccggggccccctggaggtgaccctgacccagcctgtgcgcagcggccctgtgagcaaccggctgcagagctgggaggagacctggagcctcatccctgagaagggcctgcctgaagatgatcctgacatcgtggtgaagggctggctgtaccgggagccccggggcggcggggcccggccctggctgcccccccggcgggcctggtttgtgctgacccgggacagcctggaccagttcagcagcagtggaaaaggagcccggcggctgggcagcctggtgctgaccagcctgtgcagcgtgacaggccctgagaggaggaggaaggagaccggcctgtggagcgtgacagtgtctggcaggaagcacagcgtgcggctgtgcagcccccggcaggccgaggccgagcgctggggcgtggccctgcgggaggtgattgccagcaaggcccccctggagacccccacccagctgctgctgcgggacatccaggagagctgtggggaccctgaggccgtggccctgatctacctgaggaaccccatcctgcggcacaccagcggggccctgtatgcccccctgctgcccctgccctatggagtgtctgcccctggccctggctacgcccccctgcgggaggaggccgtgcggctcttcctggccctgcaggccctggagggcgcccggcggcccggccccctgatgcagggcgtgctgcagacctgccgggacctgcctgccctgagagatgagctgttcctgcagctggccaagcagaccagcggccctgctggccccccaggcctgcctgccacccaggaccctgctgccctgcgctactggcagctgctgacctgcatgagctgcaccttccggcctggaggagctgtgcggggccacctgctgggccacctggagaggacagagcaggccctgcctgattctgagctggccgagtatgcccgcttcatcaggaaggccctgggccgcacccggggccgggagctggtgcccagcctggccgagatcagcgccctgagccagaggcaggagctgctgtgcaccgtgcactgccctggagctggggcctgtgctgtggccatcgacagccacaccacagctggggaggtggcccgggagctggtgggccgcctgggcctggcccggagcagaaatgcctttgccctgtatgagcagagaggagcccaggagcgggccctggccggcggcaccctggtggctgatgtgctgaccagcctggccgctgaggaggccggcctggaggacagcccagattctggctggaggctgtgcctgcggctgcacggccccctgcaccctgagggcctgagcccagatggccacgagctgcccttcctgtttgagcagcctgacagcgccagcctgtctgctggggcctggagcggctacggccacgtggccgcctgccagctgatgggcccccacaccctggccctgcgggtgggggagagccagctgctgctgcagagcccccaggtggaggagatcatgcagctggtgaatgcctacctggccaaccccagccctgagcggccctgcagcagcagcagccccccctgccaggacctgcctgacaccagcccccccagccagaggcctggcctggatgagccccagggccagagcggctgcctgggccagctgcaggactag

SEQ ID NO: 40789 - DNA, 1095 bp, Artificial Sequence
  Description of Artificial Sequence: Synthetic coding sequence
atgagctgcaccttccggcctggaggagctgtgcggggccacctgctgggccacctggagaggacagagcaggccctgcctgattctgagctggccgagtatgcccgcttcatcaggaaggccctgggccgcacccggggccgggagctggtgcccagcctggccgagatcagcgccctgagccagaggcaggagctgctgtgcaccgtgcactgccctggagctggggcctgtgctgtggccatcgacagccacaccacagctggggaggtggcccgggagctggtgggccgcctgggcctggcccggagcagaaatgcctttgccctgtatgagcagagaggagcccaggagcgggccctggccggcggcaccctggtggctgatgtgctgaccagcctggccgctgaggaggccggcctggaggacagcccagattctggctggaggctgtgcctgcggctgcacggccccctgcaccctgagggcctgagcccagatggccacgagctgcccttcctgtttgagcaggcccacgccctgctgctgcggggccggcccccacctccagatgacaccctgcgggccctggccgccctgcggctgcagagcctgcagagggacttcagcccccgggtgcccctgccccggctggaccggctgctgcccccaccagccccaccccgggaggaccccccccggcccaccccccggcccccacccagcgctgccctgctggccggggccctgtggagccctggcctggccaagagaagagctgagcgggcccggcggggcggggccggccgcacagctggcagcatcgcccgggagggcggcggcggggccggcacagctgctgctgtgctgggcggctggaagaggctgcggggcatgggccgggcagaggccatggccgcctacctggccctggccgcccagtgccccggctttggagctgcccggagcctggtgggcgtgctgcacaggagctgtgcctgggcctgggagccccggccctgccccagccctggccagggccgccgcagccccagcacagtgtctgccatggccatgtggcccccagccagctag

SEQ ID NO: 40790 - DNA, 450 bp, Artificial Sequence; identical to SEQ ID NO: 40744
  Description of Artificial Sequence: Synthetic coding sequence

SEQ ID NO: 40791 - DNA, 3000 bp, Artificial Sequence
  Description of Artificial Sequence: Synthetic coding sequence
atggagcctggagaggtgaaggaccgcatcctggagaacatcagcctgtctgtgaagaagctgcagagctactttgctgcctgtgaagatgagatcccagccatccggaaccacgacaaggtgctgcagaggctgtgtgagcacctggaccacgccctgctgtatggcctgcaggacctgagcagcggctactgggtgctggtggtgcacttcacccggcgggaggccatcaagcagatcgaggtgctgcagcacgtggccaccaacctgggccgcagccgggcctggctgtacctggccctgaatgaaaacagcctggagagctacctgcggctcttccaggagaacctgggcctgctgcacaagtactacgtgaagaatgccctggtgtgcagccatgaccacctgaccctcttcctgaccctggtgtctggcctggagttcatccgctttgagctggacctggatgccccctacctggacctggccccctacatgccagactactacaagccccagtacctgctggactttgaagatcggctgcccagctctgtgcacggcagtgacagcctgagcctgaacagcttcaacagcgtgaccagcaccaacctggagtgggatgacagcgccatcgcccccagcagtgaagatggagacctgacagacacagtgtctggccccaggagcacagccagtgacctgaccagcagcaaggccagcaccaggagccccacccagaggcagaaccccttcaatgaggagcctgctgagaccgtgagcagcagtgacaccacccctgtgcacaccaccagccaggagaaggaggaggcccaggccctggaccccccagatgcctgcacagagctggaggtgatccgggtgaccaagaagaagaagattggcaagaagaagaagagcagaagtgatgaggaggccagccccctgcacccagcctgcagccagaagaagtgtgccaagcagggagatggagacagcagaaatggcagccccagcctgggccgggacagcccagacaccatgctggccagcccccaggaggagggggagggccccagcagcaccacagagagcagcgagaggtctgagcccggcctgctgatccctgagatgaaggacacctccatggagcggctgggccagcccctgagcaaggtgattgaccagctgaatggccagctggaccccagcacctggtgcagcagagctgagcccccagaccagagcttcagaacaggcagccctggagatgcccctgagaggcctcccctgtgtgacttcagcgagggcctgagcgcccccatggacttctaccgcttcaccgtggagagccccagcacagtgaccagcggcggcggccaccacgaccctgctggcctgggccagcccctgcacgtgcccagcagccctgaggccgccggccaggaggaggagggcggcggcggggagggccagaccccccggcccctggaggacaccacccgggaggcccaggagctggaggcccagctgagcctggtgcgggagggccctgtgtctgagcctgagcccggcacccaggaggtgctgtgccagctgaagagggaccagcccagcccctgcctgagcagcgctgaggacagcggcgtggatgagggccagggcagccccagcgagatggtgcacagcagcgagttccgggtggacaacaaccacctgctgctgctgatgattcatgtgttcagagaaaatgaggagcagctgttcaagatgatccgcatgagcacaggccacatggagggcaacctgcagctgctgtatgtgctgctgacagactgctacgtgtacctgctgaggaagggggccacagagaagccctacctggtggaggaggccgtgtcctacaatgagctggactatgtgtctgtgggcctggaccagcagacagtgaagctggtgtgcaccaacagaaggaagcagttcctgctggacacagcagatgtggccctggccgagttcttcctggccagcctgaagagcgccatgatcaagggctgccgggagcccccctaccccagcatcctgacagatgccaccatggagaagctggccctggccaagtttgtggcccaggagagcaaatgtgaggccagcgctgtgacagtgcgcttctacggcctggtgcactgggaggaccccacagatgagagcctgggccccaccccctgccactgcagccccccagagggcaccatcaccaaggagggcatgctgcactacaaggccggcaccagctacctgggcaaggagcactggaagacctgctttgtggtgctgagcaatggcatcctgtaccagtacccagacagaacagatgtgatccccctgctgtctgtgaacatgggcggggagcagtgtggcggctgccggcgggccaacaccacagaccggccccacgccttccaggtgatcctgagtgaccggccctgcctggagctgtctgctgagagcgaggccgagatggccgagtggatgcagcacctgtgccaggccgtgtccaagggcgtcatcccccagggcgtggcccccagcccctgcatcccctgctgcctggtgctgacagatgacaggctcttcacctgccacgaggactgccagaccagcttcttccgcagcctgggcacagccaagctgggggacatctctgctgtgtccacagagcccgggaaggagtactgtgtgctggagttcagccaggacagccagcagctgctgcccccctgggtgatctacctgagctgcaccagcgagctggaccggctgctgagcgccctgaacagcggctggaagaccatctaccaggtggacctgccccacacagccatccaggaggccagcaacaagaagaagtttgaagatgccctgagcctcatccacagcgcctggcagaggagtgacagcctgtgccggggccgggccagccgggacccctggtgctag

SEQ ID NO: 40792 - DNA, 2154 bp, Artificial Sequence
  Description of Artificial Sequence: Synthetic coding sequence
atggaggccctggaggtggatgacatcagccctgccctggaggtgacagaggagttcttcagcaccctggacagcaacctggagaaggctgtgcagcaggccgaggtgtatggcatccaggaggtgcctgagctggtgggccacgaggtgctgagcaacatcacagacaatggagccatgagaaatgtgaccagcctgggcaagggcggcatgatctgggaccactgcaagagccggctgctggagaccaaggcccagaatgtgtttcctgccaaggagcagttcatggtgcagaggggcaccaccccagacaacctgtcctggatggagcagaaggaggccagcaccttcaacttcttcaacatctgccagaggcggcgggaccggcccaggtctgtgaatgacctgctggatgagaccagcaccttcaagccaggccacgcccggagcagaagtgacatcacccaggtggactggagggtggtgctgaagaccacccccctgcagcagcagcagcagcagcagcccctgctgcagggcccccacgtgacccggcccagcttcctgctgcccagccccaacaagattgaagatgcccagggcaacacagagcacaagcagaccttccccaacatcctgaagaagggctacctggagatcaggaaggaccatgacagctactggcagagctgctacgccgagctgagcccctacaacctgtacttctacagcctggacagcagcggcaaccagaacctgtatgccacctaccagctgagccacttccagagcatctctgtgctgggcaacctggaggccaggatggtggacacagtgctgtatgacaacacccagctgcagctgaaggccgagagcccctgggaggccctggactggggccagaagctgtgggaggtggtgcatgctgctgtgcccggctacatgggccggcagaatgagctgaccatcagccctggcctgggccaccatgatgactacacccagaaccacagcttccagaagaagaccagcggcctgctgccccccagccctgtgctggacagcagcaagcagtaccagaacatcctgaagagcggcaccctgtaccgcctgactgtgcagaacaactggaaggccttcacctttgtgctgagccgggcctacctgatggccttccagcccgggaagctggatgaggaccccctgctgagctacaacgtggatgtgtgcctggccgtgcagatggacaacctggatggctgtgacagctgcttccaggtgatcttcccccaggatgtgctgcggctgcgggcagagacccggcagagggcccaggagtggatggaggccctgaagattgctgccaacgtggcccggagcagcgagcagaacctgcaggtgaccctgaggaacaagcccaaggaccagatgggcggccacgagctgaggaagaacaagaggcagagcgtgaccaccagcttcctgagcatcctgaccaccctgagcctggagcggggcctgacagcccagagcttcaagtgtgccggctgccagaggagcatcggcctgagcaatggcaaggccaaggtgtgcaactacagcggctggtactactgcagcagctgccacgtggatgacagcttcctgatcccagcccgcatcgtgcacaactgggacaccagcaagtacaaggtgtccaagcaggccaaggagttcctggagtatgtgtatgaggagcccctgattgacatccagcaggagaatgccatgctgtaccaccacgccgagcccctggccgctgtgctgcggctgcggcagaggctgaagagcctgcgggcctacctgttcagctgcagagctgctgtggccgaggacctgcggcggcgcatcttcccccgggagtacctgctgcagcagatccacctgtacagcctggccgacctgcagcaggtgattgagggcaagctggcccccttcctgggcaaggtgatcaagtttgccaccagccacgtgtacagctgcagcctgtgcagccagaagggcttcatctgtgagatctgcaacaatggagagatcctgtacccctttgaggacatcagcaccagcagatttggagacccctatgctgacctgctgcagggctacgtggcctag

SEQ ID NO: 40793 - DNA, 2286 bp, Artificial Sequence
  Description of Artificial Sequence: Synthetic coding sequence
atggaggccctggaggtggatgacatcagccctgccctggaggtgacagaggagttcttcagcaccctggacagcaacctggagaaggctgtgcagcaggccgaggtgtatggcatccaggaggtgcctgagctggtgggccacgaggtgctgagcaacatcacagacaatggagccatgagaaatgtgaccagcctgggcaagggcggcatgatctgggaccactgcaagagccggctgctggagaccaaggcccagaatgtgtttcctgccaaggagcagttcatggtgcagaggggcaccaccccagacaacctgtcctggatggagcagaaggaggccagcaccttcaacttcttcaacatctgccagaggcggcgggaccggcccaggtctgtgaatgacctgctggatgagaccagcaccttcaagccaggccacgcccggagcagaagtgacatcacccaggtggactggagggtggtgctgaagaccacccccctgcagcagcagcagcagcagcagcccctgctgcagggcccccacgtgacccggcccagcttcctgctgcccagccccaacaagattgaagatgcccagggcaacacagagcacaagcagaccttccccaacatcctgaagaagggctacctggagatcaggaaggaccatgacagctactggcagagctgctacgccgagctgagcccctacaacctgtacttctacagcctggacagcagcggcaaccagaacctgtatgccacctaccagctgagccacttccagagcatctctgtgctgggcaacctggaggccaggatggtggacacagtgctgtatgacaacacccagctgcagctgaaggccgagagcccctgggaggccctggactggggccagaagctgtgggaggtggtgcatgctgctgtgcccggctacatgggccggcagaatgagctgaccatcagccctggcctgggccaccatgatgactacacccagaaccacagcttccagaagaagaccagcggcctgctgccccccagccctgtgctggacagcagcaagcagtaccagaacatcctgaagagcggcaccctgtaccgcctgactgtgcagaacaactggaaggccttcacctttgtgctgagccgggcctacctgatggccttccagcccgggaagctggatgaggaccccctgctgagctacaacgtggatgtgtgcctggccgtgcagatggacaacctggatggctgtgacagctgcttccaggtgatcttcccccaggatgtgctgcggctgcgggcagagacccggcagagggcccaggagtggatggaggccctgaagattgctgccaacgtggcccggagcagcgagcagaacctgcaggtgaccctgaggaacaagcccaaggaccagatgggcggccacgagctgaggaagaacaagaggcagagcgtgaccaccagcttcctgagcatcctgaccaccctgagcctggagcggggcctgacagcccagagcttcaagtgtgccggctgccagaggagcatcggcctgagcaatggcaaggccaaggtgtgcaactacagcggctggtactactgcagcagctgccacgtggatgacagcttcctgatcccagcccgcatcgtgcacaactgggacaccagcaagtacaaggtgtccaagcaggccaaggagttcctggagtatgtgtatgaggagcccctgattgacatccagcaggagaatgccatgctgtaccaccacgccgagcccctggccgctgtgctgcggctgcggcagaggctgaagagcctgcgggcctacctgttcagctgcagagctgctgtggccgaggacctgcggcggcgcatcttcccccgggagtacctgctgcagcagatccacctgtacagcctggccgacctgcagcaggtgattgagggcaagctggcccccttcctgggcaaggtgatcaagtttgccaccagccacgtgtacagctgcagcctgtgcagccagaagggcttcatctgtgagatctgcaacaatggagagatcctgtacccctttgaggacatcagcaccagccgctgtgagagctgtggggctgtgttccacagcgagtgcaaggagaagtctgtgccctgcccccgctgtgtgagaagagagctgcagaagaagcagaagagcttctggcagaggctgaacatggatgagagcctggaggaggcctgcaccatgtttgagctgagctaccagaacacctag

SEQ ID NO: 40794 - DNA, 1410 bp, Artificial Sequence
  Description of Artificial Sequence: Synthetic coding sequence
tgaaaccagaacctgtatgccacctaccagctgagccacttccagagcatctctgtgctgggcaacctggaggccaggatggtggacacagtgctgtatgacaacacccagctgcagctgaaggccgagagcccctgggaggccctggactggggccagaagctgtgggaggtggtgcatgctgctgtgcccggctacatgggccggcagaatgagctgaccatcagccctggcctgggccaccatgatgactacacccagaaccacagcttccagaagaagaccagcggcctgctgccccccagccctgtgctggacagcagcaagcagtaccagaacatcctgaagagcggcaccctgtaccgcctgactgtgcagaacaactggaaggccttcacctttgtgctgagccgggcctacctgatggccttccagcccgggaagctggatgaggaccccctgctgagctacaacgtggatgtgtgcctggccgtgcagatggacaacctggatggctgtgacagctgcttccaggtgatcttcccccaggatgtgctgcggctgcgggcagagacccggcagagggcccaggagtggatggaggccctgaagattgctgccaacgtggcccggagcagcgagcagaacctgcaggtgaccctgaggaacaagcccaaggaccagatgggcggccacgagctgaggaagaacaagaggcagagcgtgaccaccagcttcctgagcatcctgaccaccctgagcctggagcggggcctgacagcccagagcttcaagtgtgccggctgccagaggagcatcggcctgagcaatggcaaggccaaggtgtgcaactacagcggctggtactactgcagcagctgccacgtggatgacagcttcctgatcccagcccgcatcgtgcacaactgggacaccagcaagtacaaggtgtccaagcaggccaaggagttcctggagtatgtgtatgaggagcccctgattgacatccagcaggagaatgccatgctgtaccaccacgccgagcccctggccgctgtgctgcggctgcggcagaggctgaagagcctgcgggcctacctgttcagctgcagagctgctgtggccgaggacctgcggcggcgcatcttcccccgggagtacctgctgcagcagatccacctgtacagcctggccgacctgcagcaggtgattgagggcaagctggcccccttcctgggcaaggtgatcaagtttgccaccagccacgtgtacagctgcagcctgtgcagccagaagggcttcatctgtgagatctgcaacaatggagagatcctgtacccctttgaggacatcagcaccagcagatttggagacccctatgctgacctgctgcagggctacgtggcctag

SEQ ID NO: 40795 - DNA, 1731 bp, Artificial Sequence
  Description of Artificial Sequence: Synthetic coding sequence
atgggcaacagccactgtgtgccccaggccccccggcggctgcgggccagcttcagcaggaagcccagcctgaagggcaacagagaagattctgccaggatgtctgctggcctgcccggccctgaggccgcccggtctggagatgctgctgccaacaagctgttccactacatccctggaacagacatcctggacctggagaaccagcgggagaacctggagcagcccttcctgtctgtgttcaagaagggcagaagaagagtgcctgtgaggaacctgggcaaggtggtgcactacgccaaggtgcagctgcgcttccagcacagccaggatgtgtctgactgctacctggagctgtttcctgcccacctgtacttccaggcccacggcagcgagggcctgaccttccagggcctgctgcccctgacagagctgtctgtgtgccccctggagggcagccgggagcacgccttccagatcaccggccccctgcctgcccccctgctggtgctgtgccccagcagagctgagctggaccgctggctgtaccacctggagaagcagacagccctgctgggcggcccccggcgctgccacagcgccccaccccagggcagctgtggagatgagctgccctggaccctgcagaggcggctgacccggctgaggacagccagcggccacgagcccggcggcagcgctgtgtgtgccagccgggtgaagctgcagcacctgcctgcccaggagcagtgggaccggctgctggtgctgtaccccaccagcctggccatcttcagcgaggagctggatggcctgtgcttcaagggggagctgcccctgcgggctgtgcacatcaacctggaggagaaggagaagcagatccgctccttcctgattgagggccccctcatcaacaccatccgggtggtgtgtgccagctatgaagattatggccactggctgctgtgcctgcgggctgtgacccaccgggagggcgccccacccctgcctggagctgagagcttccctggcagccaggtgatgggcagcggccggggcagcctgagcagcggcggccagacctcctgggacagcggctgcctggccccacccagcaccaggaccagccacagcctgcctgagagctctgtgcccagcacagtgggctgcagcagccagcacacccccctgcaccggctgagcctggagagcagcccagatgccccagaccacaccagcgagaccagccacagccccctgtatgctgacccctacaccccaccagccaccagccacagaagagtgacagatgtgcggggcctggaggagttcctgagcgccatgcagagcgcccggggccccacccccagcagccccctgcccagcgtgcctgtgtctgtgcctgccagtgaccccaggagctgcagcagcggccctgctggcccctacctgctgagcaagaagggggccctgcagagcagagctgcccagaggcaccggggcagcgccaaggatggcggcccccagcccccagatgccccccagctggtgtcctctgcccgggagggcagccctgagccctggctgcccctgacagatggccgcagcccccggcgcagccgggaccccggctatgaccacctgtgggatgagaccctgagcagcagccaccagaagtgcccccagctgggcggccctgaggccagcggcggcctggtgcagtggatctag

SEQ ID NO: 40796 - DNA, 1992 bp, Artificial Sequence
  Description of Artificial Sequence: Synthetic coding sequence
atgggcaacagccactgtgtgccccaggccccccggcggctgcgggccagcttcagcaggaagcccagcctgaagggcaacagagaagattctgccaggatgtctgctggcctgcccggccctgaggccgcccggtctggagatgctgctgccaacaagctgttccactacatccctggaacagacatcctggacctggagaaccagcgggagaacctggagcagcccttcctgtctgtgttcaagaagggcagaagaagagtgcctgtgaggaacctgggcaaggtggtgcactacgccaaggtgcagctgcgcttccagcacagccaggatgtgtctgactgctacctggagctgtttcctgcccacctgtacttccaggcccacggcagcgagggcctgaccttccagggcctgctgcccctgacagagctgtctgtgtgccccctggagggcagccgggagcacgccttccagatcactggagtgtgggatgccagccgggccccccggggcaccccagaccccggcctgggggagggccctgccctgtggctgcggagcacctgtgtgtatgtgtgtgccctgagcgccctgcctgctggccccctgcctgcccccctgctggtgctgtgccccagcagagctgagctggaccgctggctgtaccacctggagaagcagacagccctgctgggcggcccccggcgctgccacagcgccccaccccagggcagctgtggagatgagctgccctggaccctgcagaggcggctgacccggctgaggacagccagcggccacgagcccggcggcagcgctgtgtgtgccagccgggtgaagctgcagcacctgcctgcccaggagcagtgggaccggctgctggtgctgtaccccaccagcctggccatcttcagcgaggagctggatggcctgtgcttcaagggggagctgcccctgcgggctgtgcacatcaacctggaggagaaggagaagcagatccgctccttcctgattgagggccccctcatcaacaccatccgggtggtgtgtgccagctatgaagattatggccactggctgctgtgcctgcgggctgtgacccaccgggagggcgccccacccctgcctggagctgagagcttccctggcagccaggtgatgggcagcggccggggcagcctgagcagcggcggccagacctcctgggacagcggctgcctggccccacccagcaccaggaccagccacagcctgcctgagagctctgtgcccagcacagtgggctgcagcagccagcacaccccagaccaggccaacagcgaccgggccagcatcggcagaagaagaacagagctgcggcgcagcggcagcagccgcagccctggcagcaaggcccgggcagagggccggggccctgtgacccccctgcacctggacctgacccagctgcaccggctgagcctggagagcagcccagatgccccagaccacaccagcgagaccagccacagccccctgtatgctgacccctacaccccaccagccaccagccaccggcgggtgacagatgtgcggggcctggaggagttcctgagcgccatgcagagcgcccggggccccacccccagcagccccctgcccagcgtgcctgtgtctgtgcctgccagtgaccccaggagctgcagcagcggccctgctggcccctacctgctgagcaagaagggggccctgcagagccgggccgcccagaggcaccggggcagcgccaaggatggcggcccccagcccccagatgccccccagctggtgagcagcgcccgggagggcagccctgagccctggctgcccctgacagatggccgcagccccaggaggagccgggaccccggctatgaccacctgtgggatgagaccctgagcagcagccaccagaagtgcccccagctgggcggccctgaggccagcggcggcctggtgcagtggatctag

SEQ ID NO: 40797 - DNA, 1836 bp, Artificial Sequence
  Description of Artificial Sequence: Synthetic coding sequence
atgggcaacagccactgtgtgccccaggccccccggcggctgcgggccagcttcagcaggaagcccagcctgaagggcaacagagaagattctgccaggatgtctgctggcctgcccggccctgaggccgcccggtctggagatgctgctgccaacaagctgttccactacatccctggaacagacatcctggacctggagaaccagcgggagaacctggagcagcccttcctgtctgtgttcaagaagggcagaagaagagtgcctgtgaggaacctgggcaaggtggtgcactacgccaaggtgcagctgcgcttccagcacagccaggatgtgtctgactgctacctggagctgtttcctgcccacctgtacttccaggcccacggcagcgagggcctgaccttccagggcctgctgcccctgacagagctgtctgtgtgccccctggagggcagccgggagcacgccttccagatcaccggccccctgcctgcccccctgctggtgctgtgccccagcagagctgagctggaccgctggctgtaccacctggagaagcagacagccctgctgggcggcccccggcgctgccacagcgccccaccccagaggcggctgacccggctgaggacagccagcggccacgagcccggcggcagcgctgtgtgtgccagccgggtgaagctgcagcacctgcctgcccaggagcagtgggaccggctgctggtgctgtaccccaccagcctggccatcttcagcgaggagctggatggcctgtgcttcaagggggagctgcccctgcgggctgtgcacatcaacctggaggagaaggagaagcagatccgctccttcctgattgagggccccctcatcaacaccatccgggtggtgtgtgccagctatgaagattatggccactggctgctgtgcctgcgggctgtgacccaccgggagggcgccccacccctgcctggagctgagagcttccctggcagccaggtgatgggcagcggccggggcagcctgagcagcggcggccagacctcctgggacagcggctgcctggccccacccagcaccaggaccagccacagcctgcctgagagctctgtgcccagcacagtgggctgcagcagccagcacaccccagaccaggccaacagcgaccgggccagcatcggcagaagaagaacagagctgcggcgcagcggcagcagccgcagccctggcagcaaggcccgggcagagggccggggccctgtgacccccctgcacctggacctgacccagctgcaccggctgagcctggagagcagcccagatgccccagaccacaccagcgagaccagccacagccccctgtatgctgacccctacaccccaccagccaccagccaccggcgggtgacagatgtgcggggcctggaggagttcctgagcgccatgcagagcgcccggggccccacccccagcagccccctgcccagcgtgcctgtgtctgtgcctgccagtgaccccaggagctgcagcagcggccctgctggcccctacctgctgagcaagaagggggccctgcagagccgggccgcccagaggcaccggggcagcgccaaggatggcggcccccagcccccagatgccccccagctggtgagcagcgcccgggagggcagccctgagccctggctgcccctgacagatggccgcagccccaggaggagccgggaccccggctatgaccacctgtgggatgagaccctgagcagcagccaccagaagtgcccccagctgggcggccctgaggccagcggcggcctggtgcagtggatctag

SEQ ID NO: 40798 - DNA, 1473 bp, Artificial Sequence
  Description of Artificial Sequence: Synthetic coding sequence
atggaggaggagggcgtgaaggaggccggggagaagcccaggggggcccagatggtggacaaggccggctggatcaagaagagcagcggcggcctgctgggcttctggaaggaccgctacctgctgctgtgccaggcccagctgctggtgtatgaaaatgaagatgaccagaagtgtgtggagaccgtggagctgggcagctatgagaagtgccaggacctgcgggccctgctgaagaggaagcaccgcttcatcctgctgcggagccctggcaacaaggtgtctgacatcaagttccaggcccccactggagaggagaaggagagctggatcaaggccctgaatgaaggcatcaacagaggcaagaacaaggcctttgatgaggtgaaggtggacaagagctgtgccctggagcacgtgacccgggacagagtgcggggcggccagaggagaagaccacccaccagggtgcacctgaaggaggtggccagcgctgccagtgatggcctgctgcggctggacctggatgtgcctgacagcggcccccctgtgtttgcccccagcaaccacgtgtctgaggcccagccccgggagaccccccggcccctgatgccacccaccaagcccttcctggcccctgagaccaccagccctggggacagagtggagacccctgtgggggagcgggcccccacccctgtgtctgccagcagcgaggtgtccccagagagccaggaggacagcgagaccccagctgaggaggacagcggcagcgagcagccccccaacagcgtgctgcctgacaagctgaaggtgtcctgggagaaccccagcccccaggaggccccagctgctgagagcgctgagcccagccaggccccctgcagcgagaccagcgaggccgccccccgggagggcggcaagccacccaccccaccacccaagatcctgtctgagaagctgaaggcctccatgggagagatgcaggccagcggccccccagcccctggcaccgtgcaggtgtctgtgaatggcatggatgacagccctgagcccgccaagcccagccaggccgagggcaccccaggcaccccacccaaggatgccaccaccagcacagccctgcccccctgggacctgcccccccagttccacccccgctgcagcagcctgggggacctgctgggggagggccccaggcaccccctgcagccccgggagcggctgtaccgggcccagctggaggtgaaggtggccagcgagcagacagagaagctgctgaacaaggtgctgggcagcgagcccgcccctgtgtctgctgagaccctgctgagccaggccgtggagcagctgcggcaggccacccaggtgctgcaggagatgagggacctgggggagctgagccaggaggcccctggcctgcgggagaagaggaaggagctggtgaccctgtaccgccgcagcgccccctag

SEQ ID NO: 40799 - DNA, 672 bp, Artificial Sequence
  Description of Artificial Sequence: Synthetic coding sequence
atggaggaggagggcgtgaaggaggccggggagaagcccaggggggcccagatggtggacaaggccggctggatcaagaagagcagcggcggcctgctgggcttctggaaggaccgctacctgctgctgtgccaggcccagctgctggtgtatgaaaatgaagatgaccagaagtgtgtggagaccgtggagctgggcagctatgagaagtgccaggacctgcgggccctgctgaagaggaagcaccgcttcatcctgctgcggagccctggcaacaaggtgtctgacatcaagttccaggcccccactggagaggagaaggagagctggatcaaggccctgaatgaaggcatcaacagaggcaagaacaaggcctttgatgaggtgaaggtggacaagagctgtgccctggagcacgtgacccgggacagagtgcggggcggccagaggagaagaccacccaccagggtgcacctgaaggaggtggccagcgctgccagtgatggcctgctgcggctggacctggatgtgcctgacagcggcccccctgtgtttgcccccagcaaccacgtgtctgaggcccagccccgggagaccccccggcccctgatgccacccaccaagcccttcctggcccctgagaccaccagccccagcagccacctgttctag

SEQ ID NO: 40800 - DNA, 1923 bp, Artificial Sequence
  Description of Artificial Sequence: Synthetic coding sequence
atgggcaccaggagcagccctgaggagggcaccccaccacccctggtgcctgaatgtgatgtggaggtgcagccccagggccaccctgaggagagccgggagcaggaggccagcgaggtgctggccgagcccagcagccggggcggcgctgagcagcaggccgaggaggaggaggtgggggagggcagcagcacagagagcagcagagatgcccctgaggccaccccacccatcgccatggccgccaccccaccagccagcaccagcagccgggagggcgtgagaggagctgcccggcggctgcagggccagcagctggaggccctgaccagggtggccctgatggagcagagggtgaaggagctgcagaggcagaggaaggagctgagaattgagatggaggtggaggtggccctgctgcggggggagctggccggggagcgggtggccgcccggcgggaggaggagcagctgcgggagctgctggagcagcaggccgccagcgagcagaggggccggcagcagcgggagcaggagcagaggcggctgagccaggagcgggaccggctggagggcctgcggcagaggctgaggaaggcccagggccagctggacagccagcctgaggaccagcgggagcggctgctgcagggcgtgcaggagatgagggagcagctggatgtggcccagagggcctatgaggacctggagttccagcagctggagcgggagagccggcaggaggaggaggaccgggacagccctggcccccaggtgcctgaccccaaggtgcaggagctgcaggcctccatggcccagcacagaagaggagccctgcagcaccgcatccgggtgctggaggagcagctgaagagcctgggggagcagatggctgctgagagccggggcctgagcaggaagaaggaggaggccctgcaggccctgagccaggagaggagccggctgctggagctgaactgcctgcagggcaccccaggaggagacttcagcgagcccaacccagccctgaccaagctgctcttcacccagaagacagaccggcagctgctggtgctgcaggatgctgtggcccacagcgctgccacccccaccagcagctgcctcttctctgtgcacagcagcctgcagggcagcatcggcctgcagaggacaggcagcctgcccaggaagagaggagagcggggcagccagaggggcagcccccggcccctgtccttccactgcacagagagcctggaggccagcgccctgcccccagctgtgggggacagcggccgctaccccctgtaccagctgctgaactgtggccggggcaacagctgtggggccatccacccagacatcgcccacatggagcggctgctgcagcaggccatggccgagcgggagcggctgctgaaggcccgggagggcacccggcggggcacagagggcagcagcggccctgctgtgcctgccatcacagccccacccaccccaccccaccccccaggcccccgcatcctggacctgcggcagcacctggagggctggggccacaaccctgagaactgcccccacgtgcaggtgtctggctgctgctgccggggccccctggtgaagatgggcggccgcatcaagacctggaggaagcgctggttctgctttgaccggcaggcccggcggctggcctactatgctgacaaggaggagaccaagctgaagggcgtcatctacttccaggccatcgaggaggtgtactatgaccacctgcgctgtgccttcaagagccccaacccccggctgaccttctgtgtgaagacctatgagcggctcttctacatggtggcccccagccctgaggccatgaggatctggatggatgtgattgtgacagctgctgatgagaaccacgccccctag

SEQ ID NO: 40801 - DNA, 528 bp, Artificial Sequence
  Description of Artificial Sequence: Synthetic coding sequence
atggccgaggccagcagcgccaacctgggcagcggctgtgaggagaagagacatgagggcagcagcagcgagagcgtgcccccaggcaccaccatcagccgggtgaagctgctggacaccatggtggacaccttcctgcagaagctggtggccgccggcagctaccagcgcttcacagactgctacaagtgcttctaccagctgcagcctgccatgacccagcagatctatgacaagttcatcgcccagctgcagaccagcatccgggaggagatcagtgacatcaaggaggagggcaacctggaggccgtgctgaatgccctggacaagatcgtggaggagggcaaggtgaggaaggagcccgcctggtgtgaggcccagcgctgccgggtgcagcagcgctgcagcctgtgtgtgcaggccggcggccagaggggcagcgaggagacccaggccctgcctgtgtccatggccggcagccccagccccctgcccggcagccctggggcccaggagggcggcgtgtag

SEQ ID NO: 40802 - DNA, 663 bp, Artificial Sequence
  Description of Artificial Sequence: Synthetic coding sequence
atggccgaggccagcagcgccaacctgggcagcggctgtgaggagaagagacatgagggcagcagcagcgagagcgtgcccccaggcaccaccatcagccgggtgaagctgctggacaccatggtggacaccttcctgcagaagctggtggccgccggcagctaccagcgcttcacagactgctacaagtgcttctaccagctgcagcctgccatgacccagcagatctatgacaagttcatcgcccagctgcagaccagcatccgggaggagatcagtgacatcaaggaggagggcaacctggaggccgtgctgaatgccctggacaagatcgtggaggagggcaaggtgaggaaggagcccgcctgcaatggcaccccctgtggggccatgtgcaggaacagaagacccaggaccagctcctggcagatgcccagctggcagggcggcggccgctggaggagctgcagctaccgcagccggcccagcagccggcccggccgctgtgaggcccagcgctgccgggtgcagcagcgctgcagcctgtgtgtgcaggccggcggccagaggggcagcgaggagacccaggccctgcctgtgtccatggccggcagccccagccccctgcccggcagccctggggcccaggagggcggcgtgtag

SEQ ID NO: 40803 - DNA, 2010 bp, Artificial Sequence
  Description of Artificial Sequence: Synthetic coding sequence
atggcccaccacctgcctgctgccatggagagccaccaggacttccgcagcatcaaggccaagttccaggccagccagcctgagcccagcgacctgcccaagaagccacccaagccagagtttgggaagctgaagaagttcagccagcctgagctgtctgagcaccccaagaaggcccccctgcctgagtttggagctgtgtccctgaagcccccacctcctgaggtgacagacctgcccaagaagcccccacctcctgaggtgacagacctgcccaagaagcccccacctcctgaggtgacagacctgcccaagaagcccccacctcctgaggtgacagacctgcccaagaagcccagcaagctggagctgagtgacctgagcaagaagttcccccagctgggcgccacccccttccccaggaagcccctgcagcctgaggtgggggaggcccccctgaaggccagcctgcctgagcccggggccccagccaggaagcccctgcagccagatgagctgagccacccagcccggcccccatctgagcccaagagcggggccttccccaggaagctgtggcagcctgaggccggggaggccacccccaggagcccccagcctgagctgagcaccttccccaagaagccagcccagcctgagttcaacgtgtaccccaagaagccaccccagccccaggtgggcggcctgcccaagaagtctgtgccccagcctgagttcagcgaggccgcccagacccccctgtggaagccccagagcagcgagcccaagagggacagcagcgccttccccaagaaggccagccagccccccctgagtgacttccccaagaagccaccccagcctgagctgggggacctgaccaggaccagcagcgagcctgaggtgtctgtgctgcccaagaggcccaggcctgctgagttcaaggccctgagcaagaagccaccccagcctgagctgggcggcctgcccaggaccagcagcgagcctgagttcaacagcctgcccaggaagctgctgcagcctgagcggcggggcccccccaggaagttcagccagcctgagcccagcgctgtgctgaagaggcacccccagcctgagttctttggagacctgcccaggaagccacccctgcccagcagcgccagcgagagcagcctgcctgctgctgtggccggcttcagcagccgccaccccctgagccctggctttggagctgctggcaccccccgctggaggtctgggggcctggtgcacagcggcggggcccggcccggcctgcggcccagccacccccccaggagaagacccctgcccccagccagcagcctgggccaccccccagccaagccacccctgcccccaggccctgtggacatgcagagcttccggcggcccagcgctgccagcattgacctgcggaggaccaggtctgctgctggcctgcacttccaggaccggcagcctgaggacatccctgtgcctgatgagatctatgagctgtatgatgatgtggagcccagagatgacagcagccccagccccaagggcagagatgaggcccccagcgtgcagcaggccgcccggcggcccccccaggaccctgccctgaggaaggagaaggacccccagccccagcagctgccccccatggaccccaagctgctgaagcagctgaggaaggccgagaaggccgagcgggagttcaggaagaagttcaagtttgaaggagaaattgtggtgcacaccaagatgatgattgaccccaatgccaagacccggcggggcggcggcaagcacctgggcatccggcggggggagatcctggaggtgattgagttcaccagcaatgaggagatgctgtgccgggaccccaagggcaagtatggctacgtgcccaggacagccctgctgcccctggagacagaggtgtatgatgatgtggacttctgtgaccccctggagaaccagcccctgcccctgggccgctag

SEQ ID NO: 40804 - DNA, 2013 bp, Artificial Sequence
  Description of Artificial Sequence: Synthetic coding sequence
atggcccaccacctgcctgctgccatggagagccaccaggacttccgcagcatcaaggccaagttccaggccagccagcctgagcccagcgacctgcccaagaagccacccaagccagagtttgggaagctgaagaagttcagccagcctgagctgtctgagcaccccaagaaggcccccctgcctgagtttggagctgtgtccctgaagcccccacctcctgaggtgacagacctgcccaagaagcccccacctcctgaggtgacagacctgcccaagaagcccccacctcctgaggtgacagacctgcccaagaagcccccacctcctgaggtgacagacctgcccaagaagcccagcaagctggagctgagtgacctgagcaagaagttcccccagctgggcgccacccccttccccaggaagcccctgcagcctgaggtgggggaggcccccctgaaggccagcctgcctgagcccggggccccagccaggaagcccctgcagccagatgagctgagccacccagcccggcccccatctgagcccaagagcggggccttccccaggaagctgtggcagcctgaggccggggaggccacccccaggagcccccagcctgagctgagcaccttccccaagaagccagcccagcctgagttcaacgtgtaccccaagaagccaccccagccccaggtgggcggcctgcccaagaagtctgtgccccagcctgagttcagcgaggccgcccagacccccctgtggaagccccagagcagcgagcccaagagggacagcagcgccttccccaagaaggccagccagccccccctgagtgacttccccaagaagccaccccagcctgagctgggggacctgaccaggaccagcagcgagcctgaggtgtctgtgctgcccaagaggcccaggcctgctgagttcaaggccctgagcaagaagccaccccagcctgagctgggcggcctgcccaggaccagcagcgagcctgagttcaacagcctgcccaggaagctgctgcagcctgagcggcggggcccccccaggaagttcagccagcctgagcccagcgctgtgctgaagaggcacccccagcctgagttctttggagacctgcccaggaagccacccctgcccagcagcgccagcgagagcagcctgcctgctgctgtggccggcttcagcagccgccaccccctgagccctggctttggagctgctggcaccccccgctggaggtctgggggcctggtgcacagcggcggggcccggcccggcctgcggcccagccacccccccaggagaagacccctgcccccagccagcagcctgggccaccccccagccaagccacccctgcccccaggccctgtggacatgcagagcttccggcggcccagcgctgccagcattgacctgcggaggaccaggtctgctgctggcctgcacttccaggaccggcagcctgaggacatcccccaggtgcctgatgagatctatgagctgtatgatgatgtggagcccagagatgacagcagccccagccccaagggcagagatgaggcccccagcgtgcagcaggccgcccggcggcccccccaggaccctgccctgaggaaggagaaggacccccagccccagcagctgccccccatggaccccaagctgctgaagcagctgaggaaggccgagaaggccgagcgggagttcaggaagaagttcaagtttgaaggagagatcgtggtgcacaccaagatgatgattgaccccaatgccaagaccaggagaggaggcggcaagcacctgggcatcagaagaggagagatcctggaggtgattgagttcaccagcaatgaggagatgctgtgccgggaccccaagggcaagtatggctacgtgcccaggacagccctgctgcccctggagacagaggtgtatgatgatgtggacttctgtgaccccctggagaaccagcccctgcccctgggccgctag

SEQ ID NO: 40805 - DNA, 72 bp, Artificial Sequence
  Description of Artificial Sequence: Synthetic coding sequence
aagttcagccagcctgaggtggccgagggcatgagccggcagaacctgggcctgaagctgcggggccgctag

SEQ ID NO: 40806 - DNA, 1320 bp, Artificial Sequence
  Description of Artificial Sequence: Synthetic coding sequence
atgagcaagaccatggccatgaacctgctggaggactggtgccggggcatggaggtggacatccacaggagcctgctggtgacaggcatccctgaggactgtggccaggccgagattgaggagaccctgaatggagtgctgagccccctgggcccctacagagtgctgaacaagatctttgtgcgggaggagaatgtgaaggccgccctgattgaggtgggggagggcgtgaacctgagcaccatcccccgggagttccctggccggggcggcgtgtggagggtggtgtgccgggaccccacccaggatgctgagttcctgaagaacctgaatgagttcctggatgctgagggccgcacctgggaggatgtggtgcggctgctgcagctgaaccaccccaccctgagccagaaccagcaccagcccccagagaactgggccgaggccctgggcgtgctgctgggcgctgtggtgcagatcatcttctgcatggatgctgagatccgcagccgggaggaggcccgggcccaggaggccgctgagtttgaggagatggccgcctgggccctggccgccggcaggaaggtgaagaaggagcccggcctggccgctgaggtgggcagcgccctgaaggccgagacccccaacaactggaatgccacagaggaccagcacgagcccaccaagcccctggtgagaagagctggggccaagagccgcagcaggaggaagaagcagaagaagaacagccggcaggaggccgtgccctggaagaagcccaagggcatcaacagcaacagcacagccaacctggaggaccctgaggtgggagatgctgagagcatggccatcagcgagcccatcaagggcagcaggaagccctgtgtgaacaaggaggagctggccctgaagaagcccatggccaagtgtgcctggaagggcccccgggagcccccccaggatgcccgggcagaggccgagagccctggaggagccagcgagagtgaccaggacggcggccacgagagcccccccaagaagaaggctgtggcctgggtgtctgccaagaacccagcccccatgaggaagaagaagaaggtgtccctgggccctgtgtcctatgtgctggtggacagtgaagatggcaggaagaagcctgtgatgcccaagaagggccctggcagccggcgggaggccagtgaccagaaggccccccggggccagcagcctgctgaggccacagccagcaccagccggggccccaaggccaagccagagggcagcccccggcgggccaccaatgaaagcaggaaggtgtag

SEQ ID NO: 40807 - DNA, 615 bp, Artificial Sequence
  Description of Artificial Sequence: Synthetic coding sequence
atgagcaagaccatggccatgaacctgctggaggactggtgccggggcatggaggtggacatccacaggagcctgctggtgacaggcatccctgaggactgtggccaggccgagattgaggagaccctgaatggagtgctgagccccctgggcccctacagagtgctgaacaagatctttgtgcgggaggagaatgtgaaggccgccctgattgaggtgggggagggcgtgaacctgagcaccatcccccgggagttccctggccggggcggcgtgtggagggtggtgtgccgggaccccacccaggatgctgagttcctgaagaacctgaatgagttcctggatgctgagggccgcacctgggaggatgtggtgcggctgctgcagctgaaccaccccaccctgagccagaaccagcaccagcccccagagaactgggccgaggccctgggcgtgctgctgggcgctgtggtgcagatcatcttctgcatggatgctgagatccgcagcagaagagaggagggggaggagaggactggagcctgcagcagaggaggcttctgcctgaagggccgggacccccagcagctggagtgccacggccgcccagcctag

SEQ ID NO: 40808 - DNA, 1137 bp, Artificial Sequence
  Description of Artificial Sequence: Synthetic coding sequence
atgagcaagaccatggccatgaacctgctggaggactggtgccggggcatggaggtggacatccacaggagcctgctggtgacaggcatccctgaggactgtggccaggccgagattgaggagaccctgaatggagtgctgagccccctgggcccctacagagtgctgaacaagatctttgtgcgggaggagaatgtgaaggccgccctgattgaggtgggggagggcgtgaacctgagcaccatcccccgggagttccctggccggggcggcgtgtggagggtggtgtgccgggaccccacccaggatgctgagttcctgaagaacctgaatgagttcctggatgctgagggccgcacctgggaggatgtggtgcggctgctgcagctgaaccaccccaccctgagccagaaccagcaccagcccccagagaactgggccgaggccctgggcgtgctgctgggcgctgtggtgcagatcatcttctgcatggatgctgagatccgcagccgggaggaggcccgggcccaggaggccgctgagtttgaggagatggccgcctgggccctggccgccggcaggaaggtgaagaaggagcccggcctggccgctgaggtgggcagcgccctgaaggccgagacccccaacaactggaatgccacagaggaccagcacgagcccaccaagcccctggtgagaagagctggggccaagagccgcagcaggaggaagaagcagaagaagaacagccggcaggaggccgtgccctggaagaagcccaagggcatcaacagcaacagcacagccaacctggaggaccctgaggtgggagatgctgagagcatggccatcagcgagcccatcaagggcagcaggaagccctgtgtgaacaaggaggagctggccctgaagaagcccatggccaagtgtgcctggaagggcccccgggagcccccccaggatgcccgggcagaggccgagagccctggaggagccagcgagagtgaccaggacggcggccacgagagcccccccaagaagaaggctgtggcctgggtgtctgccaagaacccagcccccatgaggaagaagaagaagaaccctgagagatttgacctgggggaccacccctactag

SEQ ID NO: 40809 - DNA, 840 bp, Artificial Sequence
  Description of Artificial Sequence: Synthetic coding sequence
atggccatgagcctgctgcaggactggtgccgcagcctggatgtggatgcccaccgggccctgctggtgacaggcatccctgagggcctggagcaggctgatgtggaggccgtgctgcagcccaccctgctgcccctgggcaccttccggctgcggcacatgaaggccctgatgaatgagaaggcccaggccgccctggtggagtttgtggaggatgtgaaccacgccgccatcccccgggagatccctgggaaggatggagtgtggagggtgctgtggaaggaccgggcccaggacaccagggtgctgcggcagatgaggcggctgctgctggatgatggccccacccaggccgctgaggccggcaccccaggagaggcccccaccccaccagccagcgagacccaggcccaggacagcggggaggtgacaggccaggccggcagcctgctgggcgccgccaggaacccccggcggggcagaagaggaagaagaaacagaacaagaagaaaccggctgacccagaagggcaagaagaggagcagaggaggccggcccagcgccccagcccggtctgaggccgaggacagcagtgatgagagcctgggcatcgtcatcgaggagattgaccagggcgacctgtctggagaggaggaccagagcgccctgtatgccaccctgcaggccgccgcccgggagctggtgcggcagtgggccccctgcaacagcgagggcggcccctgccccacctgcccctgggagggcatcggcggcttcggctgtgacctgactgtgcagacccggctgagccagagctatgtgcgggacacccagatgtag

SEQ ID NO: 40810 - DNA, 1221 bp, Artificial Sequence
  Description of Artificial Sequence: Synthetic coding sequence
atggcctggtgtgtggccacagctgaccctgcccacaccagccggcccctcttcaccggcctggccgtgtcccggggcagcgctggccacgcctggagcgctggctttgactgggccgctgtggtggtggtgactggaagacgctgccgcagcggccagacagtgcctggggccgcccggagccccctgctgccccaccccctgcccagccccctgcgggtgcccccacccaccggggccctgggccggcccctgccccgctggccccagcccaggaggacccccttctggagcgtcatcagcaaggccaccaagctgcggagccccccctggaccagcgcccccacagccagcaacctggagcgggaccggcgcatcagcagaattgaccccatccgcagccccaccatggccggcggcctgtttgctgtgtccaagaagtacttccagtacctgggcacctatgacaccggcatggaggtgtggggcggggagaacctggagctgtccttccgggtgtggcagtgtggcggcaagctggagatccacccctgcagccacgtgggccacgtgttccccaagagggccccctatgcccggcccaacttcctgcagaacacagcccgggctgctgaggtgtggatggatgagtacaaggagcacttctacaacagaaatcctccagccaggaaggaggcctacggggacatcagcgagaggaagctgctgcgggagcggctgcgctgcaagagctttgactggtacctgaagaatgtgttccccaacctgcacgtgcctgaagatcggcccggctggcatggagccatccgcagccggggcatcagcagcgagtgcctggactacaacagcccagacaacaaccccaccggggccaacctgagcctgtttggctgccacggccagggcggcaaccagttctttgagtacaccagcaacaaggagatccgcttcaacagcgtgacagagctgtgtgccgaggtgcctgagcagaagaactacgtgggcatgcagaactgccccaaggatggcttccctgtgcctgccaacatcatctggcacttcaaggaggatggcaccatcttccacccccacagcggcctgtgcctgagcgcctaccgcaccccagagggccgcccagatgtgcagatgaggacctgtgatgccctggacaagaaccagatctggagctttgagaagtag

SEQ ID NO: 40811 - DNA, 1728 bp, Artificial Sequence
  Description of Artificial Sequence: Synthetic coding sequence
atggccagcgccacagaggaccctgtgctggagcgctacttcaagggccacaaggccgccatcaccagcctggacctgagccccaacgggaagcagctgggcgccggccgggcccgggagctgggcagccggcggctgagtgacctgcagaagaacacagaggacctgagccggcccctgtacaagaagcccccagctgacagccgggccctgggggagtggggcaaggccagcaagctgcagctgaatgaagatgagctgaagcagcaggaggagctgattgaaagatatgccatcaacatctacctgagtgaccgcatcagcctgcaccgccacatcgaggacaagaggatgtatgagtgcaagagccagaagttcaactaccgcaccctgcccaccaccagcgtcatcatcgccttctacaatgaggcctggagcaccctgctgcggaccatccacagcgtgctggagaccagccctgctgtgctgctgaaggagatcatcctggtggatgacctgagtgacagagtgtacctgaagacccagctggagacctacatcagcaacctggacagagtgcggctcatccgcaccaacaagcgggagggcctggtgcgggcccggctcatcggggccacctttgccactggagatgtgctgaccttcctggactgccactgtgagtgcaacagcggctggctggagcccctgctggagagaattggaagagatgaaacagctgtggtgtgccctgtgattgacaccatcgactggaacacctttgagttctacatgcagattggagagcccatgattggaggctttgactggaggctgaccttccagtggcacagcgtgcccaagcaggagcgggaccggcgcatcagcagaattgaccccatccgcagccccaccatggccggcggcctgtttgctgtgtccaagaagtacttccagtacctgggcacctatgacaccggcatggaggtgtggggcggggagaacctggagctgtccttccgggtgtggcagtgtggcggcaagctggagatccacccctgcagccacgtgggccacgtgttccccaagagggccccctatgcccggcccaacttcctgcagaacacagcccgggctgctgaggtgtggatggatgagtacaaggagcacttctacaacagaaaccccccagccaggaaggaggcctatggagacatcagcgagaggaagctgctgcgggagcggctgcgctgcaagagctttgactggtacctgaagaatgtgttccccaacctgcacgtgcctgaggacaggcctggctggcacggggccatccgcagccggggcatcagcagtgaatgtctggactacaacagcccagacaacaaccccactggagccaacctgagcctgtttggctgccacggccagggcggcaaccagttctttgagtacaccagcaacaaggagatccgcttcaacagcgtgacagagctgtgtgccgaggtgcctgagcagaagaactacgtgggcatgcagaactgccccaaggatggcttccctgtgcctgccaacatcatctggcacttcaaggaggatggcaccatcttccacccccacagcggcctgtgcctgagcgcctaccgcaccccagagggccgcccagatgtgcagatgaggacctgtgatgccctggacaagaaccagatctggagctttgagaagtag

SEQ ID NO: 40812 - DNA, 1476 bp, Artificial Sequence
  Description of Artificial Sequence: Synthetic coding sequence
atggagaatgaggagagtgatgtgaagcccccagactggcccaaccccatgaatgccaccagccagttcccccagccccagcactttgacagctttggcctgcggctgccccgggacatcacagagctgcctgagtggagcgagggctaccccttctacatggccatgggcttccctggctatgacctgtctgcagatgacattgctgggaagttccagttcagccggggcatgagaagaagctatgatgctggcttcaagctgatggtggtggagtatgcagagagcaccaacaactgccaggccgccaagcagtttggagtgctggagaagaatgtgcgggactggaggaaggtgaagccccagctgcagaatgcccacgccatgaggcgggccttccggggccccaagaatggccgctttgccctggtggaccagagggtggccgagtatgtgcgctacatgcaggccaagggggaccccatcacccgggaggccatgcagctgaaggccctggagatcgcccaggagatgaacatccctgagaagggcttcaaggccagcctgggctggtgcaggaggatgatgagaagatatgacctgagcctgcggcacaaggtgcctgtgccccagcacctgcctgaggacctgacagagaagctggtgacctaccagaggtctgtgctggccctgcggcgggcccatgactatgaggtggcccagatgggaaatgctgatgagacccccatctgcctggaggtgcccagccgggtgacagtggacaaccagggcgagaagcctgtgctggtgaagaccccaggccgggagaagctgaagatcacagccatgctgggcgtgctggctgatggcaggaagctgcccccctacatcatcctgcggggcacctacatccccccaggcaagttccccagcggcatggagatccgctgccacagatatggctggatgacagaggacctgatgcaggactggctggaggtggtgtggaggagaagaactggagctgtgcccaagcagaggggcatgctgatcctgaatggcttccggggccacgccacagacagcgtgaagaacagcatggagagcatgaacacagacatggtgatcatccctgggggcctgaccagccagctgcaggtgctggatgtggtggtgtacaagcccctgaatgattctgtgcgggcccagtacagcaactggctgctggccggcaacctggccctgagccccactggaaatgccaagaagccacccctgggcctcttcctggagtgggtgatggtggcctggaacagcatcagcagcgagagcatcgtgcagggcttcaagaagtgccacatcagcagcaacctggaggaggaggatgatgtgctgtgggagattgagagcgagctgcccggcggcggggagccccccaaggactgtgacacagagagcatggccgagagcaactag

SEQ ID NO: 40813 - DNA, 1011 bp, Artificial Sequence
  Description of Artificial Sequence: Synthetic coding sequence
atgtacacagtgctgaccggcaccccacccttcatggccagccccctgtctgagatgtaccagaacatccgggagggccactacccagagcccgcccacctgagcgccaatgcccggcggctcatcgtgcacctgctggcccccaacccagctgagcggcccagcctggaccacctgctgcaggatgacttcttcacccagggcttcaccccagaccggctgcctgcccacagctgccacagcccccccatctttgccatccccccacccctgggccgcatcttcaggaaggtgggccagaggctgctgacccagtgccggcccccctgccccttcacccccaaggaggccagcggccctggagagggcggccctgaccctgacagcatggagtgggatggagagagcagcctgagcgccaaggaggtgccctgcctggagggccccatccacctggtggcccagggcaccctgcagagcgacctggccggccctgagggcagcagaagacctgaggtggaggccgccctgcggcacctgcagctgtgcctggatgtgggccccccagccacccaggaccccctgggggagcagcagcccatcctgtgggcccccaagtgggtggactacagcagcaaatatggcttcggctaccagctgctggatggcggccgcacaggccgccacccccacggccctgccaccccaagaagagagggcaccctgcccacccctgtgcccccagctggccctggcctgtgcctgctgcgcttcctggccagcgagcacgccctgctgctgctcttcagcaatggcatggtgcaggtgtccttctctggagtgcctgcccagctggtgctgagcggggagggggagggcctgcagctgaccctgtgggagcagggcagccctggcaccagctacagcctggatgtgcccaggagccacggctgtgcccccaccaccggccagcacctgcaccacgccctgaggatgctgcagagcatctag

SEQ ID NO: 40814 - DNA, 1893 bp, Artificial Sequence
  Description of Artificial Sequence: Synthetic coding sequence
atggacatcaagggccagttctggaatgatgatgattctgagggggacaatgaaagtgaggagttcctgtatggagtgcagggcagctgtgccgctgacctgtaccgccacccccagctggatgctgacatcgaggccgtgaaggagatctacagtgaaaattctgtgtccatccgggagtatggcaccattgatgatgtggacatcgacctgcacatcaacatctccttcctggatgaggaggtgtccacagcctggaaggtgctgaggacagagcccatcgtgctgcggctgcgcttcagcctgagccagtacctggatggccctgagcccagcattgaggtgttccagcccagcaacaaggagggcttcggcctgggcctgcagctgaagaagatcctgggcatgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggccggcctgctgtgcccccagcacgtgggcctgcccccaccagcccggaccagccccctggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccaccggggctgaggtggtggacctgctggtggccatgtgccgggccgccctggagagccccaggaagagcatcatctttgagccctaccccagcgtggtggaccccacagaccccaagaccctggccttcaaccccaagaagaagaactatgagcggctgcagaaggccctggacagcgtgatgagcatccgggagatgacccagggcagctacctggagatcaagaagcagatggacaagctggaccccctggcccaccccctgctgcagtggatcatcagcagcaacagaagccacatcgtgaagctgcccctgagccggctgaagttcatgcacaccagccaccagttcctgctgctgagcagccccccagccaaggaggcccgcttcagaacagccaagaagctgtatggcagcacctttgccttccacggcagccacatcgagaactggcacagcatcctgagaaatggcctggtgaatgccagctacaccaagctgcagctgcatggagctgcctacggcaagggcatctacctgagccccatcagcagcatcagctttggctacagcggcatgggcaagggccagcacaggatgcccagcaaggatgagctggtgcagcgctacaacaggatgaacaccatcccccagaccaggagcatccagagccgcttcctgcagagcaggaacctgaactgcatcgccctgtgtgaggtgatcaccagcaaggacctgcagaagcacggcaacatctgggtgtgccctgtgtctgaccacgtgtgcacccgcttcttctttgtgtatgaagatggccaggtgggagatgccaacatcaacacccaggaccccaagatccagaaggagatcatgagggtgattggcacccaggtgtacaccaactag

SEQ ID NO: 40815 - DNA, 405 bp, Artificial Sequence
  Description of Artificial Sequence: Synthetic coding sequence
atgctgctggtgctgctgtctgtggtgctgctggccctgagcagcgcccagagcacagacaatgatgtgaactatgaggacttcaccttcaccatcccagatgtggaggacagcagccagaggccagaccagggcccccagaggcctcctcctgagggcctgctgccccggcccccaggggacagcggcaaccaggatgatggcccccagcagaggcctcccaagccaggcggccaccaccgccaccccccacctccacccttccagaaccagcagaggcctccccggcggggccaccggcagctgagcctgccccgcttccccagcgtgtccctgcaggaggccagcagcttcttccagagggacaggcctgcccggcacccccaggagcagcccctgtggtag

SEQ ID NO: 40816 - DNA, 699 bp, Artificial Sequence
  Description of Artificial Sequence: Synthetic coding sequence
atgttccacaaggccgaggagctgttcagcaagaccaccaacaatgaggtggatgacatggacaccagtgacacccagtggggctggttctacctggccgagtgtgggaagtggcacatgttccagcctgacaccaacagccagtgcagcgtgtcctctgaggacatcgagaagagcttcaagaccaacccctgtggcagcatctccttcaccaccagcaagttctcctacaagattgactttgctgagatgaagcagatgaacctgaccaccgggaagcagaggctcatcaagagggcccccttcagcatcagcgccttctcctacatctgtgaaaatgaggccatccccatgccaccccactgggagaatgtgaacacccaggtgccctaccagctgatccccctgcacaaccagacccatgagtacaatgaggtggccaacctgtttgggaagaccatggacaggaaccgcatcaagaggatccagaggatccagaacctggacctgtgggagttcttctgcaggaagaaggcccagctgaagaagaagaggggcgtgccccagatcaatgagcagatgctgttccacggcaccagcagcgagtttgtggaggccatctgcatccacaactttgactggaggatcaatggcatccacggggctgtgtttgggaaggacaacatgtggaagctgtag

SEQ ID NO: 40817 - DNA, 774 bp, Artificial Sequence
  Description of Artificial Sequence: Synthetic coding sequence
atgtgggaggtggcccacgtgtctgagatgaagcagatgaacctgaccaccgggaagcagaggctcatcaagagggcccccttcagcatcagcgccttctcctacatctgtgaaaatgaggccatccccatgccaccccactgggagaatgtgaacacccaggtgccctaccagctgatccccctgcacaaccagacccatgagtacaatgaggtggccaacctgtttgggaagaccatggacaggaaccgcatcaagaggatccagaggatccagaacctggacctgtgggagttcttctgcaggaagaaggcccagctgaagaagaagaggggcgtgccccagatcaatgagcagatgctgttccacggcaccagcagcgagtttgtggaggccatctgcatccacaactttgactggaggatcaatggcatccacggggctgtgtttgggaagggcacctactttgccagagatgctgcctacagcagccgcttctgcaaggatgacatcaagcacggcaacaccttccagatccacggcgtgtccctgcagcagaggcacctgttccgcacctacaagtccatgttcctggcccgggtgctgattggagactacatcaacggggacagcaagtacatgaggcctcccagcaaggatggcagctatgtgaacctgtatgacagctgtgtggatgacacctggaaccccaagatctttgtggtgtttgatgccaaccagatctacccagagtacctgattgacttccactag

SEQ ID NO: 40818 - DNA, 774 bp, Artificial Sequence; identical to SEQ ID NO: 40817
  Description of Artificial Sequence: Synthetic coding sequence

SEQ ID NO: 40819 - DNA, 141 bp, Artificial Sequence
  Description of Artificial Sequence: Synthetic coding sequence
atgaagtggatgacctggacccggcagatccccagcggggccggcttcacctggcagaatgtgggcagcggcacctgcttcagccgcatccccaccgtgtctgtgcagctggccgtgaagatcagcaagaaggccagctag

SEQ ID NO: 40820 - DNA, 1557 bp, Artificial Sequence
  Description of Artificial Sequence: Synthetic coding sequence
atggacatcaagggccagttctggaatgatgatgattctgagggggacaatgaaagtgaggagttcctgtatggagtgcagggcagctgtgccgctgacctgtaccgccacccccagctggatgctgacatcgaggccgtgaaggagatctacagtgaaaattctgtgtccatccgggagtatggcaccattgatgatgtggacatcgacctgcacatcaacatctccttcctggatgaggaggtgtccacagcctggaaggtgctgaggacagagcccatcgtgctgcggctgcgcttcagcctgagccagtacctggatggccctgagcccagcattgaggtgttccagcccagcaacaaggagggcttcggcctgggcctgcagctgaagaagatcctgggcatgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggccggcctgctgtgcccccagcacgtgggcctgcccccaccagcccggaccagccccctggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccaccggggctgaggtggtggacctgctggtggccatgtgccgggccgccctggagagccccaggaagagcatcatctttgagccctaccccagcgtggtggaccccacagaccccaagaccctggccttcaaccccaagaagaagaactatgagcggctgcagaaggccctggacagcgtgatgagcatccgggagatgacccagggcagctacctggagatcaagaagcagatggacaagctggaccccctggcccaccccctgctgcagtggatcatcagcagcaacagaagccacatcgtgaagctgcccctgagccggctgaagttcatgcacaccagccaccagttcctgctgctgagcagccccccagccaaggaggcccgcttcagaacagccaagaagctgtatggcagcacctttgccttccacggcagccacatcgagaactggcacagcatcctgagaaatggcctggtgaatgccagctacaccaagctgcaggagtgggagaaggacagcacaggctgcccccccaggatgtcctggagccgggacaccactggatag

SEQ ID NO: 40821 - DNA, 1893 bp, Artificial Sequence; identical to SEQ ID NO: 40814
  Description of Artificial Sequence: Synthetic coding sequence

SEQ ID NO: 40822 - DNA, 1167 bp, Artificial Sequence
  Description of Artificial Sequence: Synthetic coding sequence
atggacatcaagggccagttctggaatgatgatgattctgagggggacaatgaaagtgaggagttcctgtatggagtgcagggcagctgtgccgctgacctgtaccgccacccccagctggatgctgacatcgaggccgtgaaggagatctacagtgaaaattctgtgtccatccgggagtatggcaccattgatgatgtggacatcgacctgcacatcaacatctccttcctggatgaggaggtgtccacagcctggaaggtgctgaggacagagcccatcgtgctgcggctgcgcttcagcctgagccagtacctggatggccctgagcccagcattgaggtgttccagcccagcaacaaggagggcttcggcctgggcctgcagctgaagaagatcctgggcatgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggccggcctgctgtgcccccagcacgtgggcctgcccccaccagcccggaccagccccctggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccaccggggctgaggtggtggacctgctggtggccatgtgccgggccgccctggagagccccaggaagagcatcatctttgagccctaccccagcgtggtggaccccacagaccccaagacagtggccttcatggtggagctggaccccaggaccaccccccacagtgatggccctgactag

SEQ ID NO: 40823 - DNA, 858 bp, Artificial Sequence
  Description of Artificial Sequence: Synthetic coding sequence
atgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccactggagctgaggtggtggacctgctggtggccatgtgcagagctgccctggagagccccaggaagagcatcatctttgagccctaccccagcgtggtggaccccacagaccccaagaccctggccttcaaccccaagaagaagaactatgaaaggctgcagaaggccctggacagcgtgatgagcatccgggagatgacccagggcagctacctggagatcaagaagcagatggacaagctggaccccctggcccaccccctgctgcagtggatcatcagcagcaacagaagccacatcgtgaagctgcccctgagccgctgggtgccccactag

SEQ ID NO: 40824 - DNA, 1665 bp, Artificial Sequence
  Description of Artificial Sequence: Synthetic coding sequence
atggacatcaagggccagttctggaatgatgatgattctgagggggacaatgaaagtgaggagttcctgtatggagtgcagggcagctgtgccgctgacctgtaccgccacccccagctggatgctgacatcgaggccgtgaaggagatctacagtgaaaattctgtgtccatccgggagtatggcaccattgatgatgtggacatcgacctgcacatcaacatctccttcctggatgaggaggtgtccacagcctggaaggtgctgaggacagagcccatcgtgctgcggctgcgcttcagcctgagccagtacctggatggccctgagcccagcattgaggtgttccagcccagcaacaaggagggcttcggcctgggcctgcagctgaagaagatcctgggcatgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggccggcctgctgtgcccccagcacgtgggcctgcccccaccagcccggaccagccccctggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccaccggggctgaggtggtggacctgctggtggccatgtgccgggccgccctggagagccccaggaagagcatcatctttgagccctaccccagcgtggtggaccccacagaccccaagaccctggccttcaaccccaagaagaagaactatgagcggctgcagaaggccctggacagcgtgatgagcatccgggagatgacccagggcagctacctggagatcaagaagcagatggacaagctggaccccctggcccaccccctgctgcagtggatcatcagcagcaacagaagccacatcgtgaagctgcccctgagccggcagctgaagttcatgcacaccagccaccagttcctgctgctgagcagccccccagccaaggaggcccgcttcagaacagccaagaagctgtatggcagcacctttgccttccacggcagccacatcgagaactggcacagcatcctgagaaatggcctggtgaatgccagctacaccaagctgcagctgcacggggccgcctacggcaagggcatctacctgagccccatcagcagcatcagctttggctacagcggcatgggcaagggccagcacaggatgcccagcaaggatgagctggtgcagcgctacaacaggatgaacaccatcccccagaggaggagcttccagatctag

SEQ ID NO: 40825 - DNA, 750 bp, Artificial Sequence
  Description of Artificial Sequence: Synthetic coding sequence
atgttcaccagccagcagtggaagcacctgagcaatgacttcctgaagacccagcaggagaagaggcacagctggttcaaggccagcggcaccatcaagaagttccgggccggcctgagcatcttcagccccatccccaagagccccagcttccccatcatccaggacagcatgctgaagggcaagctgggcgtgcctgagctgcgggtgggccgcctgatgaacagaagcatcagctgcaccatgaagaaccccaaggtggaggtgtttggctacccacccagcccccaggtgtctggccactgcaagaacatccccaccctggagtatggcttcctggtgcagatcatgaagtatgcagagcagaggatccccaccctgaatgagtactgtgtggtgtgtgatgagcagcacgtgttccagaatggctccatgctgaagccagctgtgtgcacccgggagctgtgtgtgttctccttctacaccctgggcgtgatgtctggagctgctgaggaggtggccactggagctgaggtggtggacctgctggtggccatgtgcagagctgccctggagagccccaggaagagcatcatctttgagccctaccccagcgtggtggaccccacagaccccaagaccctggccttcaaccccaagaagaagaactatgaaaggctgcagaaggccctggacagcgtgatgagcatccgggagatgacccagggctgcaggaactgcatcaagtag

SEQ ID NO: 40826 - DNA, 2565 bp, Artificial Sequence
  Description of Artificial Sequence: Synthetic coding sequence
atgggcatgtgcagccggcaggagcgcatccagaaggacattgatgtggtgatccagaagagcagagctgagaaggactgcctgtttgctgacttccgctacagcgacagcaccttcaccttcacctacgtgggcggccccaggtctgtgtcctacagcgtgcacgtgtctgaggactacccagacaacacctacgtgagcagcagtgaaaatgatgaagatgtgctggtgaccacagagcccatccctgtgatcttccacagaattgccacagagctgaggaagaccaatgacatcaactgctgcctgagcatcaagagcaagctgcagaaggaaaatggagaggagagccggcagaacagcacagtggaggaggacagcgagggggacaatgattctgaggagttctactacggcggccaggtgaactatgatggagagctgcacaagcacccccagctggaggccgacctgtctgctgtgcgggagatctacggcccccatgctgtgtccctgcgggagtatggagccattgatgatgtggacatcgacctgcacattgatgtgtccttcctggatgaggagattgctgtggcctgggaggtgatcagaacagagcccatcatcgtgcggctgcactgcagcctgacccagtacctgaatggacctgtgcccaccgtggatgtgttccagatcagcaccaaggagcgcttcggcctgggccaccagctgaagaagatcatgcagacctttgtgacccagcagtggaagcagagcaaggagaagagcaactgcctgcacaacaagaagctgtctgagaagaaggtgaagagccccctgcacctgttcagcaccctgcggcgcagccccagctacccacctcctggctgcggcaagagcaagagcaagctgaagtctgagcaggacggcatcagcaagacccacaagctgctgcggaggacctgcagcagcacagtgaagacagatgatgtgtgtgtgaccaagagccacaggaccttcggccgcagcctgagcagtgaccccagggctgagcaggccatgacagccatcaagagccacaagctgctgaaccggccctgcccagctgctgtgaagtcagaagaatgtctgaccctgaagagccaccggctgctgaccaggagctgcagcggggacccccgctgtgagcacaacaccaacctgaagccccacaagctgctgagccgcagctacagcagcaacctgaggatggaggagctgtatggcctgaagaaccacaagctgctgagcaagagctacagcagcgcccccaagagcagcaagacagagctgttcaaggagcccaatgctgagggccgccgcctgagcctgaccagcggcctcatcggcatcctgacccccagcagcagcagcagcagccagctggcccccaacggggccaagtgcatccctgtgcgggaccggggcttcctggtgcagaccattgaatttgctgagcagagaattcctgtgctgaatgagtactgtgtggtgtgtgatgagccccacgtgttccagaatggccccatgctgcggcccaccgtgtgtgagcgggagctgtgtgtgtttgccttccagaccctgggcgtgatgaatgaagctgctgatgaaattgccactggagcccaggtggtggacctgctggtgtccatgtgccgcagcgccctggagagccccaggaaggtggtgatctttgagccctaccccagcgtggtggaccccaatgacccccagatgctggccttcaaccccaggaagaagaactatgacagagtgatgaaggccctggacagcatcaccagcatccgggagatgacccaggccccctacctggagatcaagaagcagatggacaagcaggaccccctggcccaccccctgctgcagtgggtgatcagcagcaacagaagccacatcgtgaagctgcctgtgaaccggcagctgaagttcatgcacaccccccaccagttcctgctgctgagcagccccccagccaaggagagcaacttccgggccgccaagaagctgtttggcagcacctttgccttccacggcagccacatcgagaactggcacagcatcctgagaaatggcctggtggtggccagcaacacccggctgcagctgcatggagccatgtatggcagcggcatctacctgagccccatgagcagcatcagctttggctacagcggcatgaacaagaagcagaaggtgtctgccaaggatgagcccgccagcagcagcaagagcagcaacaccagccagagccagaagaagggccagcagagccagttcctgcagagcaggaacctgaagtgcatcgccctgtgtgaggtgatcaccagcagtgacctgcacaagcacggggagatctgggtggtgcccaacacagaccacgtgtgcacccgcttcttctttgtgtatgaagatggccaggtgggagatgccaacatcaacacccaggagggcggcatccacaaggagatcctgcgggtgattggcaaccagacagccactggatag

SEQ ID NO: 40827 - DNA, 1482 bp, Artificial Sequence
  Description of Artificial Sequence: Synthetic coding sequence
atgcagacctttgtgacccagcagtggaagcagagcaaggagaagagcaactgcctgcacaacaagaagctgtctgagaagaaggtgaagagccccctgcacctgttcagcaccctgcggcgcagccccagctacccacctcctggctgtgggaagagcaagagcaagctgaagtctgagcaggacggcatcagcaagacccacaagctgctgcggaggacctgcagcagcacagtgaagacagatgatgtgtgtgtgaccaagagccacaggaccttcggccgcagcctgagcagtgaccccagggctgagcaggccatgacagccatcaagagccacaagctgctgaaccggccctgcccagctgctgtgaagtctgaggagtgcctgaccctgaagagccaccggctgctgaccaggagctgcagcggggacccccgctgtgagcacaacaccaacctgaagccccacaagctgctgagccgcagctacagcagcaacctgaggatggaggagctgtatggcctgaagaaccacaagctgctgagcaagagctacagcagcgcccccaagagcagcaagacagagctgttcaaggagcccaatgctgagggccggcggctgagcctgaccagcggcctgattggcatcctgacccccagcagcagcagcagcagccagctggccccaaatggagccaagtgcatccctgtgcgggaccggggcttcctggtgcagaccatcgagtttgctgagcagagaattcctgtgctgaatgagtactgtgtggtgtgtgatgagccccacgtgttccagaatggccccatgctgcggcccaccgtgtgtgagcgggagctgtgtgtgtttgccttccagaccctgggcgtgatgaatgaggccgcagatgagatcgccaccggggcccagaagaagaactatgacagagtgatgaaggccctggacagcatcaccagcatccgggagatgacccaggccccctacctggagatcaagaagcagatggacaagcaggaccccctggcccaccccctgctgcagtgggtgatcagcagcaacagaagccacatcgtgaagctgcctgtgaaccggcagctgaagttcatgcacaccccccaccagttcctgctgctgagcagccccccagccaaggagagcaacttccgggccgccaagaagctgtttggcagcacctttgccttccacggcagccacatcgagaactggcacagcatcctgagaaatggcctggtggtggccagcaacacccggctgcagctgcacggggccatgtatggcagcggcatctacctgagccccatgagcagcatcagctttggctacagcggcatgaacaagaagcagaaggtgtctgccaaggatgagcccgccagcagcagcaagagcagcaacaccagccagagccagaagaggacagccatccccatcccagccaagccctag

SEQ ID NO: 40828 - DNA, 174 bp, Artificial Sequence
  Description of Artificial Sequence: Synthetic coding sequence
atgggcatgtgcagccggcaggagcgcatccagaaggacattgatgtggtgatccagaagagcagagctgagaaggactgcctgtttgctgacttccgctacagcgacagcaccttcaccttcacctacgtgggcggccccaggagaaattctgagctggcccctggcatgtag

SEQ ID NO: 40829 - DNA, 2439 bp, Artificial Sequence
  Description of Artificial Sequence: Synthetic coding sequence
atgggcatgtgcagccggcaggagcgcatccagaaggacattgatgtggtgatccagaagagcagagctgagaaggactgcctgtttgctgacttccgctacagcgacagcaccttcaccttcacctacgtgggcggccccaggtctgtgtcctacagcgtgcacgtgtctgaggactacccagacaacacctacgtgagcagcagtgaaaatgatgaagatgtgctggtgaccacagagcccatccctgtgatcttccacagaattgccacagagctgaggaagaccaatgacatcaactgctgcctgagcatcaagagcaagctgcagaaggaaaatggagaggagagccggcagaacagcacagtggaggaggacagcgagggggacaatgattctgaggagttctactacggcggccaggtgaactatgatggagagctgcacaagcacccccagctggaggccgacctgtctgctgtgcgggagatctacggcccccatgctgtgtccctgcgggagtatggagccattgatgatgtggacatcgacctgcacattgatgtgtccttcctggatgaggagattgctgtggcctgggaggtgatcagaacagagcccatcatcgtgcggctgcactgcagcctgacccagtacctgaatggacctgtgcccaccgtggatgtgttccagatcagcaccaaggagcgcttcggcctgggccaccagctgaagaagatcatgcagacctttgtgacccagcagtggaagcagagcaaggagaagagcaactgcctgcacaacaagaagctgtctgagaagaaggtgaagagccccctgcacctgttcagcaccctgcggcgcagccccagctacccacctcctggctgcggcaagagcaagagcaagctgaagtctgagcaggacggcatcagcaagacccacaagctgctgcggaggacctgcagcagcacagtgaagacagatgatgtgtgtgtgaccaagagccacaggaccttcggccgcagcctgagcagtgaccccagggctgagcaggccatgacagccatcaagagccacaagctgctgaaccggccctgcccagctgctgtgaagtcagaagaatgtctgaccctgaagagccaccggctgctgaccaggagctgcagcggggacccccgctgtgagcacaacaccaacctgaagccccacaagctgctgagccgcagctacagcagcaacctgaggatggaggagctgtatggcctgaagaaccacaagctgctgagcaagagctacagcagcgcccccaagagcagcaagacagagctgttcaaggagcccaatgctgagggccgccgcctgagcctgaccagcggcctcatcggcatcctgacccccagcagcagcagcagcagccagctggcccccaacggggccaagtgcatccctgtgcgggaccggggcttcctggtgcagaccattgaatttgctgagcagagaattcctgtgctgaatgagtactgtgtggtgtgtgatgagccccacgtgttccagaatggccccatgctgcggcccaccgtgtgtgagcgggagctgtgtgtgtttgccttccagaccctgggcgtgatgaatgaagctgctgatgaaattgccactggagcccagaagaagaactatgacagagtgatgaaggccctggacagcatcaccagcatccgggagatgacccaggccccctacctggagatcaagaagcagatggacaagcaggaccccctggcccaccccctgctgcagtgggtgatcagcagcaacagaagccacatcgtgaagctgcctgtgaaccggcagctgaagttcatgcacaccccccaccagttcctgctgctgagcagccccccagccaaggagagcaacttccgggccgccaagaagctgtttggcagcacctttgccttccacggcagccacatcgagaactggcacagcatcctgagaaatggcctggtggtggccagcaacacccggctgcagctgcatggagccatgtatggcagcggcatctacctgagccccatgagcagcatcagctttggctacagcggcatgaacaagaagcagaaggtgtctgccaaggatgagcccgccagcagcagcaagagcagcaacaccagccagagccagaagaagggccagcagagccagttcctgcagagcaggaacctgaagtgcatcgccctgtgtgaggtgatcaccagcagtgacctgcacaagcacggggagatctgggtggtgcccaacacagaccacgtgtgcacccgcttcttctttgtgtatgaagatggccaggtgggagatgccaacatcaacacccaggagggcggcatccacaaggagatcctgcgggtgattggcaaccagacagccactggatag

SEQ ID NO: 40830 - DNA, 2502 bp, Artificial Sequence
  Description of Artificial Sequence: Synthetic coding sequence
atggagcctgctgccctgcgctgtgcctacttccgctacagcgacagcaccttcaccttcacctacgtgggcggccccaggtctgtgtcctacagcgtgcacgtgtctgaggactacccagacaacacctacgtgagcagcagtgaaaatgatgaagatgtgctggtgaccacagagcccatccctgtgatcttccaccgcatcgccacagagctgaggaagaccaatgacatcaactgctgcctgagcatcaagagcaagctgcagaaggaaaatggagaggagagccggcagaacagcacagtggaggaggacagcgagggggacaatgacagcgaggagttctactatggaggccaggtgaactatgatggagagctgcacaagcacccccagctggaggccgacctgtctgctgtgcgggagatctacggcccccatgctgtgtccctgcgggagtatggagccattgatgatgtggacatcgacctgcacattgatgtgtccttcctggatgaggagattgctgtggcctgggaggtgatcagaacagagcccatcatcgtgcggctgcactgcagcctgacccagtacctgaatggacctgtgcccaccgtggatgtgttccagatcagcaccaaggagagatttggcctgggccaccagctgaagaagatcatgcagacctttgtgacccagcagtggaagcagagcaaggagaagagcaactgcctgcacaacaagaagctgtctgagaagaaggtgaagagccccctgcacctgttcagcaccctgcggcgcagccccagctacccacctcctggctgtgggaagagcaagagcaagctgaagtctgagcaggacggcatcagcaagacccacaagctgctgcggaggacctgcagcagcacagtgaagacagatgatgtgtgtgtgaccaagagccacaggaccttcggccgcagcctgagcagtgaccccagggctgagcaggccatgacagccatcaagagccacaagctgctgaaccggccctgcccagctgctgtgaagtctgaggagtgcctgaccctgaagagccaccggctgctgaccaggagctgcagcggggacccccgctgtgagcacaacaccaacctgaagccccacaagctgctgagccgcagctacagcagcaacctgaggatggaggagctgtatggcctgaagaaccacaagctgctgagcaagagctacagcagcgcccccaagagcagcaagacagagctgttcaaggagcccaatgctgagggccggcggctgagcctgaccagcggcctgattggcatcctgacccccagcagcagcagcagcagccagctggccccaaatggagccaagtgcatccctgtgcgggaccggggcttcctggtgcagaccatcgagtttgctgagcagagaattcctgtgctgaatgagtactgtgtggtgtgtgatgagccccacgtgttccagaatggccccatgctgcggcccaccgtgtgtgagcgggagctgtgtgtgtttgccttccagaccctgggcgtgatgaatgaggccgcagatgagatcgccaccggggcccaggtggtggacctgctggtgtccatgtgccgcagcgccctggagagccccaggaaggtggtgatctttgagccctaccccagcgtggtggaccccaatgacccccagatgctggccttcaaccccaggaagaagaactatgacagagtgatgaaggccctggacagcatcaccagcatccgggagatgacccaggccccctacctggagatcaagaagcagatggacaagcaggaccccctggcccaccccctgctgcagtgggtgatcagcagcaacagaagccacatcgtgaagctgcctgtgaaccggcagctgaagttcatgcacaccccccaccagttcctgctgctgagcagccccccagccaaggagagcaacttccgggccgccaagaagctgtttggcagcacctttgccttccacggcagccacatcgagaactggcacagcatcctgagaaatggcctggtggtggccagcaacacccggctgcagctgcacggggccatgtatggcagcggcatctacctgagccccatgagcagcatcagctttggctacagcggcatgaacaagaagcagaaggtgtctgccaaggatgagcccgccagcagcagcaagagcagcaacaccagccagagccagaagaagggccagcagagccagttcctgcagagcaggaacctgaagtgcatcgccctgtgtgaggtgatcaccagcagtgacctgcacaagcatggagagatctgggtggtgcccaacacagaccacgtgtgcacccgcttcttctttgtgtatgaagatggccaggtgggagatgccaacatcaacacccaggagggcggcatccacaaggagatcctgcgggtcatcggcaaccagacagccaccggctag

SEQ ID NO: 40831 - DNA, 2565 bp, Artificial Sequence; identical to SEQ ID NO: 40826
  Description of Artificial Sequence: Synthetic coding sequence

SEQ ID NO: 40832 - DNA, 2439 bp, Artificial Sequence; identical to SEQ ID NO: 40829
  Description of Artificial Sequence: Synthetic coding sequence

SEQ ID NO: 40833 - DNA, 1485 bp, Artificial Sequence
  Description of Artificial Sequence: Synthetic coding sequence
atgcagacctttgtgacccagcagtggaagcagagcaaggagaagagcaactgcctgcacaacaagaagctgtctgagaagaaggtgaagagccccctgcacctgttcagcaccctgcggcgcagccccagctacccacctcctggctgtgggaagagcaagagcaagctgaagtctgagcaggacggcatcagcaagacccacaagctgctgcggaggacctgcagcagcacagtgaagacagatgatgtgtgtgtgaccaagagccacaggaccttcggccgcagcctgagcagtgaccccagggctgagcaggccatgacagccatcaagagccacaagctgctgaaccggccctgcccagctgctgtgaagtctgaggagtgcctgaccctgaagagccaccggctgctgaccaggagctgcagcggggacccccgctgtgagcacaacaccaacctgaagccccacaagctgctgagccgcagctacagcagcaacctgaggatggaggagctgtatggcctgaagaaccacaagctgctgagcaagagctacagcagcgcccccaagagcagcaagacagagctgttcaaggagcccaatgctgagggccggcggctgagcctgaccagcggcctgattggcatcctgacccccagcagcagcagcagcagccagctggccccaaatggagccaagtgcatccctgtgcgggaccggggcttcctggtgcagaccatcgagtttgctgagcagagaattcctgtgctgaatgagtactgtgtggtgtgtgatgagccccacgtgttccagaatggccccatgctgcggcccaccgtgtgtgagcgggagctgtgtgtgtttgccttccagaccctgggcgtgatgaatgaggccgcagatgagatcgccaccggggcccagaagaagaactatgacagagtgatgaaggccctggacagcatcaccagcatccgggagatgacccaggccccctacctggagatcaagaagcagatggacaagcaggaccccctggcccaccccctgctgcagtgggtgatcagcagcaacagaagccacatcgtgaagctgcctgtgaaccggcagctgaagttcatgcacaccccccaccagttcctgctgctgagcagccccccagccaaggagagcaacttccgggccgccaagaagctgtttggcagcacctttgccttccacggcagccacatcgagaactggcacagcatcctgagaaatggcctggtggtggccagcaacacccggctgcagctgcacggggccatgtatggcagcggcatctacctgagccccatgagcagcatcagctttggctacagcggcatgaacaagaagcagaaggtgtctgccaaggatgagcccgccagcagcagcaagagcagcaacaccagccagaagaccaagaagaggacagccatccccatcccagccaagccctag

SEQ ID NO: 40834 - DNA, 603 bp, Artificial Sequence
  Description of Artificial Sequence: Synthetic coding sequence
atggccagcctgtatgtgggggacctgcaccctgaggtgacagaggccatgctgtatgagaagttcagccctgctggccccatcctgagcatccgcatctgccgggacaagatcacccggcgcagcctgggctacgcctacgtgaactaccagcagcctgtggatgccaagagggccctggagaccctgaactttgatgtgatcaagggccggcctgtgcgcatcatgtggagccagagggaccccagcctgaggaagtctggagtgggcaatgtgttcatcaagaacctgggcaagaccatcgacaacaaggccctgtacaacatcttcagcgcctttggaaacatcctgagctgcaaggtggcctgtgatgagaagggccccaagggctacggctttgtgcacttccagaagcaggagagcgctgagcgggccattgatgtgatgaatggcatgttcctgaactacaggaagatctttgtgggccgcttcaagagccacaaggagcgggaggccgagcggggggcctgggcccggcagagcaccagcgcagatgtgaaggactttgaggaggacacagatgaggaggccaccctgaggtag

SEQ ID NO: 40835 - DNA, 603 bp, Artificial Sequence; identical to SEQ ID NO: 40834
  Description of Artificial Sequence: Synthetic coding sequence

SEQ ID NO: 40836 - DNA, 1113 bp, Artificial Sequence
  Description of Artificial Sequence: Synthetic coding sequence
atgaatgtggccgccaagtacaggatggccagcctgtatgtgggggacctgcatgctgatgtgacagaggacctgctcttcaggaagttcagcacagtgggccctgtgctgagcatccgcatctgccgggaccaggtgacccggcgcagcctgggctacgcctacgtgaacttcctgcagctggctgatgcccagaaggccctggacaccatgaactttgacatcatcaagggcaagagcatccggctgatgtggagccagagagatgcctacctgcggcgctctggaattggaaatgtgttcatcaagaacctggacaagagcattgacaacaagaccctgtatgagcacttcagcgccttcggcaagatcctgagcagcaaggtgatgtctgatgaccagggcagcaagggctacgcctttgtgcacttccagaaccagagcgctgctgaccgggccatcgaggagatgaatggcaagctgctgaagggctgcaaggtgtttgtgggccgcttcaagaacaggaaggaccgggaggccgagctgcggagcaaggccagcgagttcaccaacgtgtacatcaagaactttggaggagacatggatgatgagcggctgaaggatgtgttcagcaaatatggcaagaccctgtctgtgaaggtgatgacagacagcagcggcaagagcaagggcttcggctttgtgtcctttgacagccatgaggccgccaagaaggctgtggaggagatgaatggccgggacatcaatggccagctgatctttgtgggccgggcccagaagaaggtggagcggcaggccgagctgaagcagatgtttgagcagctgaagcgggagcgcatccggggctgccagggcgtgaagctgtacatcaagaacctggatgacaccattgatgatgagaagctgagaaatgagttcagcagctttggcagcatcagccgggtgaaggtgatgcaggaggagggccagagcaagggcttcggcctcatctgcttcagcagcccagaagatgccaccaaggccatgacagagatgaatggccgcatcctgggcagcaagcccctgagcatcgccctggcccagaggcactag

SEQ ID NO: 40837 - DNA, 1287 bp, Artificial Sequence
  Description of Artificial Sequence: Synthetic coding sequence
atgagggtgctgcctgagctgggggagagctgcctgaacagcatcgcctggcccctgtgtggggaccctgaggccagcaccctggagcccggccagagctgtgacctggtgagcccccaccgggactgcagcaagaacagccggggccagacccacagcggcaaggacaaggagatgaatgtggccgccaagtacaggatggccagcctgtatgtgggggacctgcatgctgatgtgacagaggacctgctcttcaggaagttcagcacagtgggccctgtgctgagcatccgcatctgccgggaccaggtgacccggcgcagcctgggctacgcctacgtgaacttcctgcagctggctgatgcccagaaggccctggacaccatgaactttgacatcatcaagggcaagagcatccggctgatgtggagccagagagatgcctacctgcggcgctctggaattggaaatgtgttcatcaagaacctggacaagagcattgacaacaagaccctgtatgagcacttcagcgccttcggcaagatcctgagcagcaaggtgatgtctgatgaccagggcagcaagggctacgcctttgtgcacttccagaaccagagcgctgctgaccgggccatcgaggagatgaatggcaagctgctgaagggctgcaaggtgtttgtgggccgcttcaagaacaggaaggaccgggaggccgagctgcggagcaaggccagcgagttcaccaacgtgtacatcaagaactttggaggagacatggatgatgagcggctgaaggatgtgttcagcaaatatggcaagaccctgtctgtgaaggtgatgacagacagcagcggcaagagcaagggcttcggctttgtgtcctttgacagccatgaggccgccaagaaggctgtggaggagatgaatggccgggacatcaatggccagctgatctttgtgggccgggcccagaagaaggtggagcggcaggccgagctgaagcagatgtttgagcagctgaagcgggagcgcatccggggctgccagggcgtgaagctgtacatcaagaacctggatgacaccattgatgatgagaagctgagaaatgagttcagcagctttggcagcatcagccgggtgaaggtgatgcaggaggagggccagagcaagggcttcggcctcatctgcttcagcagcccagaagatgccaccaaggccatgacagagatgaatggccgcatcctgggcagcaagcccctgagcatcgccctggcccagaggcactag

SEQ ID NO: 40838 - DNA, 762 bp, Artificial Sequence
  Description of Artificial Sequence: Synthetic coding sequence
atgcccctgctgcccagcacagtgggcctggccggcctgctcttctgggccggccaggccgtgaatgccctgatcatgcccaatgccaccccagccccagcccagcctgagagcacagccatgaggctgctgagcggcctggaggtgccccgctacagaaggaagaggcacatctctgtgcgggacatgaatgccctgctggactaccacaaccacatccgggcctctgtgtacccacctgctgccaacatggagtacatggtgtgggacaagaggctggcccgggctgctgaggcctgggccacccagtgcatctgggcccacggccccagccagctgatgagatatgtgggccagaacctgagcatccacagcggccagtacagatctgtggtggacctgatgaagtcctggagcgaggagaagtggcactacctgtttcctgccccccgggactgcaacccccactgcccctggaggtgtgatggccccacctgcagccactacacccagatggtgtgggccagcagcaaccggctgggctgtgccatccacacctgcagcagcatctctgtgtggggcaacacctggcaccgggccgcctacctggtgtgcaactatgccatcaagggcaactggattggagagagcccctacaagatgggcaagccctgcagcagctgccccccatcctaccagggcagctgcaacagcaacatgtgcttcaagggcctgaagagcaacaagttcacctggttctag

SEQ ID NO: 40839 - DNA, 1845 bp, Artificial Sequence
  Description of Artificial Sequence: Synthetic coding sequence
atgaatgccagcggcagcggctaccccctggccagcctgtatgtgggggacctgcacccagatgtgacagaggccatgctgtatgagaagttctccccagctggccccatcctgagcatccgggtgtgcagagatgtggccaccaggaggagcctgggctacgcctacatcaacttccagcagcctgcagatgctgagcgggccctggacaccatgaactttgagatgctgaagggccagcccatccgcatcatgtggagccagagggaccccggcctgaggaagagcggcgtgggcaacatcttcatcaagaacctggaggacagcattgacaacaaggccctgtatgacaccttcagcaccttcggcaacatcctgagctgcaaggtggcctgtgatgaacatggcagccggggcttcggctttgtgcactttgagacccatgaggccgcccagcaggccatcaacaccatgaatggcatgctgctgaatgacaggaaggtgtttgtgggccacttcaagagccggcgggagcgggaggccgagctgggcgcccgggccctggagttcaccaacatctacgtgaagaacctgcctgtggatgtggatgagcagggcctgcaggacctcttcagccagtttgggaagatgctgtctgtgaaggtgatgagggacaacagcggccacagccgctgctttggatttgtgaactttgagaagcatgaggaggcccagaaggctgtggtgcacatgaatggcaaggaggtgtctggccgcctgctgtatgccggccgggcccagaagagggtggagcggcagaatgagctgaagagaagatttgagcagatgaagcaggaccggctgcggcgctaccagggcgtgaacctgtatgtgaagaacctggatgacagcattgatgatgacaagctgaggaaggagttcagcccctatggagtcatcaccagcgccaaggtgatgacagaaggaggccacagcaaaggatttggatttgtgtgcttcagcagccctgaggaggccaccaaggctgtgacagagatgaatggaagaattgtgggcaccaagcccctgtatgtggccctggcccagaggaaggaggagaggaaggccatcctgaccaaccagtacatgcagaggctgagcaccatgaggaccctgagcaaccccctgctgggcagcttccagcagcccagcagctacttcctgcctgccatgccccagcccccagcccaggccgcctactacggctgcggccctgtgacccccacccagcctgccccccgctggaccagccagcccccccggcccagctgtgcctccatggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaagattgatgaggccgtggccgtgctgcaggcccaccaggccatggagcagcccaaggcctacatgcactag

SEQ ID NO: 40840 - DNA, 993 bp, Artificial Sequence
  Description of Artificial Sequence: Synthetic coding sequence
atgaatgccagcggcagcggctaccccctggccagcctgtatgtgggggacctgcacccagatgtgacagaggccatgctgtatgagaagttctccccagctggccccatcctgagcatccgggtgtgcagagatgtggccaccaggaggagcctgggctacgcctacatcaacttccagcagcctgcagatgctgagcgggccctggacaccatgaactttgagatgctgaagggccagcccatccgcatcatgtggagccagagggaccccggcctgaggaagagcggcgtgggcaacatcttcatcaagaacctggaggacagcattgacaacaaggccctgtatgacaccttcagcaccttcggcaacatcctgagctgcaaggtggcctgtgatgaacatggcagccggggcttcggctttgtgcactttgagacccatgaggccgcccagcaggccatcaacaccatgaatggcatgctgctgaatgacaggaaggtgtttgtgggccacttcaagagccggcgggagcgggaggccgagctgggcgcccgggccctggagttcaccaacatctacgtgaagaacctgcctgtggatgtggatgagcagggcctgcaggacctcttcagccagtttgggaagatgctgtctgtgaaggtgatgagggacaacagcggccacagccgctgctttggatttgtgaactttgagaagcatgaggaggcccagaaggctgtggtgcacatgaatggcaaggaggtgtctggccgcctgctgtatgccggccgggcccagaagagggtggagcggcagaatgagctgaagagaagatttgagcagatgaagcaggaccggctgcggcgctaccagggcgtgaacctgtatgtgaagaacctggatgacagcattgatgatgacaagctgaggaaggagttcagcccctatggagtcatcaccagcgccaagaagaggcggcagaggccctag

SEQ ID NO: 40841 - DNA, 1845 bp, Artificial Sequence; identical to SEQ ID NO: 40839
  Description of Artificial Sequence: Synthetic coding sequence

SEQ ID NO: 40842 - DNA, 450 bp, Artificial Sequence
  Description of Artificial Sequence: Synthetic coding sequence
atggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaagatcagcgcctag

SEQ ID NO: 40843 - DNA, 582 bp, Artificial Sequence
  Description of Artificial Sequence: Synthetic coding sequence
atggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggcacctgctacctggtgctgaagcgctggagcgactggatggtgctgtccttcctgcccctgctgctgagctgtgactttgagggctctgtgtccacccccctgtccatgatgagcacccccagctggctggcccggagccgggcctgctgctggaggctgaccacccagagctgctgcagctgctggagcctgcagaaccccagcatgcccaggaaaggaaacccccgcttccacggctgccagaaggacagcgtgtctggcagccagccctag

SEQ ID NO: 40844 - DNA, 405 bp, Artificial Sequence
  Description of Artificial Sequence: Synthetic coding sequence
tgcaagtgcagcagcgctgcccacagcacctacagagtgcaggagcctgctgtgcacatccctggccaggagcccctgacagcctccatgctggccgccgcccccctgcacgagcagaagcagatgattggcacctgctacctggtgctgaagcgctggagcgactggatggtgctgtccttcctgcccctgctgctgagctgtgactttgagggctctgtgtccacccccctgtccatgatgagcacccccagctggctggcccggagccgggcctgctgctggaggctgaccacccagagctgctgcagctgctggagcctgcagaaccccagcatgcccaggaagggcaacccccgcttccacggctgccagaaggacagcgtgtctggcagccagccctag

SEQ ID NO: 40845 - DNA, 507 bp, Artificial Sequence
  Description of Artificial Sequence: Synthetic coding sequence
atggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaagattgatgaggccgtggccgtgctgcaggcccaccaggccatggagcagcccaaggcctacatgcactag

SEQ ID NO: 40846 - DNA, 459 bp, Artificial Sequence
  Description of Artificial Sequence: Synthetic coding sequence
tgacaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaaggcccagaggaggaaggtgcagaggctggtgaagtacatcctggccctgaaggagctgagcacccagaacctgtag

SEQ ID NO: 40847 - DNA, 513 bp, Artificial Sequence
  Description of Artificial Sequence: Synthetic coding sequence
atggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaaggcccagaggaggaaggtgcagaggctggtgaagtacatcctggccctgaaggagctgagcacccagaacctgtag

SEQ ID NO: 40848 - DNA, 993 bp, Artificial Sequence; identical to SEQ ID NO: 40840
  Description of Artificial Sequence: Synthetic coding sequence

SEQ ID NO: 40849 - DNA, 603 bp, Artificial Sequence; identical to SEQ ID NO: 40834
  Description of Artificial Sequence: Synthetic coding sequence

SEQ ID NO: 40850 - DNA, 603 bp, Artificial Sequence; identical to SEQ ID NO: 40834
  Description of Artificial Sequence: Synthetic coding sequence

SEQ ID NO: 40851 - DNA, 603 bp, Artificial Sequence; identical to SEQ ID NO: 40834
  Description of Artificial Sequence: Synthetic coding sequence

SEQ ID NO: 40852 - DNA, 603 bp, Artificial Sequence; identical to SEQ ID NO: 40834
  Description of Artificial Sequence: Synthetic coding sequence

SEQ ID NO: 40853 - DNA, 1134 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatcaaggagatccgggagaccactggagcccaggtgcaggtggccggggacctgctgcccaacagcacagaaagagctgtgacagtgtctggagtgcctgatgccatcatcctgtgtgtgcggcagatctgtgccgtcatcctggagagcccccccaagggggccaccatcccctaccaccccagcctgagcctgggcaccgtgctgctgagcgccaaccagggcttctctgtgcagggccagtatggagctgtgaccccagctgaggtgaccaagctgcagcagctgagcagccatgctgtgccctttgccacccccagcgtggtgcccggcctggaccccggcacccagaccagcagccaggagttcctggtgcccaatgacctgattggctgtgtgattggccggcagggcagcaagatcagcgagatccggcagatgtctggggcccacatcaagattggcaaccaggccgagggcgctggggagcggcacgtgaccatcaccggcagccctgtgtccatcgccctggcccagtacctgatcacagcctgcctggagacagccaagagcaccagcggcggcacccccagcagcgccccagctgacctgcctgcccccttcagcccccccctgacagccccccagctgcccctggcctgctgggcccaccccatgcccagccccagccccaccagcagcgcccaggcccacgccctgctgggcttcaccacctgcttccccagggctgctgctggcctgtag

SEQ ID NO: 40854 - DNA, 732 bp, Artificial Sequence
  Description of Artificial Sequence: Synthetic coding sequence
atgattgccttcaagctggatgaggacctgtgtgccgccccagccaacggcggcaatgtgtccaggcctcctgtgaccctgcggctggtgatcccagccagccagtgtggcagcctcatcggcaaggccggcaccaagatcaaggagatccgggaggtgaccaagctgcagcagctgagcagccatgctgtgccctttgccacccccagcgtggtgcccggcctggaccccggcacccagaccagcagccaggagttcctggtgcccaatgacctgattggctgtgtgattggccggcagggcagcaagatcagcgagatccggcagatgtctggggcccacatcaagattggcaaccaggccgagggcgctggggagcggcacgtgaccatcaccggcagccctgtgtccatcgccctggcccagtacctgatcacagcctgcctggagacagccaagagcaccagcggcggcacccccagcagcgccccagctgacctgcctgcccccttcagcccccccctgacagccctgcccacagcccctcctggcctgctgggcaccccctatgccatcagcctgagcaacttcatcggcctgaagcccatgcccttcctggccctgcccccagccagccctggccccccacctggcctggccgcctacacagccaagatggccgccgccaacggcagcaagaaggccgagcggcagaagttcagcccctactag

SEQ ID NO: 40855 - DNA, 1275 bp, Artificial Sequence
  Description of Artificial Sequence: Synthetic coding sequence
atgccccgctgcccagccctgatcctgtacctgcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatcaaggagatccgggaggtgcggggggagatctaccacccccagggcatccggggcaaaggagctgtggtgcggggcgtgctgggcctgtggaggcctccccacctggagagcagcgagcccggccagcccttcagcggcctgtgggagcagcctgaggtggcccctgtgctgtgcctgcagaccaccggggcccaggtgcaggtggccggggacctgctgcccaacagcacagaaagagctgtgacagtgtctggagtgcctgatgccatcatcctgtgtgtgcggcagatctgtgctgtgatcctggagagcccccccaagggggccaccatcccctaccaccccagcctgagcctgggcaccgtgctgctgagcgccaaccagggcttctctgtgcagggccagtacggggctgtgaccccagctgaggtgaccaagctgcagcagctgagcagccatgctgtgccctttgccaccccatctgtggtgcccggcctggaccccggcacccagaccagcagccaggagttcctggtgcccaatgacctgattggctgcgtcatcggccggcagggcagcaagatcagcgagatccggcagatgtctggggcccacatcaagattggcaaccaggccgagggcgctggggagagacatgtgaccatcaccggcagccctgtgtccatcgccctggcccagtacctgatcacagcctgcctggagacagccaagagcaccagcggcggcacccccagcagcgccccagctgacctgcctgcccccttcagcccccccctgacagccctgcccacagcccctcctggcctgctgggcaccccctatgccatcagcctgagcaacttcatcggcctgaagcccatgcccttcctggccctgcccccagccagccctggccccccacctggcctggccgcctacacagccaagatggctgctgccaacggcagcaagaaggccgagcggcagaagttcagcccctactag

SEQ ID NO: 40856 - DNA, 1083 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatcaaggagatccgggagagcccccccaagggggccaccatcccctaccaccccagcctgagcctgggcaccgtgctgctgagcgccaaccagggcttctctgtgcagggccagtacggggctgtgaccccagctgaggtgaccaagctgcagcagctgagcagccatgctgtgccctttgccaccccatctgtggtgcccggcctggaccccggcacccagaccagcagccaggagttcctggtgcccaatgacctgattggctgcgtcatcggccggcagggcagcaagatcagcgagatccggcagatgtctggggcccacatcaagattggcaaccaggccgagggcgctggggagagacatgtgaccatcaccggcagccctgtgtccatcgccctggcccagtacctgatcacagcctgcctggagacagccaagagcaccagcggcggcacccccagcagcgccccagctgacctgcctgcccccttcagcccccccctgacagccctgcccacagcccctcctggcctgctgggcaccccctatgccatcagcctgagcaacttcatcggcctgaagcccatgcccttcctggccctgcccccagccagccctggccccccacctggcctggccgcctacacagccaagatggctgctgccaacggcagcaagaaggccgagcggcagaagttcagcccctactag

SEQ ID NO: 40857 - DNA, 141 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagtag

SEQ ID NO: 40858 - DNA, 375 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatctag

SEQ ID NO: 40859 - DNA, 507 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatcaaggagatccgggagaccactggagcccaggtgcaggtggccggggacctgctgcccaacagcacagaaagagctgtgacagtgtctggagtgcctgatgccatcatcctgtgtgtgcggcagatctgtgcctag

SEQ ID NO: 40860 - DNA, 228 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgcctag

SEQ ID NO: 40861 - DNA, 1083 bp, Artificial Sequence; identical to SEQ ID NO: 40856
  Description of Artificial Sequence: Synthetic coding sequence

SEQ ID NO: 40862 - DNA, 279 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagcctag

SEQ ID NO: 40863 - DNA, 261 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggtgtag

SEQ ID NO: 40864 - DNA, 324 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgtag

SEQ ID NO: 40865 - DNA, 3024 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatggaggaggccatgaacagcagccatgacaagaagcaggcccaggccctggcctttgaggagagcgaggtggagtttggcagcagcaagcagtgccacctgcggcagctgcagcagctgaagaagaagctgctggtgctgcagcaggagctggagttccacacagaggagctgcagaccagctactacagcctgcggcagtaccagagcatcctggagaagcagaccagtgacctggtgctgctgcaccaccactgcaagctgaaggaggatgaagtcatcctgtatgaggaggagatgggcaaccacaatgaaaatactggagagaagctgcacctggcccaggagcagctggccctggccggggacaagatcgccagcctggagaggagcctgaacctgtacagagacaagtaccagagcagcctgagcaacatcgagctgctggagtgccaggtgaagatgctgcagggcgagctgggcggcatcatgggccaggagccagaaaataaaggagaccacagcaaggtgcgcatctacaccagcccctgcatgatccaggagcaccaggagacccagaagaggctgtctgaggtgtggcagaaggtgtcccagcaggatgacctgatccaggagctgaggaacaagctggcctgcagcaatgccctggtgctggagcgggagaaggccctgatcaagctgcaggccgactttgccagctgcacagccacccaccgctacccacccagcagcagcgaggagtgtgaggacatcaagaagatcctgaagcacctgcaggagcagaaggacagccagtgcctgcacgtggaggagtaccagaacctggtgaaggacctgcgggtggagctggaggccgtgtctgagcagaagaggaacatcatgaaggacatgatgaagctggagctggacctgcacggcctgcgggaggagaccagcgcccacatcgagaggaaggacaaggacatcaccatcctgcagtgccgcctgcaggagctgcagctggagttcacagagacccagaagctgaccctgaagaaggacaagttcctgcaggagaaggatgagatgctgcaggagctggagaagaagctgacccaggtgcagaacagcctgctgaagaaggagaaggagctggagaagcagcagtgcatggccacagagctggagatgacagtgaaggaggccaagcaggacaagagcaaggaggccgagtgcaaggccctgcaggccgaggtgcagaagctgaagaacagcctggaggaggccaagcagcaggagcggctggccgcccagcaggccgcccagtgcaaggaggaggccgccctggccggctgccacctggaggacacccagaggaagctgcagaagggcctgctgctggacaagcagaaggctgacaccatccaggagctgcagcgggagctgcagatgctgcagaaggagagctccatggccgagaaggagcagaccagcaacaggaagagggtggaggagctgagcctggagctgtctgaggccctgaggaagctggagaacagcgacaaggagaagaggcagctgcagaagacagtggccgagcaggacatgaagatgaatgacatgctggaccgcatcaagcaccagcaccgggagcagggcagcatcaagtgcaagctggaggaggacctgcaggaggccaccaagctgctggaggacaagcgggagcagctgaagaagagcaaggagcacgagaagctgatggagggggagctggaggccctgcggcaggagttcaagaagaaggacaagaccctgaaggagaacagcaggaagctggaggaggagaatgaaaacctgcgggcagagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctatgatgccctgagcaggaagtctgctgcctgccaggatgacctgacccaggccctggagaagctgaaccacgtgaccagcgagaccaagagcctgcagcagagcctgacccagacccaggagaagaaggcccagctggaggaggagatcatcgcctatgaggagaggatgaagaagctgaacacagagctgaggaagctgcggggcttccaccaggagagcgagctggaggtgcacgcctttgacaagaagctggaggagatgagctgccaggtgctgcagtggcagaagcagcaccagaatgacctgaagatgctggccgccaaggaggagcagctgcgggagttccaggaggagatggccgccctgaaggagaacctgctggaggatgacaaggagccctgctgcctgccccagtggagcgtgcccaaggacacctgccgcctgtacagaggaaatgaccagatcatgaccaacctggagcagtgggccaagcagcagaaggtggccaatgagaagctgggcaaccagctgcgggagcaggtgaagtacatcgccaagctgtctggagagaaggaccacctgcacagcgtgatggtgcacctgcagcaggagaacaagaagctgaagaaggagattgaggagaagaagatgaaggccgagaacacccggctgtgcaccaaggccctgggccccagcaggacagagagcacccagcgggagaaggtgtgtggcaccctgggctggaagggcctgccccaggacatgggccagaggatggacctgaccaagtacatcggcatgccccactgccccggcagcagctactgctag

SEQ ID NO: 40866 - DNA, 2649 bp, Artificial Sequence
  Description of Artificial Sequence: Synthetic coding sequence
atgggcaaccacaatgaaaatactggagagaagctgcacctggcccaggagcagctggccctggccggggacaagatcgccagcctggagaggagcctgaacctgtacagagacaagtaccagagcagcctgagcaacatcgagctgctggagtgccaggtgaagatgctgcagggcgagctgggcggcatcatgggccaggagcctgagaacaagggggaccacagcaaggtgcgcatctacaccagcccctgcatgatccaggagcaccaggagacccagaagaggctgtctgaggtgtggcagaaggtgtcccagcaggatgacctgatccaggagctgaggaacaagctggcctgcagcaatgccctggtgctggagcgggagaaggccctgatcaagctgcaggccgactttgccagctgcacagccacccaccgctacccacccagcagcagtgaagaatgtgaggacatcaagaagatcctgaagcacctgcaggagcagaaggacagccagtgcctgcacgtggaggagtaccagaacctggtgaaggacctgcgggtggagctggaggccgtgtctgagcagaagaggaacatcatgaaggacatgatgaagctggagctggacctgcacggcctgcgggaggagaccagcgcccacattgaaaggaaggacaaggacatcaccatcctgcagtgccgcctgcaggagctgcagctggagttcacagagacccagaagctgaccctgaagaaggacaagttcctgcaggagaaggatgagatgctgcaggagctggagaagaagctgacccaggtgcagaacagcctgctgaagaaggagaaggagctggagaagcagcagtgcatggccacagagctggagatgacagtgaaggaggccaagcaggacaagagcaaggaggccgagtgcaaggccctgcaggccgaggtgcagaagctgaagaacagcctggaggaggccaagcagcaggagcggctggccgcccagcaggccgcccagtgcaaggaggaggccgccctggccggctgccacctggaggacacccagaggaagctgcagaagggcctgctgctggacaagcagaaggctgacaccatccaggagctgcagcgggagctgcagatgctgcagaaggagagctccatggccgagaaggagcagaccagcaacaggaagagggtggaggagctgagcctggagctgtctgaggccctgaggaagctggagaacagcgacaaggagaagaggcagctgcagaagacagtggccgagcaggacatgaagatgaatgacatgctggaccgcatcaagcaccagcaccgggagcagggcagcatcaagtgcaagctggaggaggacctgcaggaggccaccaagctgctggaggacaagcgggagcagctgaagaagagcaaggagcacgagaagctgatggagggggagctggaggccctgcggcaggagttcaagaagaaggacaagaccctgaaggagaacagcaggaagctggaggaggagaatgaaaacctgcgggcagagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctatgatgccctgagcaggaagtctgctgcctgccaggatgacctgacccaggccctggagaagctgaaccacgtgaccagcgagaccaagagcctgcagcagagcctgacccagacccaggagaagaaggcccagctggaggaggagatcatcgcctatgaggagaggatgaagaagctgaacacagagctgaggaagctgcggggcttccaccaggagagcgagctggaggtgcacgcctttgacaagaagctggaggagatgagctgccaggtgctgcagtggcagaagcagcaccagaatgacctgaagatgctggccgccaaggaggagcagctgcgggagttccaggaggagatggccgccctgaaggagaacctgctggaggatgacaaggagccctgctgcctgccccagtggagcgtgcccaaggacacctgccgcctgtacagaggaaatgaccagatcatgaccaacctggagcagtgggccaagcagcagaaggtggccaatgagaagctgggcaaccagctgcgggagcaggtgaagtacatcgccaagctgagcggggagaaggaccgggagcccacccgggccagcagccccaacaccacccggcccagcagccccagccacagccacctgcacagcgtgatggtgcacctgcagcaggagaacaagaagctgaagaaggagattgaggagaagaagatgaaggccgagaacacccggctgtgcaccaaggccctgggccccagcaggacagagagcacccagcgggagaaggtgtgtggcaccctgggctggaagggcctgccccaggacatgggccagaggatggacctgaccaagtacatcggcatgccccactgccccggcagcagctactgctag

SEQ ID NO: 40867 - DNA, 474 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatggaggaggccatgaacagcagccatgacaagaagcaggcccaggccctggcctttgaggagagcgaggtggagtttggcagcagcaagcagtgccacctgcggcagctgcagcagctgaagaagaagctgctggtgctgcagcaggagctggagttccacacagaggagctgcagaccagctactacagcctgcggcagtaccagagcatcctggagaagcagaccagtgacctggtgctgctgcaccaccactgcaagctgaaggaggatgaagtcatcctgtatgaggaggagatgggcaaccacaatgaaaatactggagagaagctgtag

SEQ ID NO: 40868 - DNA, 207 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatggaggaggccatgaacagcagccatgacaagaagcaggcccaggccctggcctttgaggagagctag

SEQ ID NO: 40869 - DNA, 3069 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatggaggaggccatgaacagcagccatgacaagaagcaggcccaggccctggcctttgaggagagcgaggtggagtttggcagcagcaagcagtgccacctgcggcagctgcagcagctgaagaagaagctgctggtgctgcagcaggagctggagttccacacagaggagctgcagaccagctactacagcctgcggcagtaccagagcatcctggagaagcagaccagtgacctggtgctgctgcaccaccactgcaagctgaaggaggatgaagtcatcctgtatgaggaggagatgggcaaccacaatgaaaatactggagagaagctgcacctggcccaggagcagctggccctggccggggacaagatcgccagcctggagaggagcctgaacctgtacagagacaagtaccagagcagcctgagcaacatcgagctgctggagtgccaggtgaagatgctgcagggcgagctgggcggcatcatgggccaggagccagaaaataaaggagaccacagcaaggtgcgcatctacaccagcccctgcatgatccaggagcaccaggagacccagaagaggctgtctgaggtgtggcagaaggtgtcccagcaggatgacctgatccaggagctgaggaacaagctggcctgcagcaatgccctggtgctggagcgggagaaggccctgatcaagctgcaggccgactttgccagctgcacagccacccaccgctacccacccagcagcagcgaggagtgtgaggacatcaagaagatcctgaagcacctgcaggagcagaaggacagccagtgcctgcacgtggaggagtaccagaacctggtgaaggacctgcgggtggagctggaggccgtgtctgagcagaagaggaacatcatgaaggacatgatgaagctggagctggacctgcacggcctgcgggaggagaccagcgcccacatcgagaggaaggacaaggacatcaccatcctgcagtgccgcctgcaggagctgcagctggagttcacagagacccagaagctgaccctgaagaaggacaagttcctgcaggagaaggatgagatgctgcaggagctggagaagaagctgacccaggtgcagaacagcctgctgaagaaggagaaggagctggagaagcagcagtgcatggccacagagctggagatgacagtgaaggaggccaagcaggacaagagcaaggaggccgagtgcaaggccctgcaggccgaggtgcagaagctgaagaacagcctggaggaggccaagcagcaggagcggctggccggggaggccccagctgcccagcaggccgcccagtgcaaggaggaggccgccctggccggctgccacctggaggacacccagaggaagctgcagaagggcctgctgctggacaagcagaaggctgacaccatccaggagctgcagcgggagctgcagatgctgcagaaggagagctccatggccgagaaggagcagaccagcaacaggaagagggtggaggagctgagcctggagctgtctgaggccctgaggaagctggagaacagcgacaaggagaagaggcagctgcagaagacagtggccgagcaggacatgaagatgaatgacatgctggaccgcatcaagcaccagcaccgggagcagggcagcatcaagtgcaagctggaggaggacctgcaggaggccaccaagctgctggaggacaagcgggagcagctgaagaagagcaaggagcacgagaagctgatggagggggagctggaggccctgcggcaggagttcaagaagaaggacaagaccctgaaggagaacagcaggaagctggaggaggagaatgaaaacctgcgggcagagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctatgatgccctgagcaggaagtctgctgcctgccaggatgacctgacccaggccctggagaagctgaaccacgtgaccagcgagaccaagagcctgcagcagagcctgacccagacccaggagaagaaggcccagctggaggaggagatcatcgcctatgaggagaggatgaagaagctgaacacagagctgaggaagctgcggggcttccaccaggagagcgagctggaggtgcacgcctttgacaagaagctggaggagatgagctgccaggtgctgcagtggcagaagcagcaccagaatgacctgaagatgctggccgccaaggaggagcagctgcgggagttccaggaggagatggccgccctgaaggagaacctgctggaggatgacaaggagccctgctgcctgccccagtggagcgtgcccaaggacacctgccgcctgtacagaggaaatgaccagatcatgaccaacctggagcagtgggccaagcagcagaaggtggccaatgagaagctgggcaaccagctgcgggagcaggtgaagtacatcgccaagctgagcggggagaaggaccacctgcacagcgtgatggtgcacctgcagcaggagaacaagaagctgaagaaggagattgaggagaagaagatgaaggccgagaacacccggctgtgcaccaaggccctgggccccagcaggacagagagcacccagcgggagaaggtgtgtggcaccctgggctggaagggcctgccccaggacatgggccagaggatggacctgaccaagtacatcggcatgccccactgccccggcaccagcgccatctgccagaagaacaagtgtgacttcttcctgtag

SEQ ID NO: 40870 - DNA, 333 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatggaggaggccatgaacagcagccatgacaagaagcaggcccaggccctggcctttgaggagagcgaggtggagtttggcagcagcaagcagtgccacctgcggcagctgcagcagctgaagaagaagctgctggtgctgcagcaggagctggagttccacacagaggagctgcagaccagctactacagctag

SEQ ID NO: 40871 - DNA, 144 bp, Artificial Sequence
  Description of Artificial Sequence: Synthetic coding sequence
atgaaggatgaagctggggagcgggaccgggaggtgagcagcctgaacagcaagctgctgagcctgcagctggacatcaagaacctgcatgatgtgtgcaagaggcagaggaagaccctgcaggacaaccagctgtgcatgtag

SEQ ID NO: 40872 - DNA, 1536 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggcggcgtggtggaggtgggcgcccactggatccacggccccagccggggcaaccctgtgttccagctggccgcagaatatggcctgctgggggagaaggagctgagccaggagaaccagctggtggagaccggcggccacgtgggcctgcccagcgtgtcctatgccagcagcggggcctctgtgtccctgcagctggtggccgagatggccaccctcttctacggcctgattgaccagacccgggagttcctgcatgctgctgagacccctgtgcccagcgtgggggagtacctgaagaaggagatcggccagcacgtggccggctggacagaagatgaggagaccaggaagctgaagctggccgtgctgaacagcttcttcaacctggagtgctgcgtgtctggcacccacagcatggacctggtggccctggccccctttggagagtacacagtgctgcccggcctggactgcaccttcagcaagggctaccagggcctgaccaactgcatgatggccgccctgcctgaggacacagtggtgtttgagaagcctgtgaagaccatccactggaatggcagcttccaggaggccgccttccctggagagaccttccctgtgtctgtggagtgtgaagatggagaccgcttccctgcccaccacgtgattgtgacagtgcccctgggcttcctgcgggagcacctggacaccttctttgacccccccctgcctgctgagaaggccgaggccatcaggaagattggatttggcaccaacaacaagatcttcctggagtttgaggagcccttctgggagccagactgccagctgatccagctggtgtgggaggacaccagccccctggaggatgctgcccctgagctgcaggatgcctggttcaggaagctgattggatttgtggtgctgcctgcctttgcctctgtgcacgtgctgtgtggcttcatcgccggcctggagagcgagttcatggagaccctgagtgatgaggaggtgctgctgtgcctgacccaggtgctgcggcgggtgactggaaacccccggctgcctgcccccaagtctgtgctgcggagccgctggcacagcgccccctacacccggggcagctacagctatgtggccgtgggcagcactggaggagacctggacctgctggcccagcccctgcctgcagatggagctggggcccagctgcagatcctgtttgctggggaggccacccacaggaccttctacagcaccacccatggagccctgctgagcggctggagggaggccgaccggctgctgagcctgtgggccccccaggtgcagcagccccggccccggctgtag

SEQ ID NO: 40873 - DNA, 1461 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggcggcgtggtggaggtgggcgcccactggatccacggccccagccggggcaaccctgtgttccagctggccgcagaatatggcctgctgggggagaaggagctgagccaggagaaccagctggtggagaccggcggccacgtgggcctgcccagcgtgtcctatgccagcagcggggcctctgtgtccctgcagctggtggccgagatggccaccctcttctacggcctgattgaccagacccgggagttcctgcatgctgctgagacccctgtgcccagcgtgggggagtacctgaagaaggagatcggccagcacgtggccggctggacagaagatgaggagaccaggaagctgaagctggccgtgctgaacagcttcttcaacctggagtgctgcgtgtctggcacccacagcatggacctggtggccctggccccctttggagagtacacagtgctgcccggcctggactgcaccttcagcaagggctaccagggcctgaccaactgcatgatggccgccctgcctgaggacacagtggtgtttgagaagcctgtgaagaccatccactggaatggcagcttccaggaggccgccttccctggagagaccttccctgtgtctgtggagtgtgaagatggagaccgcttccctgcccaccacgtgattgtgacagtgcccctgggcttcctgcgggagcacctggacaccttctttgacccccccctgcctgctgagaaggccgaggccatcaggaagattggatttggcaccaacaacaagatcttcctggagtttgaggagcccttctgggagccagactgccagctgatccagctggtgtgggaggacaccagccccctggaggatgctgcccctgagctgcaggatgcctggttcaggaagctgattggatttgtggtgctgcctgcctttgcctctgtgcacgtgctgtgtggcttcatcgccggcctggagagcgagttcatggagaccctgagtgatgaggaggtgctgctgtgcctgacccaggtgctgcggcgggtgacagccccagaccctgtgtgtggcggcagccacaccagccacgtgctgctgcatgatgcccggggcagcgctgtgggcatggagggcggccggcccccaccccagagcgtgggccctgctggagctgctgcccaggcccaggccctggccggccccagcctgctgtgcagcaccagggtgggcggccgcctgggccccagcttcctgctgacagacttcagcctggcctag

SEQ ID NO: 40874 - DNA, 342 bp, Artificial Sequence
  Description of Artificial Sequence: Synthetic coding sequence
atggccaccctcttctacggcctgattgaccagacccgggagttcctgcacgccgctgagacccctgtgcccagcgtgggggagtacctgaagaaggagatcggccagcacgtggccggctggacagaagatgaggagaccaggaagctgaagctggccgtgctgaacagcttcttcaacctggagtgctgcgtgtctggcacccacagaagaacaggcctgtgctgcagagatggcggccggcccacagccagctctgtgtgtggcccccggcgctgcagcagccctggccctggcagctcctgggcccagcccaccctcttccacccctgccggggctag

SEQ ID NO: 40875 - DNA, 699 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggcggcgtggtggaggtgggcgcccactggattcatgctgcccctgagctgcaggatgcctggttcaggaagctgattggatttgtggtgctgcctgcctttgcctctgtgcacgtgctgtgtggcttcatcgccggcctggagagcgagttcatggagaccctgagtgatgaggaggtgctgctgtgcctgacccaggtgctgcggcgggtgacaggcaacccccggctgcctgcccccaagtctgtgctgcggagccgctggcacagcgccccctacacccggggcagctacagctatgtggccgtgggcagcactggaggagacctggacctgctggcccagcccctgcctgcagatggagctggggcccagctgcagatcctgtttgctggggaggccacccacaggaccttctacagcaccacccacggggccctgctgagcggctggagggaggccgaccggctgctgagcctgtgggccccccaggtgcagcagccccggccccggctgtag

SEQ ID NO: 40876 - DNA, 210 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggggccatcaaggacagccagacagcctag

SEQ ID NO: 40877 - DNA, 1392 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggcggcgtggtggaggtgggcgcccactggatccacggccccagccggggcaaccctgtgttccagctggccgcagaatatggcctgctgggggagaaggagctgagccaggagaaccagctggtggagaccggcggccacgtgggcctgcccagcgtgtcctatgccagcagcggggcctctgtgtccctgcagctggtggccgagatggccaccctcttctacggcctgattgaccagacccgggagttcctgcatgctgctgagacccctgtgcccagcgtgggggagtacctgaagaaggagatcggccagcacgtggccggctggacagaagatgaggagaccaggaagctgaagctggccgtgctgaacagcttcttcaacctggagtgctgcgtgtctggcacccacagcatggacctggtggccctggccccctttggagagtacacagtgctgcccggcctggactgcaccttcagcaagggctaccagggcctgaccaactgcatgatggccgccctgcctgaggacacagtggtgtttgagaagcctgtgaagaccatccactggaatggcagcttccaggaggccgccttccctggagagaccttccctgtgtctgtggagtgtgaagatggagaccgcttccctgcccaccacgtgattgtgacagtgcccctgggcttcctgcgggagcacctggacaccagccccctggaggatgctgcccctgagctgcaggatgcctggttcaggaagctgattggatttgtggtgctgcctgcctttgcctctgtgcacgtgctgtgtggcttcatcgccggcctggagagcgagttcatggagaccctgagtgatgaggaggtgctgctgtgcctgacccaggtgctgcggcgggtgactggaaacccccggctgcctgcccccaagtctgtgctgcggagccgctggcacagcgccccctacacccggggcagctacagctatgtggccgtgggcagcactggaggagacctggacctgctggcccagcccctgcctgcagatggagctggggcccagctgcagatcctgtttgctggggaggccacccacaggaccttctacagcaccacccatggagccctgctgagcggctggagggaggccgaccggctgctgagcctgtgggccccccaggtgcagcagccccggccccggctgtag

SEQ ID NO: 40878 - DNA, 252 bp, Artificial Sequence
  Description of Artificial Sequence: Synthetic coding sequence
atggagagcacaggctctgtgggggaggcccctgggggcccccgggtgctggtggtgggcggcggcatcagccgcagctgcctgcggggcaagccccacatcgcccgcttcacccccaggagaacaggcctgtgctgcagagatggcggccggcccacagccagctctgtgtgtggcccccggcgctgcagcagccctggccctggcagctcctgggcccagcccaccctcttccacccctgccggggctag

SEQ ID NO: 40879 - DNA, 978 bp, Artificial Sequence
  Description of Artificial Sequence: Synthetic coding sequence
atggagagcacaggctctgtgggggaggcccctgggggcccccgggtgctggtggtgggcggcggcattgctggcctgggcgccgcccagaggctgtgtggccacagcgccttcccccacctgcgggtgctggaggccacagcccgggccggcggccgcatccgctctgagcgctgcttcggcggcgtggtggaggtgggcgcccactggatccacggccccagccggggcaaccctgtgttccagctggccgcagaatatggcctgctgggggagaaggagctgagccaggagaaccagctggtggagaccggcggccacgtgggcctgcccagcgtgtcctatgccagcagcggggcctctgtgtccctgcagctggtggccgagatggccaccctcttctacggcctgattgaccagacccgggagttcctgcatgctgctgagacccctgtgcccagcgtgggggagtacctgaagaaggagatcggccagcacgtggccggctggacagaagatgaggagaccaggaagctgaagctggccgtgctgaacagcttcttcaacctggagtgctgcgtgtctggcacccacagcatggacctggtggccctggccccctttggagagtacacagtgctgcccggcctggactgcaccttcagcaagggctaccagggcctgaccaactgcatgatggccgccctgcctgaggacacagtggtgtttgagaagcctgtgaagaccatccactggaatggcagcttccaggaggccgccttccctggagagaccttccctgtgtctgtggagtgtgaagatggagaccgcttccctgcccaccacgtgattgtgacagtgcccctgggcctgagcaccttctctgtgggcagcctgcctgacctgagcctgagctcctggaggctgtgcaggatgaagaagtacttctgtgtgagccccaagtgcagcggggagtag

SEQ ID NO: 40880 - DNA, 132 bp, Artificial Sequence
  Description of Artificial Sequence: Synthetic coding sequence
atggagagcacaggctctgtgggggaggcccctgggggcagacatggcccccggcggggcccccaccccctgggcgccctgctgcgctggaggggcggcggcggccgggccctggacccctgctgcccctag

SEQ ID NO: 40881 - DNA, 2976 bp, Artificial Sequence
  Description of Artificial Sequence: Synthetic coding sequence
atgtctgctgtgggcctggtgctgctggtgctggccctgcggctgcgggccaccaccgtgaagccagaggagggcagcttctgcagcaacagccaggtggccttcagagatgcctgctatgaatttgtgcccctgggccgcaccttcagagatgcccagagctggtgtgagggccagggcggccacctggtgttcatccaggatgagggcacccagtggttcctgcagaagcacatcagccaggaccgggagtggtggattggcctgacctggaacctggccagaaatggcaccacagagggccctggcacctggctggacaccagcaatgtgacctacagcaactggcatggaggccaggccgctgctgccccagacacctgtggccacatcggccggggccccagcagcgagtgggtgaccagtgactgtgcccagacctttgccttcatgtgtgagttccgggtgggccagagcctggcctgtgagggcctgaatgccaccgtgcactgcggcctgggccaggtgatccaggtgcaggatgctgtgtatggccggcagaacccccacttctgcacccaggatgctggccggcccagcgacctggagcagggctgctcctgggccaacgtgaaggaggaggtggccggccagtgccaggagctgcagagctgccaggtggccgcagatgagacctacttcggcaacctgtgccccacccagggcagctacctgtgggtgcagtaccagtgccgggaggccctgcagctgatggtgtcctctgagagcttcatctttgacaacgtgaccatcagcctgacctggctgctgagcccctacatcggcaacctgagctgcatcatcagcactggagacagccacacctttgacccctacaaccccccatctgtgagcagcaatgtgacccaccagttcaccagccctggagagttcaccgtgtttgctgaatgtaccaccagcgagtggcacgtgacagcccagaggcaggtgacagtgcgggacaagatggagaccctgtctgtgacagcctgcagcggcctgagccagagcggggccggccccctgtgccaggccgtgtttggagaccccctgtggatccaggtggagctggatggcggcactggagtgacctacacagtgctgctgggggacatcaccctggccgagagcaccacccagaagggcagcctgccctacaacctgatcctggaccgggagacccagaagctgatgggccctggccgccaccggctggagatccaggccaccggcaacaccaccaccagcaccatcagcaggaacatcaccgtgcacctggtggagctgctgagcggcctgcaggcctcctgggccagtgaccacctggagctgggccaggacctgctgatcaccatcagcctggcccagggcaccccagaggagctgacctttgaggtggccggcctgaatgccaccttcagccatgagcaggtgtcctttggagagcccttcggcatctgccgcctggccgtgcctgtggagggcaccttcctggtgaccatgctggtgagaaatgccttcagcaacctgagcctggagatcggcaacatcaccatcacagcccccagcggcctgcaggagcccagcggcatgaatgctgagggcaagagcaaggacaagggggacatggaggtgtacatccagcccggcccctacgtggaccccttcaccaccgtgaccctgggctggccagacaatgacaaggagctgcgcttccagtggagctgtggcagctgctgggccctgtggagcagctgtgtggagcggcagctgctgaggacagaccagcgggagctggtggtgcctgccagctgcctgcccccaccagattctgctgtgaccctgcggctggccgtgctgcggggccaggagctggagaacagagctgagcagtgcctgtatgtgtctgccccctgggagctgcggccccgggtgtcctgtgaaagaaactgcaggcctgtgaatgccagcaaggacatcctgctgcgggtgaccatgggagaggacagccctgtggccatgttctcctggtacctggacaacacccccacagagcaggccgagcccctgctggatgcctgccgcctgcggggcttctggcccaggagcctgaccctgctgcagagcaacaccagcaccctgctgctgaacagcagcttcctgcagagcagaggagaggtgatccgcatccgggccacagccctgaccaggcatgcctacggggaggacacctacgtgatcagcacagtgcccccccgggaggtgcctgcctgcaccatcgcccctgaggagggcaccgtgctgaccagctttgccatcttctgcaatgccagcacagccctgggccccctggagttctgcttctgcctggagagcggcagctgcctgcactgcggccctgagcccgccctgcccagcgtgtacctgcccctgggggaggagaacaatgactttgtgctgactgtggtgatcagcgccaccaacagagctggggacacccagcagacccaggccatggccaaggtggccctgggggacacctgtgtggaggatgtggccttccaggccgctgtgtctgagaagatccccacagccctgcagggcgagggcggccctgagcagctgctgcagctggccaaggctgtgtcctccatgctgaaccaggagcacgagagccagggcagcggccagagcctgagcattgatgtgcggcagaaggtgcgggagcacgtgctgggcagcctgtctgctgtgaccaccggcctggaggatgtgcagagggtgcaggagctggccgaggtgctgcgggaggtgacctgccgcagcaaggagctgacccccagcgcccagggcagctgcatgggagacagctgggagggcgcccccccagctgcccacgtgtcccatgccaggtag

SEQ ID NO: 40882 - DNA, 1560 bp, Artificial Sequence
  Description of Artificial Sequence: Synthetic coding sequence
tgactggcccagggcaccccagaggagctgacctttgaggtggccggcctgaatgccaccttcagccatgagcaggtgtcctttggagagcccttcggcatctgccgcctggccgtgcctgtggagggcaccttcctggtgaccatgctggtgagaaatgccttcagcaacctgagcctggagatcggcaacatcaccatcacagcccccagcggcctgcaggagcccagcggcatgaatgctgagggcaagagcaaggacaagggggacatggaggtgtacatccagcccggcccctacgtggaccccttcaccaccgtgaccctgggctggccagacaatgacaaggagctgcgcttccagtggagctgtggcagctgctgggccctgtggagcagctgtgtggagcggcagctgctgaggacagaccagcgggagctggtggtgcctgccagctgcctgcccccaccagattctgctgtgaccctgcggctggccgtgctgcggggccaggagctggagaacagagctgagcagtgcctgtatgtgtctgccccctgggagctgcggccccgggtgtcctgtgaaagaaactgcaggcctgtgaatgccagcaaggacatcctgctgcgggtgaccatgggagaggacagccctgtggccatgttctcctggtacctggacaacacccccacagagcaggccgagcccctgctggatgcctgccgcctgcggggcttctggcccaggagcctgaccctgctgcagagcaacaccagcaccctgctgctgaacagcagcttcctgcagagcagaggagaggtgatccgcatccgggccacagccctgaccaggcatgcctacggggaggacacctacgtgatcagcacagtgcccccccgggaggtgcctgcctgcaccatcgcccctgaggagggcaccgtgctgaccagctttgccatcttctgcaatgccagcacagccctgggccccctggagttctgcttctgcctggagagcggcagctgcctgcactgcggccctgagcccgccctgcccagcgtgtacctgcccctgggggaggagaacaatgactttgtgctgactgtggtgatcagcgccaccaacagagctggggacacccagcagacccaggccatggccaaggtggccctgggggacacctgtgtggaggatgtggccttccaggccgctgtgtctgagaagatccccacagccctgcagggcgagggcggccctgagcagctgctgcagctggccaaggctgtgtcctccatgctgaaccaggagcacgagagccagggcagcggccagagcctgagcattgatgtgcggcagaaggtgcgggagcacgtgctgggcagcctgtctgctgtgaccaccggcctggaggatgtgcagagggtgcaggagctggccgaggtgctgcgggaggtgacctgccgcagcaaggagctgacccccagcgcccagggcagctgcatgggagacagctgggagggcgcccccccagctgcccacgtgtcccatgccaggtag

SEQ ID NO: 40883 - DNA, 798 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgatgctgaggagaagctggacaggagccatgacaagagtgaccggggccatgacaagagtgacaggagccatgagaagctggaccggggccatgacaagagtgaccggggccatgacaagagtgaccgggaccgggagcggggctatgacaaggtggaccgggagcgggagcgggaccgggagcgggaccgggaccggggctatgacaaggctgaccgggaggagggcaaggagcggcggcaccaccggcgggaggagctggccccctaccccaagagcaagaaggctgtgtccaggaaggatgaggagctggaccccatggaccccagcagctacagtgatgccccccggggcacctggagcacaggcctgcccaagagaaatgaggccaagacaggagctgacaccacagctgctggccccctcttccagcagaggccctaccccagccctggagctgtgctgcgggccaatgctgaggccagcaggaccaagcagcaggactag

SEQ ID NO: 40884 - DNA, 798 bp, Artificial Sequence; identical to SEQ ID NO: 40883
  Description of Artificial Sequence: Synthetic coding sequence

SEQ ID NO: 40885 - DNA, 798 bp, Artificial Sequence; identical to SEQ ID NO: 40883
  Description of Artificial Sequence: Synthetic coding sequence

SEQ ID NO: 40886 - DNA, 513 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgctgtgtccaggaaggatgaggagctggaccccatggaccccagcagctacagtgatgccccccggggcacctggagcacaggcctgcccaagagaaatgaggccaagacaggagctgacaccacagctgctggccccctcttccagcagaggccctaccccagccctggagctgtgctgcgggccaatgctgaggccagcaggaccaagcagcaggactag

SEQ ID NO: 40887 - DNA, 1446 bp, Artificial Sequence
  Description of Artificial Sequence: Synthetic coding sequence
atgtaccaggccagcgctgtgtccctgctgccccgggacatccccagctgccacagccccagccctggcttcagccacctgcccaccagcagcagccagctggccccagacctgctgcagttccccctgggccaggaccccagcttcctggccatccccatcctgaccctgccccccagcgacagcctggtgcccccctacatcgtgtggtacatcgtgtggcccagcgccctgatctccttcctgggctgcaccctgactgtgcagttcagcaatggcaagctgcagagccctggcaacatgaggttcaccctgtatgagaacaaggacagcaccaaccccaggaagaggaaccagaggatcctggccgctgagacagaccggctgtcctatgtgggcaacaactttggcaccggggccctgaagtgcaacaccctgtgccgccactttgtgggcatcctgaacaagaccagcggccagatggaggtgtatgatgctgagctgttcaacatgcagcccctcttcagtgatgtgtctgtggagagcgagctggccctggagagccagaccaagacctaccgggagaagatggacagctgcatcgaggccttcggcaccaccaagcagaagagggccctgaacaccaggaggatgaacagagtgggcaatgaaagcctgaacagagctgtggccaaggctgctgagaccatcatcgacaccaagggcgtgacagccctggtgtctgatgccatccacaatgacctgcaggatgacagcctgtacctgcccccctgctatgatgatgctgccaagccagaagatgtgtacaagtttgaggacctgctgagccctgcagaatatgaggccctgcagagccccagcgaggccttcagaaatgtgaccagcgaggagatcctgaagatgattgaggagaacagccactgcacctttgtgattgaggccctgaagagcctgcccagtgatgtggagagccgggaccggcaggcccgctgcatctggttcctggacaccctcatcaagttccgggcccaccgggtggtgaagaggaagagcgccctgggccctggggtgccccacatcatcaacaccaagctgctgaagcacttcacctgcctgacctacaacaacggccgcctgaggaacctgatcagtgacagcatgaaggccaagatcacagcctacgtgatcatcctggccctgcacatccatgacttccagattgacctgactgtgctgcagagggacctgaagctgtctgagaagaggatgatggagatcgccaaggccatgaggctgaagatcagcaagagaagagtgtctgtggccgccggcagcgaggaggaccacaagctgggcaccctgagcctgcccctgcccccagcccagaccagtgaccggctggccaagaggaggaagatcacctag

SEQ ID NO: 40888 - DNA, 1260 bp, Artificial Sequence
  Description of Artificial Sequence: Synthetic coding sequence
atggctgctgaggtgctgcccagcgcccgctggcagtactgtggggccccagatggcagccagagagctgtgctggtgcagttcagcaatggcaagctgcagagccctggcaacatgaggttcaccctgtatgagaacaaggacagcaccaaccccaggaagaggaaccagaggatcctggccgctgagacagaccggctgtcctatgtgggcaacaactttggcaccggggccctgaagtgcaacaccctgtgccgccactttgtgggcatcctgaacaagaccagcggccagatggaggtgtatgatgctgagctgttcaacatgcagcccctcttcagtgatgtgtctgtggagagcgagctggccctggagagccagaccaagacctaccgggagaagatggacagctgcatcgaggccttcggcaccaccaagcagaagagggccctgaacaccaggaggatgaacagagtgggcaatgaaagcctgaacagagctgtggccaaggctgctgagaccatcatcgacaccaagggcgtgacagccctggtgtctgatgccatccacaatgacctgcaggatgacagcctgtacctgcccccctgctatgatgatgctgccaagccagaagatgtgtacaagtttgaggacctgctgagccctgcagaatatgaggccctgcagagccccagcgaggccttcagaaatgtgaccagcgaggagatcctgaagatgattgaggagaacagccactgcacctttgtgattgaggccctgaagagcctgcccagtgatgtggagagccgggaccggcaggcccgctgcatctggttcctggacaccctcatcaagttccgggcccaccgggtggtgaagaggaagagcgccctgggccctggggtgccccacatcatcaacaccaagctgctgaagcacttcacctgcctgacctacaacaacggccgcctgaggaacctgatcagtgacagcatgaaggccaagatcacagcctacgtgatcatcctggccctgcacatccatgacttccagattgacctgactgtgctgcagagggacctgaagctgtctgagaagaggatgatggagatcgccaaggccatgaggctgaagatcagcaagagaagagtgtctgtggccgccggcagcgaggaggaccacaagctgggcaccctgagcctgcccctgcccccagcccagaccagtgaccggctggccaagaggaggaagatcacctag

SEQ ID NO: 40889 - DNA, 561 bp, Artificial Sequence
  Description of Artificial Sequence: Synthetic coding sequence
atggctgctgaggtgctgcccagcgcccgctggcagtactgtggggccccagatggcagccagagagctgtgctggtgcagttcagcaatggcaagctgcagagccctggcaacatgaggttcaccctgtatgagaacaaggacagcaccaaccccaggaagaggaaccagaggatcctggccgctgagacagaccggctgtcctatgtgggcaacaactttggcaccggggccctgaagtgcaacaccctgtgccgccactttgtgggcatcctgaacaagaccagcggccagatggaggtgtatgatgctgagctgttcaacatgcagcccctcttcagtgatgtgtctgtggagagcgagctggccctggagagccagaccaagacctaccgggagaagatgacccccagcaccttcctgcctgccatgatgatgcagcccagcctgaagacctgcatcaacctgaagatcttcttccccctgtggagggctgagacagcccggccagatgcctacggcttctggatccccagcagcaactttgagctgattggatag

SEQ ID NO: 40890 - DNA, 1050 bp, Artificial Sequence
  Description of Artificial Sequence: Synthetic coding sequence
atgatgctgaactgcagcacctgcagccactacttccaggtgttccaccaggagagcaagatcatcttctggaaggagcccaggacctgcttcctgatcctgagcctgcccctgcctggagagctgacctgggatgtgtctgtggagagcgagctggccctggagagccagaccaagacctaccgggagaagatggacagctgcatcgaggccttcggcaccaccaagcagaagagggccctgaacaccaggaggatgaacagagtgggcaatgaaagcctgaacagagctgtggccaaggctgctgagaccatcatcgacaccaagggcgtgacagccctggtgtctgatgccatccacaatgacctgcaggatgacagcctgtacctgcccccctgctatgatgatgctgccaagccagaagatgtgtacaagtttgaggacctgctgagccctgcagaatatgaggccctgcagagccccagcgaggccttcagaaatgtgaccagcgaggagatcctgaagatgattgaggagaacagccactgcacctttgtgattgaggccctgaagagcctgcccagtgatgtggagagccgggaccggcaggcccgctgcatctggttcctggacaccctcatcaagttccgggcccaccgggtggtgaagaggaagagcgccctgggccctggggtgccccacatcatcaacaccaagctgctgaagcacttcacctgcctgacctacaacaacggccgcctgaggaacctgatcagtgacagcatgaaggccaagatcacagcctacgtgatcatcctggccctgcacatccatgacttccagattgacctgactgtgctgcagagggacctgaagctgtctgagaagaggatgatggagatcgccaaggccatgaggctgaagatcagcaagagaagagtgtctgtggccgccggcagcgaggaggaccacaagctgggcaccctgagcctgcccctgcccccagcccagaccagtgaccggctggccaagaggaggaagatcacctag

SEQ ID NO: 40891 - DNA, 588 bp, Artificial Sequence
  Description of Artificial Sequence: Synthetic coding sequence
atggccagcagaggaggcggccggggccggggccggggccagctgaccttcaacgtggaggccgtgggcatcggcaaaggagatgccctgcccccacccaccctgcagcccagccccctcttcccccccctggagttccggcctgtgcccctgcccagcggggaggagggggagtatgtgctggccctgaagcaggagctgcggggggccatgaggcagctgccctacttcatccggcctgctgtgcccaagagggactggaggcggctgccccgggagctgaagatccgggtgaggaagctgcagaaggagcgcatcaccatcctgctgcccaagaggcctcccaagaccacagaggacaaggaggagaccatccagaagctggagaccctggagaagaaggaggaggaggtgaccagcgaggaggatgaggagaaggaggaggaggaggagaaggaggaggaggaggaggaggagtatgatgaggaggagcacgaggaggagacagactacatcatgagctactttgacaacggggaggactttggaggagacagtgatgacaacatggatgaggccatctactag

SEQ ID NO: 40892 - DNA, 657 bp, Artificial Sequence
  Description of Artificial Sequence: Synthetic coding sequence
atggccagcagaggaggcggccggggccggggccggggccagctgaccttcaacgtggaggccgtgggcatcggcaaaggagatgccctgcccccacccaccctgcagcccagccccctcttcccccccctggagttccggcctgtgcccctgcccagcggggaggagggggagtatgtgctggccctgaagcaggagctgcggggggccatgaggcagctgccctacttcatccggcctgctgtgcccaagagagatgtggagcgctacagcgacaagtaccagatgagcggccccatcgacaatgccatcgactggaacccagactggaggcggctgccccgggagctgaagatccgggtgaggaagctgcagaaggagcgcatcaccatcctgctgcccaagaggcctcccaagaccacagaggacaaggaggagaccatccagaagctggagaccctggagaagaaggaggaggaggtgaccagtgaagaagatgaggagaaggaggaggaggaggagaaggaggaggaggaggaggaggagtatgatgaggaggagcacgaggaggagacagactacatcatgagctactttgacaatggagaagattttggaggagacagtgatgacaacatggatgaggccatctactag

SEQ ID NO: 40893 - DNA, 1680 bp, Artificial Sequence
  Description of Artificial Sequence: Synthetic coding sequence
atggccacagccaccatcgccctgcaggtgaatggccagcagggcggcggcagcgagcctgctgctgctgctgctgtggtggccgccggggacaagtggaagccaccccagggcacagacagcatcaagatggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggctgctgtgaccatgggctttggagaccccctgagccccctgcagagcatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcatcgagtatgagaaggcccagagcagccaggatgctgtgtcctccatgaacctgtttgacctgggcggccagtacctgcgggtgggcaaggctgtgaccccacccatgcccctgctgaccccagccaccccaggcggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcactggagtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaggagtgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 40894 - DNA, 1500 bp, Artificial Sequence
  Description of Artificial Sequence: Synthetic coding sequence
atggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcatcgagtatgagaaggcccagagcagccaggatgctgtgtcctccatgaacctgtttgacctgggcggccagtacctgcgggtgggcaaggctgtgaccccacccatgcccctgctgaccccagccaccccaggcggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcactggagtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaggagtgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 40895 - DNA, 1629 bp, Artificial Sequence
  Description of Artificial Sequence: Synthetic coding sequence
atggccacagccaccatcgccctgcaggtgaatggccagcagggcggcggcagcgagcctgctgctgctgctgctgtggtggccgccggggacaagtggaagccaccccagggcacagacagcatcaagatggagaatggccagagcacagctgccaagctgggcctgccccccctgaccccagagcagcaggaggccctgcagaaggccaagaagtatgccatggagcagagcatcaagtctgtgctggtgaagcagaccatcgcccaccagcagcagcagctgaccaacctgcagatggccgcccagaggcagagggccctggccatcatgtgccgggtgtatgtgggcagcatctactatgagctgggggaggacaccatccggcaggcctttgcccccttcggccccatcaagagcattgacatgtcctgggacagcgtgaccatgaagcacaagggctttgcctttgtggagtatgaggtgcctgaggccgcccagctggccctggagcagatgaacagcgtgatgctgggcggcaggaacatcaaggtgggccggcccagcaacatcggccaggcccagcccatcatcgaccagctggccgaggaggcccgggccttcaaccgcatctacgtggcctctgtgcaccaggacctgagtgatgatgacatcaagtctgtgtttgaggccttcggcaagatcaagagctgcaccctggcccgggaccccaccaccgggaagcacaagggctacggcttcattgaatatgagaaggcccagagcagccaggatgctgtgtcctccatgaacctgtttgacctgggcggccagtacctgcgggtgggcaaggctgtgaccccacccatgcccctgctgaccccagccacccctgggggcctgcccccagctgctgctgtggccgctgctgctgccacagccaagatcacagcccaggaggccgtggccggggctgctgtgctgggcaccctgggcaccccaggcctggtgtccccagccctgaccctggcccagcccctgggcaccctgccccaggccgtgatggccgcccaggcccctggggtcatcaccggggtgaccccagcccggccccccatccctgtgaccatccccagcgtgggcgtggtgaaccccatcctggccagcccccccaccctgggcctgctggagcccaagaaggagaaggaggaggaggagctgtttcctgagagcgagaggcctgagatgctgtctgagcaggagcacatgagcatcagcggcagcagcgcccggcacatggtgatgcagaagctgctgaggaagcaggagagcacagtgatggtgctgaggaacatggtggaccccaaggacattgatgatgacctggagggggaggtgacagaagaatgtgggaagtttggagctgtgaacagagtcatcatctaccaggagaagcagggcgaggaggaggatgctgagatcatcgtgaagatctttgtggagttcagcatcgccagcgagacccacaaggccatccaggccctgaatggccgctggtttgctggcaggaaggtggtggccgaggtgtatgaccaggagagatttgacaacagcgacctgagcgcctag

SEQ ID NO: 40896 - DNA, 891 bp, Artificial Sequence
  Description of Artificial Sequence: Synthetic coding sequence
atgggcgccgccgccccagctgagagcgctgacctgggcaacttctggaaggccggggagcccctgctgcagggcccagatgccctggccgcccccatgagccgcagccccagcaccccccagaccacccccagcccccagggccggcagagcccctggcccctgcggagcctgacccagagccacatccagtacttccagtggggccggcctgtgcccagcacccacctgattgaggtgcggcccacccaggaccctgccaagccccagagggtggtgtctgagggctggaggaggcctgccctgcctggagaaacagccctgggccgggacctgagctgtgcctgggagggctgcatgaagggcggcctgtgccgggcctggaaccctggccgcacctggagccctgtgaccatcggcatcgcccctcctgagcggcaggagagcccctggaggagccctggccagagggcccggcctgctggccggcctgctgcccaggagctgctggacccctgcacccgggagaccctgctgggcgccctgagccagtgccccaagggcagcgccaggtttgatggccccctgtggtttgaggtgtctgacagcaagggcggcagaagaaacctgcagccccggcccagcgccttcaagcccctgagcaagaatggagctgtggccagctttgtgcccaggcctggccccctgaagcccagcctgggcccctggagcctgtccttctgtgatgatgcctggcccagcgtgctggtgcagcctgcccccagcgccatctgggacttctgggaggccaccacccccagctgtggcagctgcagccgggtgtcctttgccctggaggtgacccagagcgctggccccttcggcagctag

SEQ ID NO: 40897 - DNA, 2916 bp, Artificial Sequence
  Description of Artificial Sequence: Synthetic coding sequence
atgggcagcttcctgagcaagctggagctgagccccagcagccctgcccaggtgaggacagacctgcctgagcggcccaccaagagaagaccaccccagcccctgcaccaggtgcaccgggtgcagtttgtgcaccgggcccacccagccccccgctacagacctgtgagaagaagacccaacctggaccctgccaaccccaccacctggctggccaatgaggcctggaggcgcttccccatgaagaagagccagaacagccccctgggccccctgcccagcgactggtgggagagctacctgaagaggaccatctggagcctgcggcacccccggcccatctggagccctgtgaccatccgcatcaccccaccagaccagagggtgccccccagcaccagcccagaagatgtgattgccctggccggcctgcccccatctgaggagctggccgacccctgcagcaaggagaccgtgctgcgggccctgagagaatgtaggaagggcaagggccgcctggaggagcccctcttccctgagagcctggacagcaagaggaggagccctgagacccggcccagcgccttcaagcccctgatgaagaatggcaccctgaccagctttgtgccccggcccggccccctgaagaggagcctgcacagctggggcagtgaccacagcctgaccaagaggcccaactgcagctccatgagcagcctggccagcatctaccggggcggcaccctgagcagcaagagaaatgccatcggcagcagctacagcagctgcaggaacttcagtgacccctggaagaggtctgtgcccagcgtgtcctttgagaccccagagtggcccatcaagaaggagaagagctgccaccggcccagcagccctgtgcccctggtgtctgactttgagagcctgggcggcagcgagagcagcggccagcagaaccagaagatcccccagctgcccagcagccctgagaacctggtgtctgagatccccccaccccagctgggctatgctgtgtctgatgagaacctgaccctgggcaagaaggccgagctgcagagcactggagaggccacctctgtggcccacagccccctgaagacccccagcctgcccaccccacctggctgcagccagagcgagctgctgcccggcaccagcccagacagcaagcccacagccaccttcatcctgctgacccccaccagccccaccctgcctgtgacagacaccacctggccacccagcaccagccaggccgacaggagccccatgcccccagaccccccagccccacccaccatccagagcaccctgctgggcatggtgagcagccccaccagccacctgagcgccagcgcccccccagatgccaccagcgcccacctgatgctgaagcccatcctgggccccctgcacaacagcgagatcggcagcagcagctacagccgcatctctgtgacagctgctgccagcagcatcagcagcctgagcaccatccagggcaccctgacccccaccttcaagcccatcttcggcagcattgaccccctgaagaccacccccatgattgcccccttcagcagcaagcagaccccaccacccttcacccacgccagcacccaccacttccacggcctggtgaaggccacctctgtggtgatgagcaccaccctggccagcaccagcaaggacagcgtcttcaagccacccctggactttggagtggtgaatgtgaccagcgctgtgggcaacacctacagcgtgcccagcacctgtgacaccttcctgctgggcacagcccaggccttccgggctgacttcaccccagccaccggcttcatcttccccccccaccaccaccccaccatccccaccgtgcacacagtgaccatgttcacccaggtgctgagctctgtggtgcagatcagccccaggagcagcacagccaacttccggggcatgggcagccccctgcctgccagcgccctggtgtccaccaactggctggccagcacccccagcatcagcaacctgaccccagccatcaccagccccctgggcagcagcagccggccccccttccccctgagccagggcgccaacccccagcctgccttcggggccaccaacggccagaagcagggccccagccagcctgccctgatgcccagcgtgagcagcagcttcctgtttggcagcagcgctgtggccctgcccacccccatgcccaccccagcccagcctgccttcatcagcaccacccagagcgccctgggctgcctgacccccagcgccagcaccagccagaccccagccagcacctggagcggcatcggcggcatcccagctggcttccccatcagccaggccagcaccaccggcttcagaattgtcatccagacccaccagagcggggcctttggatctgtgtttggcagccgggccccccagcccttcacctttggaggctttgtgacccccatggactgtgatgaaagtggcatcatcatgacaggccctgacatgagccccaccagcggggccttcagcattggagccctgcccagcggcaccaccaacaccatgatcccctttgggaagggctggagccagaacacagagggcctgcccagccacaggacagccttcagcctgggccggggcagcatcagcgccaggaagaccatggcccccatcgcccagaacacccctgtgcccggccaggccaaggccggcagctctgtgggcttcggcatgcccttccccccagcccagggctctgtgggccggggccccttccgcagcagcgccagcagcttcagcatcggggccaagagcaagacccccaagaaccgggagaagggccacagccgccgccaccacgcctacaagaagtag

SEQ ID NO: 40898 - DNA, 3108 bp, Artificial Sequence
  Description of Artificial Sequence: Synthetic coding sequence
atgggcagcttcctgagcaagctggagctgagccccagcagccctgcccaggtgaggacagacctgcctgagcggcccaccaagagaagaccaccccagcccctgcaccaggtgcaccgggtgcagtttgtgcaccgggcccacccagccccccgctacagacctgtgagaagaagacccaacctggaccctgccaaccccaccacctggctggccaatgaggcctggaggcgcttccccatgaagaagagccagaacagccccctgggccccctgcccagcgactggtgggagagctacctgaagaggaccatctggagcctgcggcacccccggcccatctggagccctgtgaccatccgcatcaccccaccagaccagagggtgccccccagcaccagcccagaagatgtgattgccctggccggcctgcccccatctgaggagctggccgacccctgcagcaaggagaccgtgctgcgggccctgagagaatgtaggaagggcaagggccgcctggaggagcccctcttccctgagagcctggacagcaagaggaggagccctgagacccggcccagcgccttcaagcccctgatgaagaatggcaccctgaccagctttgtgccccggcccggccccctgaagaggagcctgcacagctggggcagtgaccacagcctgaccaagaggcccaactgcagctccatgagcagcctggccagcatctaccggggcggcaccctgagcagcaagagaaatgccatcggcagcagctacagcagctgcaggaacttcagtgacccctggaagaggtctgtgcccagcgtgtcctttgagaccccagagtggcccatcaagaaggagaagagctgccaccggcccagcagccctgtgcccctggtgtctgactttgagagcctgggcggcagcgagagcagcggccagcagaaccagaagatcccccagctgcccagcagccctgagaacctggtgtctgagatccccccaccccagctgggctatgctgtgtctgatgagaacctgaccctgggcaagaaggccgagctgcaggtgagcaacaatgctggggaggacaccacagaggtgaacacagaccccttccctgagacctggctggccatccagcccagcctgagcctggccctgcccagcagcgagacagacctgacccagggcgccaacccccagctggagaacctgaggaagatgcagaagagcctgggccccctggccagcccccagagcactggagaggccacctctgtggcccacagccccctgaagacccccagcctgcccaccccacctggctgcagccagagcgagctgctgcccggcaccagcccagacagcaagcccacagccaccttcatcctgctgacccccaccagccccaccctgcctgtgacagacaccacctggccacccagcaccagccaggccgacaggagccccatgcccccagaccccccagccccacccaccatccagagcaccctgctgggcatggtgagcagccccaccagccacctgagcgccagcgcccccccagatgccaccagcgcccacctgatgctgaagcccatcctgggccccctgcacaacagcgagatcggcagcagcagctacagccgcatctctgtgacagctgctgccagcagcatcagcagcctgagcaccatccagggcaccctgacccccaccttcaagcccatcttcggcagcattgaccccctgaagaccacccccatgattgcccccttcagcagcaagcagaccccaccacccttcacccacgccagcacccaccacttccacggcctggtgaaggccacctctgtggtgatgagcaccaccctggccagcaccagcaaggacagcgtcttcaagccacccctggactttggagtggtgaatgtgaccagcgctgtgggcaacacctacagcgtgcccagcacctgtgacaccttcctgctgggcacagcccaggccttccgggctgacttcaccccagccaccggcttcatcttccccccccaccaccaccccaccatccccaccgtgcacacagtgaccatgttcacccaggtgctgagctctgtggtgcagatcagccccaggagcagcacagccaacttccggggcatgggcagccccctgcctgccagcgccctggtgtccaccaactggctggccagcacccccagcatcagcaacctgaccccagccatcaccagccccctgggcagcagcagccggccccccttccccctgagccagggcgccaacccccagcctgccttcggggccaccaacggccagaagcagggccccagccagcctgccctgatgcccagcgtgagcagcagcttcctgtttggcagcagcgctgtggccctgcccacccccatgcccaccccagcccagcctgccttcatcagcaccacccagagcgccctgggctgcctgacccccagcgccagcaccagccagaccccagccagcacctggagcggcatcggcggcatcccagctggcttccccatcagccaggccagcaccaccggcttcagaattgtcatccagacccaccagagcggggcctttggatctgtgtttggcagccgggccccccagcccttcacctttggaggctttgtgacccccatggactgtgatgaaagtggcatcatcatgacaggccctgacatgagccccaccagcggggccttcagcattggagccctgcccagcggcaccaccaacaccatgatcccctttgggaagggctggagccagaacacagagggcctgcccagccacaggacagccttcagcctgggccggggcagcatcagcgccaggaagaccatggcccccatcgcccagaacacccctgtgcccggccaggccaaggccggcagctctgtgggcttcggcatgcccttccccccagcccagggctctgtgggccggggccccttccgcagcagcgccagcagcttcagcatcggggccaagagcaagacccccaagaaccgggagaagggccacagccgccgccaccacgcctacaagaagtag

SEQ ID NO: 40899 - DNA, 1374 bp, Artificial Sequence
  Description of Artificial Sequence: Synthetic coding sequence
atggacagcctgtggggccctggagctggcagccaccccttcggcgtgcacaacagccggctgagcccagacctgtgccctgggaagatcgtgctgcgggccctgaaggagagcggggccggcatgcctgagcaggacaaggacccccgggtgcaggagaaccctggggaccagaggagagtgcctgaggtgactggagatgcccccagcgccttccggcccctgcgggacaatggaggcctgagcccctttgtgcccggccctggccccctgcagacagacctgcacgcccagaggtctgagatccgctatgaccagagcagccagacctcctggaccagcagctgcaccaacagaaatgccatcagcagcagctacagcagcactggaggcctgcccggcctgaagagaagaagaggccctgccagcagccactgccagctgaccctgagcagcagcaagacagtgtctgaggaccggccccaggccgtgagcagcggccacacccagtgtgagaaggtggccgagaaggcccctggccagaccctggccctgagaaatgacagcagccgctctgaggccagccggcccagcaccaggaagttccccctgctgccccaccggcggggggagcccctgatgctgcccccacctgtggagctgggctacagagtgacagctgaggacctggactgggagaaggaggccgccttccagtgcatcaagagcgccctgcaggtggaggacaaggccatcagtgactgccggcccagccggcccagccacaccctgagcagcctggccactggagccagcggcctgcctgctgtgtccaaggcccccagcatggatgcccagcaggagcggcacaagagccaggactgcctgggcctggtggcccccctggccagcgccacagaggtgcccagcacagcccccatgtctggagagaagcacaggcctcctggccccctcttcagcagcagtgaccccctgcctgccaccagcagccacagccaggacagcgcccaggtgaccagcctcatcccagcccccttccctgctgcctccatggatgctggcatgaggaggaccaggcctggcaccagcgccccagctgctgctgctgctgcccccccacccagcaccctgaacagaaccctgggcagcctgctggagtggatggaggccctgcacatcagcggcccccagccccagctgcagcaggtgccccggggccagaaccagaggagccagaccagcaggaccagcagctgccccaagagaaatgccatcagcagcagctgcagcagcactggagacctgcccggcaggaagaggaagaggcggcagccccaccccacagccagctag

SEQ ID NO: 40900 - DNA, 1389 bp, Artificial Sequence
  Description of Artificial Sequence: Synthetic coding sequence
atggacagcctgtggggccctggagctggcagccaccccttcggcgtgcacaacacccggctgagcccagacctgtgccctgggaagatcgtgctgcgggccctgaaggagagcggggccggcatgcctgagcaggacaaggacccccgggtgcaggagaaccctggggaccagaggagagtgcctgaggtgactggagatgcccccagcgccttccggcccctgcgggacaatggaggcctgagcccctttgtgcccggccctggccccctgcagacagacctgcacgcccagaggtctgagatccgctacaaccagaccagccagacctcctggaccagcagctgcaccaacagaaatgccatcagcagcagctacagcagcactggaggcctgcccggcctgaagagaagaagaggccctgccagcagccactgccagctgaccctgagcagcagcaagacagtgtctgaggaccggccccaggccgtgagcagcggccacacccagtgtgagaaggctgctgacatcgcccctggccagaccctggccctgagaaatgacagcagcaccagcgaggccagccggcccagcacccacaagttccccctgctgccccggcggcggggggagcccctgatgctgcccccacccctggagctgggctacagagtgacagtggaggacctggaccgggagaaggaggccgccttccagaggatcaacagcgccctgcaggtggaggacaaggccatcagtgactgccggcccagccggcccagccacaccctgagcagcctggccactggagccagcggcctgccccctgtgtccaaggcccccagcatggatgcccagcaggagacccacaagagccaggactgcctgggcctgctggcccccctggccagcgctgctggggtgcccagcacagcccccatgtctgggaagaagcacaggcctcctggccccctcttcagcagcagtgaccccctgcctgccaccagcagccacagccaggacagcgcccaggtgaccagcctcatcccagcccccttccctgctgcctccatggatgctggcatgaggaggacccgctgtggcaccagcgccccagctgctgctgctgctgcccccccacccagcaccctgaaccccaccctgggcagcctgctggagtggatggaggccctgcacatcagcggcccccagccccagctgcagcaggtgccccggggccagaaccagaggagccagaccagcaggaccagcagctgccccaagagaaatgccatcagcagcccctaccgcagcactggaggcctgcctgagaggaagagaagaagaggccctgccagcagccactgccagctgaccctgagcagctag

SEQ ID NO: 40901 - DNA, 1389 bp, Artificial Sequence; identical to SEQ ID NO: 40900
  Description of Artificial Sequence: Synthetic coding sequence

SEQ ID NO: 40902 - DNA, 3000 bp, Artificial Sequence
  Description of Artificial Sequence: Synthetic coding sequence
atggtgtgcagccctgtgacagtgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaaggagaagaagaggacagtggaggaggaggaccagatcttcctggatggccaggagaacaagagaagaagacatgacagcagcggcagcggccacagcgcctttgagcccctggtggccaacggggtgcctgccagctttgtgcccaagccaggcagcctgaagaggggcctgaacagccagagcagtgatgaccacctgaacaagaggagccgcagcagctccatgagcagcctgactggagcctatgccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgaccgggagagccagggcgagaaggctgctgacaccacccccaggaagaagcagaacagcaacagccagagcaccccaggcagcagcggccagaggaagaggaaggtgcagctgctgcccagcagaagaggagagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccatcacccagcccagcttcaccttcaccctgcctgctgctgccccagccagcccccccaccagcctgctggcccccagcaccaaccccctgctggagagcctgaagaagatgcagaccccacccagcctgcccccctgcccagagagcgctggggccgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccccacccatgttcaagcccatcttcaccgccccacccaagtctgagaaggagggccccaccccacctggccccagcgtgacagccacagcccccagcagcagcagcctgcccaccaccaccagcaccacagcccccaccttccagcccgtcttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagattctgccagcaagccagcctttggatttggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcacacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgcctttggagctgctgagggccagcccccaggagctgccaagccagccctggcccccagctttggcagcagcttcaccttcggcaacagcgctgccccagctgctgcccccaccccagccccacccagcatgatcaaggtggtgcctgcctacgtgcccacccccatccaccccatctttggaggagccacccacagcgccttcggcctgaaggccacagccagcgccttcggggccccagccagcagccagcctgccttcggcggcagcacagctgtgttcttcggggccgccaccagcagcggctttggagccaccacccagacagccagcagcggcagcagcagctctgtgtttggcagcaccacccccagccccttcaccttcggcggcagcgctgccccagctggcagcggcagctttggcatcaacgtggccaccccaggcagcagcaccaccactggagccttctcctttggagctggccagagcggcagcacagccaccagcaccccatttgctgggggcctgggccagaatgccctgggcaccaccggccagagcaccccatttgccttcaacgtgagcagcaccacagagagcaagcctgtgtttggaggaacagccacccccaccttcggcctgaacaccccagcccctggggtgggcaccagcggcagcagcctgagctttggagccagcagcgccccagcccagggctttgtgggcgtggcccccttcggcaacacctttgcccaccagcaggagcacagccccaggaagggccccaacaacctgagcaagaggaagctgctgcctgctgtgcgggcccagggcctgccccggcggggccaggccagcagcttccccaccaggaaggagtag

SEQ ID NO: 40903 - DNA, 1386 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaacaagaagaggaaggcccggggcaccatggtgcgctggctgcgggcctatgaatctgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctatgctgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctcatcggctag

SEQ ID NO: 40904 - DNA, 1368 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaagggcaccatggtgcgctggctgcgggcctatgaatctgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctatgctgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctcatcggctag

SEQ ID NO: 40905 - DNA, 1146 bp, Artificial Sequence
  Description of Artificial Sequence: Synthetic coding sequence
atgagcagacatgagggcgtgtcctgtgatgcctgcctgaagggcaacttccggggccgccgctacaagtgcctgatctgctatgactatgacctgtgtgccagctgctatgaaagtggggccaccaccaccaggcacaccacagaccaccccatgcagtgcatcctgaccagggtggactttgacctgtactatggaggagaggccttctctgtggagcagccccagagcttcacctgcccctactgcggcaagatgggctacacagagaccagcctgcaggagcacgtgaccagcgagcacgccgagaccagcacagaggtgatctgccccatctgtgccgccctgcctggaggagaccccaaccacgtgacagatgactttgctgcccacctgaccctggagcaccgggccccccgggacctggatgagagcagcggcgtgcgccacgtgcggaggatgttccaccctggccggggcctgggcggcccccgggcccggcgcagcaacatgcacttcaccagcagcagcactggaggcctgagcagcagccagagcagctacagccccagcaaccgggaggccatggaccccatcgccgagctgctgagccagctgtctggagtgcggcgctctgctgggggccagctgaacagcagcggccccagcgccagccagctgcagcagctgcagatgcagctgcagctggagcggcagcacgcccaggccgcccggcagcagctggagacagccagaaatgccaccaggaggaccaacaccagctctgtgaccaccaccatcacccagagcacagccaccaccaacatcgccaacacagagagcagccagcagaccctgcagaacagccagttcctgctgacccggctgaatgaccccaagatgtctgaaacagagcggcagagcatggagagcgagagagctgacaggagcctgtttgtgcaggagctgctgctgagcaccctggtgcgggaggagagcagcagcagtgatgaagatgacagaggagagatggctgactttggagccatgggctgtgtggacatcatgcccctggatgtggccctggagaacctgaacctgaaggagagcaacaagggaaatgagcccccacctccacccctgtag

SEQ ID NO: 40906 - DNA, 705 bp, Artificial Sequence
  Description of Artificial Sequence: Synthetic coding sequence
atgccccacaggaaggagcggcccagcggcagcagcctgcacacccacggcagcactggaacagctgagggcggcaacatgagccggctgagcctgaccaggagccctgtgagccccctggccgcccagggcatccccctgcctgcccagctgaccaagagcaatgcccctgtgcacattgatgtgggcggccacatgtacaccagcagcctggccaccctgaccaagtacccagacagccgcatcagccgcctcttcaatggaacagagcccatcgtgctggacagcctgaagcagcactacttcatcgacagagatggagagatcttccgctacgtgctgtccttcctgcggaccagcaagctgctgctgcctgatgacttcaaggacttcagcctgctgtatgaggaggcccgctactaccagctgcagcccatggtgcgggagctggagcgctggcagcaggagcaggagcagaggagaagaagccgggcctgtgactgcctggtggtgcgggtgaccccagacctgggggagagaattgccctgagcggggagaaggccctgattgaggaggtgtttcctgagactggagatgtgatgtgcaacagcgtgaatgccggctggaaccaggaccccacccacgtgatccgcttccccctgaatggctactgccgcctgaacagcgtgcaggatgtgctgtag

SEQ ID NO: 40907 - DNA, 915 bp, Artificial Sequence
  Description of Artificial Sequence: Synthetic coding sequence
atgaccctgcggacctctgtgtgctgcacccggcggcgggccaccatcagcagcagcccctggtgtgcctcctggagcgctggcagccgcagccgcagcagcggggctgctgctggccctgtgacagcctggtggtgtgccagccggcccacctgggccagcggcagccacagcgctgcccggcggcccagcagccgccgcagcagccccaggcctgagaccagctgtgccacccccagcaccccagctggcaccaggacccccaggaccagcagcgccagccgctccatggccacagctggcagcacccgctaccgctcctggagcggctgcagccggggcgtgtctgcctggctgcggcctgtgggcgctgtgtggaccccacccagcagcgcctccatgtgctttgctggccgcagcggcggccgcagccccccacccctgctgtttgagagcagcaggaacccctggacccggccctgcttcagcgcccacctgggccccccccgggacctggagaccgtgctgggcagcagcgcctgtgtgtacctggccgtgggcatgaggccccgggtgcggctggagggccccaagctggcccagagggcccctggcagccaggtgtcctggcagcagaatgtgggctgctggaggcatgcctgcagaagaacagtggatgccacccagcgctacagcggcggcatctctgctgccagcagccccagccccagcgccagccagcccggggccgccagcagcgaggcccctggccctgtgggcgccggcctggaggagcccagcgctgccaccagcgaggagctgttcatccccctgcacgccggccagaccctggccggcctgctggccagcgagcgctggctgatcttccagtacctgaagtggatgcagccctag

SEQ ID NO: 40908 - DNA, 498 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgcccaccaagagggacagccagggcaactgcttcatcgacagagatggcaaggtgttccgctacatcctgaacttcctgcggaccagccacctggacctgcctgaggacttccaggagatgggcctgctgcggcgggaggccgacttctaccaggtgcagcccctgattgaggccctgcaggagaaggaggtggagctgagcaaggccgagaagaatgccatgctgaacatcaccctgaaccagagggtgcagacagtgcacttcaccgtgcgggaggccccccagatctacagcctgagcagcagctccatggaggtgttcaatgccaacatcttcagcaccagctgcctcttcctgaagctgctgggcagcaagctgttctactag

SEQ ID NO: 40909 - DNA, 114 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgtag

SEQ ID NO: 40910 - DNA, 351 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgcccaccaagagggacagccagggcaactgcttcatcgacagagatggcaaggtgttccgctacatcctgaacttcctgcggaccagccacctggacctgcctgaggacttccaggagatgggcctgctgcggcgggaggccgacttctaccaggtgcagcccctgattgaggccctgcaggagaaggaggtggagctgagcaaggccgagaagaatgccatgctgaacatcaccctgtag

SEQ ID NO: 40911 - DNA, 216 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgcccaccaagagggacagccagggcaactgcttcatcgacagagatggcaaggtgttccgctacatcctgaacttcctgcggaccagccacctggacctgccctag

SEQ ID NO: 40912 - DNA, 3450 bp, Artificial Sequence
  Description of Artificial Sequence: Synthetic coding sequence
atgttccagaccaagctgagaaatgagacctgggaggacctgcccaagatgagctgcaccacagagatccaggccgccttcatcctgagcagctttgtgaccttcttcagcggcctcatcatcctgctgatcttccgcctcatctggaggtctgtgaagaagtggcagatcatcaagggcaccggcatcatcctggagctgttcaccagcggcaccatcgcccggagccacgtgcgcagcctgcacttccagggccagttccgggaccacatcgagatgctgctgagcgcccagacctttgtgggccaggtgctggtgatcctggtgtttgtgctgagcatcggcagcctcatcatctacttcatcaacagcgctgaccctgtgggcagctgcagcagctatgaggacaagaccatccccatcgacctggtgttcaatgccttcttctccttctacttcggcctgcgcttcatggccgcagatgacaagatcaagttctggctggagatgaacagcatcgtggacatcttcaccatcccccccaccttcatctcctactacctgaagagcaactggctgggcctgcgcttcctgcgggccctgcggctgctggagctgccccagatcctgcagatcctgcgggccatcaagaccagcaacagcgtgaagttcagcaagctgctgagcatcatcctgagcacctggttcaccgctgctggcttcatccacctggtggagaacagcggggacccctggctgaagggcaggaacagccagaacatctcctactttgagagcatctacctggtgatggccaccaccagcacagtgggctttggagatgtggtggccaagaccagcctgggccgcaccttcatcatgttcttcaccctgggcagcctcatcctgtttgccaactacatccctgagatggtggagctgtttgccaacaagaggaagtacaccagcagctatgaggccctgaagggcaagaagttcatcgtggtgtgtggcaacatcaccgtggacagcgtgacagccttcctgaggaacttcctgcgggacaagtctggagagatcaacacagagatcgtgttcctgggggagaccccacccagcctggagctggagaccatcttcaagtgctacctggcctacaccaccttcatcagcggcagcgccatgaagtgggaggacctgcggcgggtggccgtggagagcgctgaggcctgcctgatcatcgccaaccccctgtgcagcgacagccatgctgaggacatcagcaacatcatgagggtgctgagcatcaagaactatgacagcaccacccgcatcatcatccagatcctgcagagccacaacaaggtgtacctgcccaagatccccagctggaactgggacaccggggacaacatcatctgctttgctgagctgaagctgggcttcatcgcccagggctgcctggtgcccggcctgtgcaccttcctgaccagcctgtttgtggagcagaacaagaaggtgatgcccaagcagacctggaagaagcacttcctgaacagcatgaagaacaagatcctgacccagaggctgagtgatgactttgctggcatgtccttccctgaggtggcccggctgtgcttcctgaagatgcacctgctgctgattgccatcgagtacaagagcctcttcacagatggcttctgtggcctcatcctgaaccccccaccccaggtgcgcatcaggaagaacaccctgggcttcttcatcgccgagacccccaaggatgtgagaagagccctcttctactgcagcgtgtgccatgatgatgtgttcatccctgagctgatcaccaactgtggctgcaagagccgcagccggcagcacatcaccgtgcccagcgtgaagaggatgaagaagtgcctgaagggcatcagcagccgcatcagcggccaggacagccccccccgggtgtctgccagcaccagcagcatcagcaacttcaccaccaggaccctgcagcatgatgtggagcaggacagcgaccagctggacagcagcggcatgttccactggtgcaagcccaccagcctggacaaggtgaccctgaagaggacaggcaagagcaagtacaagttcaggaaccacatcgtggcctgtgtgtttggagatgcccacagcgcccccatgggcctgaggaactttgtgatgcccctgcgggccagcaactacaccaggaaggagctgaaggacatcgtgttcatcggcagcctggactacctgcagcgggagtggaggttcctgtggaacttcccccagatctacatcctgcccggctgtgccctgtacagcggggacctgcacgccgccaacatcgagcagtgcagcatgtgtgctgtgctgagccccccaccccagcccagcagcaaccagaccctggtggacacagaggccatcatggccaccctgaccatcggcagcctgcagattgacagcagcagtgaccccagccccagcgtgtctgaggagaccccaggctacaccaacggccacaatgagaagagcaactgcaggaaggtgcccatcctgacagagctgaagaaccccagcaacatccacttcatcgagcagctgggcggcctggagggcagcctgcaggagaccaacctgcacctgagcacagccttcagcactggaacagtgttcagcggcagcttcctggacagcctgctggccacagccttctacaactaccacgtgctggagctgctgcagatgctggtgactggaggagtgagcagccagctggagcagcacctggacaaggacaaggtgtatggagtggccgacagctgcaccagcctgctgagcggcaggaaccgctgcaagctgggcctgctgagcctgcacgagaccatcctgagtgatgtgaaccccaggaacaccttcggccagctgttctgtggcagcctggacctgtttggcatcctgtgtgtgggcctgtaccgcatcattgatgaggaggagctgaaccctgagaacaagcgcttcgtcatcaccaggcctgccaatgagttcaagctgctgcccagcgacctggtgttctgtgccatccccttcagcacagcctgctacaagagaaatgaggagttcagcctgcagaagagctatgagatcgtgaacaaggccagccagaccacagagacccacagcgacaccaactgcccccccaccatcgacagcgtgacagagaccctgtacagccctgtgtacagctaccagcccaggaccaacagcctgtccttccccaagcagatcgcctggaaccagagcaggaccaacagcatcatcagcagccagatccccctgggggacaatgccaaggaaaatgaaaggaagaccagtgatgaggtgtatgatgaggacccctttgcctacagcgagcccctgtag

SEQ ID NO: 40913 - DNA, 1302 bp, Artificial Sequence
  Description of Artificial Sequence: Synthetic coding sequence
atgacagctgccagccgggccaacccctacagcatcgtgtccctggaggaggatggcctgcacctggtgaccatgtctggggccaatggatttggaaatggcaaggtgcacacccggcggcgctgcaggaacagatttgtgaagaagaatggccagtgcaacatcgcctttgccaacatggatgagaagagccagcgctacctggccgacatgttcaccacctgtgtggacatccgctggagatacatgctgctgatcttcagcctggccttcctggcctcctggctgctgtttggagtcatcttctgggtgattgctgtggcccatggagacctggagcctgctgagggccacggccgcaccccctgtgtgatgcaggtgcacggcttcatggccgccttcctgttcagcattgagacccagaccaccatcggctacggcctgcgctgtgtgacagaggagtgcctggtggccgtgttcatggtggtggcccagagcatcgtgggctgcatcatcgacagcttcatgattggagccatcatggccaagatggcccggcccaagaagagggcccagaccctgctcttcagccacaatgctgtggtggccctgagagatggcaagctgtgcctgatgtggagggtgggcaacctgaggaagagccacatcgtggaggcccacgtgcgggcccagctgatcaagccccgggtgacagaggagggggagtacatccccctggaccagattgatattgatgtgggctttgataaaggcctggaccgcatcttcctggtgagccccatcaccatcctgcacgagattgatgaggccagccccctgtttggcatcagccggcaggacctggagacagatgactttgaaattgtggtgatcctggagggcatggtggaggccacagccatgaccacccaggcccggagcagctacctggccaatgagatcctgtggggccacagatttgagcctgtgctgtttgaggagaagaaccagtacaagattgactacagccacttccacaagacctatgaggtgcccagcaccccccgctgcagcgccaaggacctggtggagaacaagttcctgctgcccagcgccaacagcttctgctatgaaaatgagctggccttcctgagcagagatgaagaagatgaagcagatggagaccaggacggccgcagcagagatggcctgagcccccaggcccggcatgactttgaccggctgcaggccggcggcggcgtgctggagcagaggccctaccgccggggcagcgagatctag

SEQ ID NO: 40914 - DNA, 1875 bp, Artificial Sequence
  Description of Artificial Sequence: Synthetic coding sequence
atgcagaagagcagcacctgcagcttcatgtatggagagctgacagacaagaagaccatcgagaaggtgcggcagacctttgacaactatgagagcaactgctttgaggtgctgctgtacaagaagaacagaacacctgtgtggttctacatgcagatcgcccccatcagaaatgagcacgagaaggtggtgctcttcctgtgcaccttcaaggacatcaccctcttcaagcagcccattgaagatgacagcaccaagggctggaccaagtttgcccggctgacccgggccctgaccaacagccgctctgtgctgcagcagctgacccccatgaacaagacagaggtggtgcacaagcacagccggctggccgaggtgctgcagctgggcagtgacatcctgccccagtacaagcaggaggcccccaagaccccaccccacatcatcctgcactactgtgccttcaagaccacctgggactgggtgatcctgatcctgaccttctacacagccatcatggtgccctacaacgtgtccttcaagaccaagcagaacaacatcgcctggctggtgctggacagcgtggtggatgtgatcttcctggtggacatcgtgctgaacttccacaccacctttgtgggccctggaggagaggtgatcagtgaccccaagctgatccgcatgaactacctgaagacctggtttgtgattgacctgctgagctgcctgccctatgacatcatcaatgcctttgaaaatgtggatgagggcatcagcagcctcttcagcagcctgaaggtggtgcggctgctgcggctgggccgggtggccaggaagctggaccactacctggagtatggagctgctgtgctggtgctgctggtgtgtgtgtttggcctggtggcccactggctggcctgcatctggtacagcatcggggactatgaggtgattgatgaggtgaccaacaccatccagattgacagctggctgtaccagctggccctgagcatcggcaccccctaccgctacaacaccagcgctggcatctgggagggcggccccagcaaggacagcctgtatgtgagcagcctgtacttcaccatgaccagcctgaccaccatcggctttggaaacatcgcccccaccacagatgtggagaagatgttttctgtggccatgatgatggtgggcagcctgctgtatgccaccatctttggaaatgtgaccaccatcttccagcagatgtatgccaacaccaaccgctaccacgagatgctgaacaacgtgcgggacttcctgaagctgtaccaggtgcccaagggcctgtctgagcgggtgatggactacatcgtgtccacctggagcatgagcaaaggaattgacacagagaaggtgctgagcatctgccccaaggacatgagagctgacatctgtgtgcacctgaacaggaaggtgttcaatgagcacccagccttccggctggccagtgatggctgcctgcgggccctggccgtggagttccagaccatccactgtgcccctggggacctgatctaccacgccggggagagcgtggatgccctgtgctttgtggtgtctggcagcctggaggtgatccaggatgatgaggtggtggccatcctgggcaaaggagatgtgtttggagacatcttctggaaggagaccaccctggcccacgcctgtgccaacgtgcgggccctgacctactgtgacctgcacatcatcaagcgggaggccctgctgaaggtgctggacttctacacagcctttgccaacagcttcagcaggaacctgaccctgacctgcaacctgaggaagaggggctggttctccatggccaatgccctgtag

SEQ ID NO: 40915 - DNA, 1836 bp, Artificial Sequence
  Description of Artificial Sequence: Synthetic coding sequence
atgcctgggggcaagaggggcctggtggccccccagaacaccttcctggagaacatcgtgagaagaagcagcgagagcagcttcctgctgggcaatgcccagatcgtggactggcctgtggtgtacagcaatgatggcttctgcaagctgagcggctaccacagagcagatgtgatgcagaagagcagcacctgcagcttcatgtatggagagctgacagacaagaagaccatcgagaaggtgcggcagacctttgacaactatgagagcaactgctttgaggtgctgctgtacaagaagaacagaacacctgtgtggttctacatgcagatcgcccccatcagaaatgagcacgagaaggtggtgctcttcctgtgcaccttcaaggacatcaccctcttcaagcagcccattgaagatgacagcaccaagggctggaccaagtttgcccggctgacccgggccctgaccaacagccgctctgtgctgcagcagctgacccccatgaacaagacagaggtggtgcacaagcacagccggctggccgaggtgctgcagctgggcagtgacatcctgccccagtacaagcaggaggcccccaagaccccaccccacatcatcctgcactactgtgccttcaagaccacctgggactgggtgatcctgatcctgaccttctacacagccatcatggtgccctacaacgtgtccttcaagaccaagcagaacaacatcgcctggctggtgctggacagcgtggtggatgtgatcttcctggtggacatcgtgctgaacttccacaccacctttgtgggccctggaggagaggtgatcagtgaccccaagctgatccgcatgaactacctgaagacctggtttgtgattgacctgctgagctgcctgccctatgacatcatcaatgcctttgaaaatgtggatgagggcatcagcagcctcttcagcagcctgaaggtggtgcggctgctgcggctgggccgggtggccaggaagctggaccactacctggagtatggagctgctgtgctggtgctgctggtgtgtgtgtttggcctggtggcccactggctggcctgcatctggtacagcatcggggactatgaggtgattgatgaggtgaccaacaccatccagattgacagctggctgtaccagctggccctgagcatcggcaccccctaccgctacaacaccagcgctggcatctgggagggcggccccagcaaggacagcctgtatgtgagcagcctgtacttcaccatgaccagcctgaccaccatcggctttggaaacatcgcccccaccacagatgtggagaagatgttttctgtggccatgatgatggtgggcagcctgctgtatgccaccatctttggaaatgtgaccaccatcttccagcagatgtatgccaacaccaaccgctaccacgagatgctgaacaacgtgcgggacttcctgaagctgtaccaggtgcccaagggcctgtctgagcgggtgatggactacatcgtgtccacctggagcatgagcaaaggaattgacacagagaaggtgctgagcatctgccccaaggacatgagagctgacatctgtgtgcacctgaacaggaaggtgttcaatgagcacccagccttccggctggccagtgatggctgcctgcgggccctggccgtggagttccagaccatccactgtgcccctggggacctgatctaccacgccggggagagcgtggatgccctgtgctttgtggtgtctggcagcctggaggtgatccaggatgatgaggtggtggccatcctggaccacctgtcctag

SEQ ID NO: 40916 - DNA, 1755 bp, Artificial Sequence
  Description of Artificial Sequence: Synthetic coding sequence
atggtggccgaggtgtgcagcatgcccacagccagcacagtgaagaagccctttgacctgcggagcaagatgggcaagtggtgccaccaccgcttcccctgctgccggggcagcggcaagagcaacatgggcaccagcggggaccatgatgacagcttcatgaagatgctgcggagcaagatgggcaagtgctgccgccactgcttcccctgctgccggggcagcggcaccagcaatgtgggcaccagcggggaccatgaaaattccttcatgaagatgctgcggagcaagatgggcaagtggtgctgccactgcttcccctgctgccggggcagcagcaagagcaatgtgggcgcctggggagactatgaccacagcgccttcatggagccccgctaccacgtgcggcgggaggacctggacaagctgcaccgggccgcctggtggggcaaggtgcccaggaaggacctgattgtgatgctgcgggacacagacatgaacaagagggacaaggagaagaggacagccctgcacctggccagcgccaatggaaacagcgaggtggtgcagctgctgctggaccggcgctgccagctgaatgtgctggacaacaagaagaggacagccctgatcaaggccatccagtgccaggaggatgaatgtgtgctgatgctgctggagcacggggctgacaggaacatcccagatgaatatggcaacacagccctgcactacgccatctacaatgaagacaagctgatggccaaggccctgctgctgtatggagctgacatcgagagcaagaacaagtgtggcctgacccccctgctgctgggcgtgcatgagcagaagcagcaggtggtgaagttcctgatcaagaagaaggccaacctgaatgtgctggacagatatggccgcacagccctgatcctggccgtgtgctgcggcagcgccagcatcgtgaacctgctgctggagcagaatgtggatgtgagcagccaggacctgagcggccagacagcccgggagtatgctgtgagcagccaccaccacgtgatctgtgagctgctgagtgactacaaggagaagcagatgctgaagatcagcagcgagaacagcaaccctgagcaggacctgaagctgaccagcgaggaggagagccagaggctgaaggtgtctgagaacagccagcctgagaagatgagccaggagcctgagatcaacaaggactgtgaccgggaggtggaggaggagatcaagaagcacggcagcaaccctgtgggcctgcctgagaacctgaccaatggagccagcgctggaaatggagatgatggcctcatcccccagaggaggagcaggaagccagagaaccagcagttcccagacacagaaaatgaggagtaccacagtgatgagcagaatgacaccaggaagcagctgtctgaggagcagaacacaggcatcagccaggatgagatcctgaccaacaagcagaagcagatcgaggtggccgagcagaagatgaacagcgagctgagcctgagccacaagaaggaggaggacctgctgagagaaaattctgtgctgcaggaggagattgctgtgctgcggctggagctggatgagaccaagcaccagaaccagctgcgggagaacaagatcctggaggagattgagagcgtgaaggagaagacagacaagctgctgcgggccatgcagctgaatgaggaggccctgaccaagaccaacatctag

SEQ ID NO: 40917 - DNA, 3228 bp, Artificial Sequence
  Description of Artificial Sequence: Synthetic coding sequence
atggtggtggaggtggacagcatgcctgctgccagctctgtgaagaagcccttcggcctgcggagcaagatgggcaagtggtgctgccgctgcttcccctgctaccgggagagcggcaagagcaatgtgggcaccagcggggaccatgatgacagcgccatgaagaccctgcggagcaagatgggcaagtggtgccaccactgcttcccctgctgccggggcagcggcaagagcaatgtgggcgccagcggggaccatgatgattctgccatgaagaccctgaggaacaagatgggcaagtggtgctgccactgcttcccctgctgccggggcagcggcaagagcaaggtgggcgcctggggagactatgatgacagcgccttcatggagccccgctaccacgtgcggggggaggacctggacaagctgcaccgggccgcctggtggggcaaggtgcccaggaaggacctgattgtgatgctgcgggacacagatgtgaacaagaaggacaagcagaagaggacagccctgcacctggccagcgccaatggaaacagcgaggtggtgaagctgctgctggaccggcgctgccagctgaatgtgctggacaacaagaagaggacagccctgatcaaggctgtgcagtgccaggaggatgaatgtgccctgatgctgctggagcacggcacagaccccaacatcccagatgaatatggcaacaccaccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccaccacgtgatctgccagctgctgagtgactacaaggagaagcagatgctgaagatcagcagcgagaacagcaaccctgagcaggagctgaagctgaccagcgaggaggagagccagcgcttcaagggcagcgagaacagccagcctgagaagatgagccaggagctggagatcaacaaggatggagaccgggaggtggaggaggagatgaagaagcatgagagcaacaacgtgggcctgctggagaacctgaccaatggagtgacagctggaaatggagacaatggcctcatcccccagaggaagagcaggaccccagagaaccagcagttcccagacaatgaaagtgaggagtaccaccgcatctgtgagctgctgagtgactacaaggagaagcagatgcccaagtacagcagcgagaacagcaaccctgagcaggacctgaagctgaccagcgaggaggagagccagaggctgaagggctctgaaaatggccagcctgagaagaggagccaggagcctgagatcaacaaggatggagaccgggagctggagaacttcatggccatcgaggagatgaagaagcacggcagcacccacgtgggcttccctgagaacctgaccaacggggccacagctggaaatggagatgatggcctcatcccccccaggaagagcaggaccccagagagccagcagttcccagacacagaaaatgaggagtaccacagtgatgagcagaatgacacccagaagcagttctgtgaggagcagaacacaggcatcctgcatgatgagatcctgattcatgaggagaagcagatcgaggtggtggagaagatgaacagcgagctgagcctgagctgcaagaaggagaaggatgtgctgcacgagaacagcaccctgcgggaggagatcgccatgctgcggctggagctggacaccatgaagcaccagagccagctgcgggagaagaagtacctggaggacatcgagagcgtgaagaagaagaatgacaacctgctgaaggccctgcagctgaatgagctgaccatggatgatgacacagctgtgctggtgattgacaatggcagcggcatgtgcaaggccggctttgctggagatgatgcccccagggctgtgttccccagcatcgtgggccggccccggcagcagggcatgatgggcggcatgcaccagaaggagagctatgtgggcaaggaggcccagagcaagaggggcatcctgaccctgaagtaccccatggagcacggcatcatcaccaactgggatgacatggagaagatctggcaccacaccttctacaatgagctgcgggtggcccctgaggagcaccccatcctgctgacagaggcccccctgaaccccaaggccaaccgggagaagatgacccagatcatgtttgagaccttcaacaccccagccatgtatgtggccatccaggccgtgcccagcctgtacaccagcggccgcaccactggaattgtgatggattctggagatggagtgacccacacagtgcccatctatgagggcaatgccctgccccacgccaccctgcggctggacctggccggccgggagctgcctgactacctgatgaagatcctgacagagcggggctaccgcttcaccaccatggccgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagccctgcttcctgggcatggagagctgtggcatccacgagaccaccttcaacagcatcatgaagagtgatgtggacatcaggaaggacctgtacaccaacacagtgctgagcggcggcaccaccatgtacccaggcatggcccacaggatgcagaaggagattgctgccctggcccccagcatgatgaagatccgcatcatcgccccacccaagaggaagtacagcgtgtgggtgggcggcagcatcctggccagcctgagcaccttccagcagatgtggatcagcaagcaggagtatgatgaaagtggccccagcatcgtgcacaggaagtgcttctag

SEQ ID NO: 40918 - DNA, 1185 bp, Artificial Sequence
  Description of Artificial Sequence: Synthetic coding sequence
atggtggtggaggtggacagcatgcctgctgccagctctgtgaagaagcccttcggcctgcggagcaagatgggcaagtggtgctgccgctgcttcccctgctaccgggagagcggcaagagcaatgtgggcaccagcggggaccatgatgacagcgccatgaagaccctgcggagcaagatgggcaagtggtgccaccactgcttcccctgctgccggggcagcggcaagagcaatgtgggcgccagcggggaccatgatgattctgccatgaagaccctgaggaacaagatgggcaagtggtgctgccactgcttcccctgctgccggggcagcggcaagagcaaggtgggcgcctggggagactatgatgacagcgccttcatggagccccgctaccacgtgcggggggaggacctggacaagctgcaccgggccgcctggtggggcaaggtgcccaggaaggacctgattgtgatgctgcgggacacagatgtgaacaagaaggacaagcagaagaggacagccctgcacctggccagcgccaatggaaacagcgaggtggtgaagctgctgctggaccggcgctgccagctgaatgtgctggacaacaagaagaggacagccctgatcaaggtgtgcagcagccagctgtaccagcatgaagctgtgcagtgccaggaggatgaatgtgccctgatgctgctggagcacggcacagaccccaacatcccagatgaatatggcaacaccaccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccaccacgtgatctgccagctgctgagtgactacaaggagaagcagatgctgaagatcagcagcgagaacagcaacccagaaaatgtgtccaggaccaggaacaagtag

SEQ ID NO: 40919 - DNA, 1527 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgcttcccctggtgccggggcagcggcaagagcaatgtgggcaccagcggggaccatgatgacagcgccatgaagaccctgcggagcaagatgggcaagtggtgccgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagagcaaggtgggcccctggggagactatgatgacagcgccttcatggagccccgctaccacgtgcggcgggaggacctggacaagctgcaccgggccgcctggtggggcaaggtgcccaggaaggacctgattgtgatgctgaaggacacagacatgaacaagaaggacaagcagaagaggacagccctgcacctggccagcgccaatggaaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagtgctgatcctggccgtgtgctgcggcagcgccagcatcgtgtccctgctgctggagcagaacattgatgtgagcagccaggacctgagcggccagacagcccgggagtatgctgtgagcagccgccacaacgtcatctgccagctgctgagtgactacaaggagaagcagatcctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgcccaatggagccacagctgacaatggagatgatggcctcatcccccccaggaagagcaggaccccagagagccagcagttcccagacacagaaaatgagcagtaccacagtgatgagcagaatgacacccagaagcagctgtctgaggagcagaacacaggcatcctgcaggatgagatcctgatccacgaggagaagcagatcgaggtggctgaaaatgagttctag

SEQ ID NO: 40920 - DNA, 1629 bp, Artificial Sequence
  Description of Artificial Sequence: Synthetic coding sequence
atggtgacagaggtgtgcagcatgcctgctgccagcgctgtgaagaagccctttgacctgcggagcaagatgggcaagtggttccaccaccgcttcccctgctgcaagggcagcggcaagagcaacatgggcaccagcggggaccatgatgacagcttcatgaagatgctgcggagcaagatgggcaagtgctgccaccactgcttcccctgctgccggggcagcggcaccagcaatgtgggcaccagcggggaccatgacaacagcttcatgaagaccctgcggagcaagatgggcaagtggtgctgccactgcttcccctgctgccggggcagcggcaagagcaatgtgggcgcctggggagactatgatgacagcgccttcatggagccccgctaccacgtgcggcgggaggacctggacaagctgcaccgggccgcctggtggggcaaggtgcccaggaaggacctgattgtgatgctgcgggacacagacatgaacaagagggacaagcagaagaggacagccctgcacctggccagcgccaatggaaacagcgaggtggtgcagctgctgctggaccggcgctgccagctgaatgtgctggacaacaagaagaggacagccctgatcaaggctgtgcagtgccaggaggatgaatgtgtgctgatgctgctggagcacggggctgaccagaacatcccagatgaatatggcaacaccaccctgcactatgctgtgcacaatgaagacaagctgatggccaaggccctgctgctgtatggagctgacatcgagagcaagaacaagtgtggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgaacctgctgctggagcagaatgtggatgtgagcagccaggacctgagcggccagacagcccgggagtatgctgtgagcagccaccaccacgtgatctgtgagctgctgagtgactacaaggagaagcagatgctgaagatcagcagcgagaacagcaaccctgagcaggacctgaagctgaccagcgaggaggagagccagaggctgaaggtgtctgagaacagccagcctgagaagatgagccaggagcctgagatcaacaaggactgtgaccgggaggtggaggaggagatcaagaagcacggcagcaaccctgtgggcctgcctgagaacctgaccaatggagccagcgctggaaatggagatgatggcctcatcccccagaggaggagcaggaagccagagaaccagcagttcccagacacagaaaatgaggagtaccacagtgatgagcagaatgacaccaggaagcagctgtctgaggagcagaacacaggcatcagccaggatgagatcctgaccaacaagcagaagcagatcgaggtggccgagaagaagatgaacagcgagctgagcctgagccacaagaaggaggaggacctgctgagagaaaattccatgctgcaggaggagatcgccatgctgatcagcggggactggaactag

SEQ ID NO: 40921 - DNA, 1146 bp, Artificial Sequence
  Description of Artificial Sequence: Synthetic coding sequence
atggtgacagaggtgtgcagcatgcctgctgccagcgctgtgaagaagccctttgacctgcggagcaagatgggcaagtggttccaccaccgcttcccctgctgcaagggcagcggcaagagcaacatgggcaccagcggggaccatgatgacagcttcatgaagatgctgcggagcaagatgggcaagtgctgccaccactgcttcccctgctgccggggcagcggcaccagcaatgtgggcaccagcggggaccatgacaacagcttcatgaagaccctgcggagcaagatgggcaagtggtgctgccactgcttcccctgctgccggggcagcggcaagagcaatgtgggcgcctggggagactatgatgacagcgccttcatggagccccgctaccacgtgcggcgggaggacctggacaagctgcaccgggccgcctggtggggcaaggtgcccaggaaggacctgattgtgatgctgcgggacacagacatgaacaagagggacaagcagaagaggacagccctgcacctggccagcgccaatggaaacagcgaggtggtgcagctgctgctggaccggcgctgccagctgaatgtgctggacaacaagaagaggacagccctgatcaaggctgtgcagtgccaggaggatgaatgtgtgctgatgctgctggagcacggggctgaccagaacatcccagatgaatatggcaacaccaccctgcactatgctgtgcacaatgaagacaagctgatggccaaggccctgctgctgtatggagctgacatcgagagcaagaacaagtgtggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgaacctgctgctggagcagaatgtggatgtgagcagccaggacctgagcggccagacagcccgggagtatgctgtgagcagccaccaccacgtgatctgtgagctgctgagtgactacaaggagaagcagatgctgaagatcagcagcgagaacagcaaccctgggaaggaggccgaggagtag

SEQ ID NO: 40922 - DNA, 1527 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgcttcccctggtgccggggcagcggcaagagcaatgtgggcaccagcggggaccatgatgacagcgccatgaagaccctgcggagcaagatgggcaagtggtgccgccactgcttcccctggtgccggggcagcagcaagagcaatgtgggcaccagcggggaccatgatgattctgccatgaagaccctgcggagcaagatgggcaagtggtgctgccactgcttcccctgctgccggggcagcggcaagagcaaggtgggcccctggggagactatgatgacagcgccttcatggagccccgctaccacgtgcggcgggaggacctggacaagctgcaccgggccgcctggtggggcaaggtgcccaggaaggacctgattgtgatgctgaaggacacagacatgaacaagaaggacaagcagaagaggacagccctgcacctggccagcgccaatggaaacagcgaggtggtgaagctgctgctggaccggcgctgccagctgaacatcctggacaacaagaagaggacagccctgaccaaggctgtgcagtgccgggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccacaacgtcatctgccagctgctgagtgactacaaggagaagcagatgctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgcccaatggagccacagctgacaatggagatgatggcctcatcccccccaggaagagcaggaccccagagagccagcagttcccagacacagaaaatgagcagtaccacagtgatgagcagaatgacacccagaagcagctgtctgaggagcagaacacaggcatcctgcaggatgagatcctgatccacgaggagaagcagatcgaggtggctgaaaatgagttctag

SEQ ID NO: 40923 - DNA, 1461 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgcttcccctggtgccggggcagcggcaagagcaatgtgggcaccagcggggaccatgatgacagcgccatgaagaccctgcggagcaagatgggcaagtggtgccgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagagcaaggtgggcccctggggagactatgatgacagcgccttcatggagccccgctaccacgtgcggcgggaggacctggacaagctgcaccgggccgcctggtggggcaaggtgcccaggaaggacctgattgtgatgctgaaggacacagacatgaacaagaaggacaagcagaagaggacagccctgcacctggccagcgccaatggaaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagtgctgatcctggccgtgtgctgcggcagcgccagcatcgtgtccctgctgctggagcagaacattgatgtgagcagccaggacctgagcggccagacagcccgggagtatgctgtgagcagccgccacaacgtcatctgccagctgctgagtgactacaaggagaagcagatcctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgcccaatggagccacagctgacaatggagatgatggcctcatcccccccaggaagagcaggaccccagagagccagcagttcccagacacagaaaatgagcagtaccaccgggacttcagcggccaccccaacttccccaccaccctgcccatcaagcagtag

SEQ ID NO: 40924 - DNA, 1782 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgcttcccctggtgccggggcagcggcaagagcaatgtgggcaccagcggggaccatgatgacagcgccatgaagaccctgcggagcaagatgggcaagtggtgccgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagagcaaggtgggcccctggggagactatgatgacagcgccttcatggagccccgctaccacgtgcggcgggaggacctggacaagctgcaccgggccgcctggtggggcaaggtgcccaggaaggacctgattgtgatgctgaaggacacagacatgaacaagaaggacaagcagaagaggacagccctgcacctggccagcgccaatggaaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagattgagagccacagcgtgtcccaggccggcgtgcagtggtgtgaccacagcagcctgcagcccaggcctcctgaggcccagatggtgctgcagccccagccccagttcttcttcctgtccttcttcctgttcctgttcctgttcctgttcttcttcagcagagatgaggtgtttgccatgttcctgcggctggtgctgaacagctgggcccaggccatccaccccccccagccccccaaggtgctgggcctgcagcacggcctgacccccctgctgctgggcgtgcatgagcagaagcagcaggtggtgaagttcctgatcaagaagaaggccaacctgaatgccctggacagatatggccgcacagtgctgatcctggccgtgtgctgcggcagcgccagcatcgtgtccctgctgctggagcagaacattgatgtgagcagccaggacctgagcggccagacagcccgggagtatgctgtgagcagccgccacaacgtcatctgccagctgctgagtgactacaaggagaagcagatcctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgcccaacggggccacagctgacaatggagatgatggcctcatcccccccaggaagagcaggaccccagagagccagcagttcccagacacagaaaatgagcagtaccacagtgatgagcagaatgacacccagaagcagctgtctgaggagcagaacacaggcatcctgcaggatgagatcctgattcatgaggagaagcagatcgaggtggccgagaatgagttctag

SEQ ID NO: 40925 - DNA, 1080 bp, Artificial Sequence
  Description of Artificial Sequence: Synthetic coding sequence
atggccggccacctggccagtgactttgccttcagccccccacctgggggcggcggagatggcccctggggcgctgagcccggctgggtggaccccctgacctggctgtccttccagggccccccaggcggccctggcatcggccctggggtgggccctggcagcgaggtgtggggcatccccccctgccccccaccctatgagctgtgtggcggcatggcctactgcggcccccaggtgggcgtgggcctggtgccccagggcggcctggagaccagccagcctgagagcgaggccggcgtgggcgtggagagcaacagcaatggagccagccctgagccctgcaccgtgcccccaggagctgtgaagctggagaaggagaagctggagcagaaccctgagaagagccaggacatcaaggccctgcagaaggagctggagcagtttgccaagctgctgaagcagaagaggatcaccctgggctacacccaggctgatgtgggcctcatcctgggcgtgctgtttgggaaggtgttcagccagaagaccatctgccgctttgaggccctgcagctgtccttcaagaacatgtgcaagctgcggcccctgctgcagaagtgggtggaggaggccgacaacaatgaaaacctgcaggagatctgcaaggccgagaccctgatgcaggccaggaagaggaagaggaccagcattgagaacagagtgcggggcaacctggagaacctcttcctgcagtgccccaagcccaccctgcagatcagccacatcgcccagcagctgggcctggagaaggatgtggtgcgggtgtggttctgcaacagacggcagaagggcaagaggagcagcagtgactatgcccagagagaagattttgaagctgctggcagccccttcagcggcggccctgtgtccttccccccagcccctggcccccacttcggcaccccaggctacggcagcccccacttcaccgccctgtacagctctgtgcccttccctgagggggaggtgtttcctcctgtgtctgtcatcaccctgggcagccccatgcacagcaactag

SEQ ID NO: 40926 - DNA, 1080 bp, Artificial Sequence; identical to SEQ ID NO: 40925
  Description of Artificial Sequence: Synthetic coding sequence

SEQ ID NO: 40927 - DNA, 987 bp, Artificial Sequence
  Description of Artificial Sequence: Synthetic coding sequence
atggccggccaccggcccagcaaccacttctgccccctgcccggcagcggcggcggcggcccccggggccccatgcccctgcgggtggacaccctgacctggctgagcacccaggccgcccctggccgggtgatggtgtggccagctgtgcggcccggcatctgccccggcccagatgtgtggaggatccccctgggccccctgccccatgagttccggggctggatcgccccctgccggccccggctgggcgccagcgaggccggggactggctgcggcggcccagcgagggcgccctgcccggcccctacatcgccctgcggagcatccccaagctgcccccacctgaggacatcagcggcatcctgaaggagctgcagcagctggccaaggagctgcggcagaagaggctgagcctgggctacagccaggctgatgtgggcattgctgtgggcgccctgtttgggaaggtgctgagccagaccaccatctgccgctttgaggcccagcagctgtctgtggccaacatgtggaagctgcggcccctgctgaagaagtggctgaaggaggtggaggccgagaacctgctgggcctgtgcaagatggagatgatcctgcagcagagcggcaagtggaggcgggccagccgggagaggagaattggcaacagcctggagaagttcttccagcgctgccccaagcccaccccccagcagatcagccacatcgccggctgcctgcagctgcagaaggatgtggtgcgggtgtggttctacaacagaagcaagatgggcagccggcccaccaatgatgccagcccccgggagatcgtgggcacagctggccccccctgccctggggcccctgtgtgcttccacctgggcctgggcctgcctgtggacatcccccactacacccggctgtacagcgctggggtggcccacagcagcgccccagccaccaccctgggcctgctgcgcttctag

SEQ ID NO: 40928 - DNA, 2385 bp, Artificial Sequence
  Description of Artificial Sequence: Synthetic coding sequence
atgggccagagcggccgcagccgccaccagaagagggcccgggcccaggcccagctgaggaacctggaggcctatgctgccaacccccacagctttgtgttcacccggggctgcacaggaagaaacatccggcagctgagcctggatgtgagaagagtgatggagcccctgacagccagccggctgcaggtgaggaagaagaacagcctgaaggactgtgtggccgtggccggccccctgggcgtgacccacttcctgatcctgagcaagacagagaccaacgtgtacttcaagctgatgaggctgcccggcggccccaccctgaccttccaggtgaagaagtacagcctggtgagagatgtggtgagcagcctgcggcggcacaggatgcatgagcagcagtttgcccacccccccctgctggtgctgaacagctttggcccccacggcatgcacgtgaagctgatggccaccatgttccagaacctcttccccagcatcaacgtgcacaaggtgaacctgaacaccatcaagcgctgcctgctgattgactacaacccagacagccaggagctggacttccgccactacagcatcaaggtggtgcctgtgggcgccagccggggcatgaagaagctgctgcaggagaagttccccaacatgagccggctgcaggacatcagcgagctgctggccactggagctggcctgtctgagagcgaggccgagccagatggagaccacaacatcacagagctgccccaggccgtggccggccggggcaacatgagggcccagcagagcgctgtgcggctgacagaaattggccccaggatgaccctgcagctgatcaaggtgcaggagggcgtgggggagggcaaggtgatgttccacagctttgtgtccaagacagaggaggagctgcaggccatcctggaggccaaggagaagaagctgcggctgaaggcccagaggcaggcccagcaggcccagaatgtgcagaggaagcaggagcagcgggaggcccacaggaagaagagcctggagggcatgaagaaggcccgggtgggcggcagtgatgaggaggccagcggcatccccagcaggacagccagcctggagctgggagaagatgatgatgagcaggaggatgatgacatcgagtacttctgccaggccgtgggggaggcccccagcgaggacctcttccctgaggccaagcagaagaggctggccaagagccctggcaggaagaggaagcgctgggagatggacagaggagccaagagctgcccagccaacttcctggccgctgctgatgacaagctgagcggcttccagggcgacttcctgtggcccatcctggtggtggagttcctggtggccgtggccagcaatggcctggccctgtaccgcttcagcatcaggaagcagaggccctggcaccctgctgtggtgttttctgtgcagctggccgtgtctgacctgctgtgtgccctgaccctgccccccctggccgcctacctgtacccacccaagcactggaggtatggagaggccgcctgccgcctggagcgcttcctgttcacctgcaacctgctgggcagcgtcatcttcatcacctgcatcagcctgaaccgctacctgggcatcgtgcaccccttctttgcccggagccacctgcggcccaagcacgcctgggccgtgtctgctgctggctgggtgctggccgccctgctggccatgcccaccctgtccttcagccacctgaagaggccccagcagggcgccggcaactgcagcgtggcccggcctgaggcctgcatcaagtgcctgggcacagctgaccacggcctggccgcctaccgggcctacagcctggtgctggccggcctgggctgcggcctgcccctgctgctgaccctggccgcctatggagccctgggccgggctgtgctgcggagccctggcatgacagtggccgagaagctgcgggtggccgccctggtggccagcggcgtggccctgtatgccagcagctatgtgccctaccacatcatgagggtgctgaatgtggatgcccggcggcgctggagcacccgctgccccagctttgctgacatcgcccaggccacagctgccctggagctgggcccctacgtgggctaccaggtgatgaggggcctgatgcccctggccttctgtgtgcaccccctgctgtacatggctgctgtgcccagcctgggctgctgctgccgccactgccccggctacagagacagctggaacccagaagatgccaagagcacaggccaggccctgcccctgaatgccacagctgcccccaagcccagcgagccccagagccgggagctgagccagtag

SEQ ID NO: 40929 - DNA, 1563 bp, Artificial Sequence
  Description of Artificial Sequence: Synthetic coding sequence
atgggccagagcggccgcagccgccaccagaagagggcccgggcccaggcccagctgaggaacctggaggcctatgctgccaacccccacagctttgtgttcacccggggctgcacaggaagaaacatccggcagctgagcctggatgtgagaagagtgatggagcccctgacagccagccggctgcaggtgaggaagaagaacagcctgaaggactgtgtggccgtggccggccccctgggcgtgacccacttcctgatcctgagcaagacagagaccaacgtgtacttcaagctgatgaggctgcccggcggccccaccctgaccttccaggtgaagaagtacagcctggtgagagatgtggtgagcagcctgcggcggcacaggatgcatgagcagcagtttgcccacccccccctgctggtgctgaacagctttggcccccacggcatgcacgtgaagctgatggccaccatgttccagaacctcttccccagcatcaacgtgcacaaggtgaacctgaacaccatcaagcgctgcctgctgattgactacaacccagacagccaggagctggacttccgccactacagcatcaaggtggtgcctgtgggcgccagccggggcatgaagaagctgctgcaggagaagttccccaacatgagccggctgcaggacatcagcgagctgctggccactggagctggcctgtctgagagcgaggccgagccagatggagaccacaacatcacagagctgccccaggccgtggccggccggggcaacatgagggcccagcagagcgctgtgcggctgacagaaattggccccaggatgaccctgcagctgatcaaggtgcaggagggcgtgggggagggcaaggtgatgttccacagctttgtgtccaagacagaggaggagctgcaggccatcctggaggccaaggagaagaagctgcggctgaaggcccagaggcaggcccagcaggcccagaatgtgcagaggaagcaggagcagcgggaggcccacaggaagaagagcctggagggcatgaagaaggcccgggtgggcggcagtgatgaggaggccagcggcatccccagcaggacagccagcctggagctgggagaagatgatgatgagcaggaggatgatgacatcgagtacttctgccaggccgtgggggaggcccccagcgaggacctcttccctgaggccaagcagaagaggctggccaagagccctggcaggaagaggaagcgctgggagatggaccggggccggggccgcctgtgtgaccagaagttccccaagaccaaggacaagagccagggcgcccaggtgcccagccctgccctgcccacctcctggcagctgcccaccaccaacagcgtgggcagccggggcaccagctgtggcccctactggtggctgagctcctggtggccctggccagccatggcctggccctgcacagccagcgccagcggcagcagcgcccacggcaccccaccctggagcagcctgagctcctggcagagcgccacctgcagcgccccctag

SEQ ID NO: 40930 - DNA, 378 bp, Artificial Sequence
  Description of Artificial Sequence: Synthetic coding sequence
tgaagcctgcagtgtgtgaagctgggccgggccacagcccgctggtggtgggtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacattgaatccatgaccatcgagggggagtacagcggccccaagctggaggatgacaaggtgaccatcaccttcatgaagggcctgatgcagtggtacaaggaccagaagaagctgcaccagaagtgtgcctaccaggacttccggcagaagagcggcatcatcaccagccaggactgtgtgcagaccacctag

SEQ ID NO: 40931 - DNA, 486 bp, Artificial Sequence
  Description of Artificial Sequence: Synthetic coding sequence
atgggcgccaaccagctggtggtgctgaatgtgtatgacatgtactggatgaatgagtacaccagcagcatcggcatcggggtcttccacagcggcatcgaggtgtatggccgggctgtggtgctgggcagcacagacttcctggaggatgacatcgagaagatcgtggaggagctgggcaaggagtacaagggaaatgcctaccacctgatgcacaagaactgcaaccacttcagcagcgccctgtctgagatcctgtgtgggaaggagatcccccgctggatcaaccggctggcctacttcagcagctgcatccccttcctgcagagctgcctgcccaaggagtggctgaccccagctgccctgcagagctctgtgtcccaggagctgcaggatgagctggaggaggccgaggatgctgctgccagcgcctctgtggccagcacagctgctggcagcaggcctggccgccacaccaagctgtag

SEQ ID NO: 40932 - DNA, 585 bp, Artificial Sequence
  Description of Artificial Sequence: Synthetic coding sequence
atgggcgccaaccagctggtggtgctgaatgtgtatgacatgtactggatgaatgagtacaccagcagcatcggcatcggggtcttccacagcggcatcgaggtgtatggccgggagtttgcctacggcggccacccctaccccttcagcggcatctttgagatcagccctggaaatgccagcgagctgggggagaccttcaagttcaaggaggccgtggtgctgggcagcacagacttcctggaggatgacatcgagaagatcgtggaggagctgggcaaggagtacaagggaaatgcctaccacctgatgcacaagaactgcaaccacttcagcagcgccctgtctgagatcctgtgtgggaaggagatcccccgctggatcaaccggctggcctacttcagcagctgcatccccttcctgcagagctgcctgcccaaggagtggctgaccccagctgccctgcagagctctgtgtcccaggagctgcaggatgagctggaggaggctgaagatgctgctgccagcgcctctgtggccagcacagctgctggcagccggcccggccgccacaccaagctgtag

SEQ ID NO: 40933 - DNA, 306 bp, Artificial Sequence
  Description of Artificial Sequence: Synthetic coding sequence
atgaggctgaccttcctgaagaagatcgcccagctgaactacctggagatcctggtggtgctgctgagctacaccctgaagaccaccttccagtactggatgaatgagtacaccagcagcattggaattggagtcttccacagcggcatcgaggtgtatggccgggagtttgcctatggaggccacccctaccccttcagcggcatctttgagatcagccctggaaatgccagcgagctgggggagaccttcaagttcaaggaggccgtggtgctgggcagcacagacttcctggaggatgactag

SEQ ID NO: 40934 - DNA, 3072 bp, Artificial Sequence
  Description of Artificial Sequence: Synthetic coding sequence
atgtctgcctacagcgtgcccagcacctttgcccaggccagcctgcctgtgcacaaccaggtgctgcccagcattgaatctgtggatggcagtgaccccctggccaccctgcagacccccctgggccgcctggaggccaaggaggaggaggatgaagatgaagatgaggacacagaggaggatgaggaggaggatggagaggacacagacctggatgactgggagccagaccccccccggccctttgacccccatgacctgtggtgtgaggagtgcaacaatgcccacgcctctgtgtgccccaagcacggccccctgcaccccatccccaacagacctgtgctgacccgggcccgggccagcctgcccctggtgctgtacatcgaccgcttcctgggcggcgtcttcagcaagaggcgcatccccaagaggacccagtttggacctgtggagggccccctggtgcggggcagcgagctgaaggactgctacatccacctgaaggtgtccctggacaagggggacaggaaggagcgggacctgcacgaggacctgtggtttgagctgagtgatgagaccctgtgcaactggatgatgtttgtgcggcctgcccagaaccacctggagcagaacctggtggcctaccagtatggccaccacgtgtactacaccaccatcaagaatgtggagcccaagcaggagctgaaggtgtggtacgccgccagctatgcagagtttgtgaaccagaagatccatgacatcagcgaggaggagaggaaggtgctgcgggagcaggagaagaactggccctgctatgagtgcaacagacgcttcatcagcagcgagcagctgcagcagcacctgaacagccatgatgagaagctggatgtgttcagcaggacccggggccggggccggggccggggcaagagaagatttggacctggaagaagacctggccggccccccaagttcatccggctggagatcaccagtgaaaatggagagaagagtgatgatggcacccaggacctgctgcacttccccaccaaggagcagtttgatgaagctgagcccgccaccctgaatggcctggaccagcctgagcagaccaccatccccatcccccagctgccccaggagacccagagcagcctggagcacgagcctgagacccacaccctgcacctgcagccccagcacgaggagagcgtggtgcccacccagagcaccctgacagcagatgacatgaggcgggccaagaggatcagaaatgctgccctgcagcacctgttcatcaggaagagcttccggcccttcaagtgcctgcagtgtgggaaggccttccgggagaaggacaagctggaccagcacctgcgcttccacggccgggagggcaactgccccctgacctgtgacctgtgcaacaagggcttcatcagcagcaccagcctggagagccacatgaagctgcacagcgaccagaagacctacagctgcatcttctgcccagagagctttgaccggctggacctgctgaaggaccacgtggccatccacatcaatgatggctacttcacctgccccacctgcaagaagcgcttcccagacttcatccaggtgaagaagcacgtgcgctccttccacagcgagaagatctaccagtgcacagaatgtgacaaggccttctgcaggccagacaagctgcggctgcacatgctgcggcacagcgacaggaaggacttcctgtgcagcacctgtgggaagcagttcaagaggaaggacaagctgcgggagcacatgcagaggatgcacaaccctgagcgggaggccaagaaggctgaccgcatcagccgcagcaagaccttcaagccccgcatcaccagcacagattatgacagcttcaccttcaagtgccgcctgtgcatgatgggcttcagaagaagaggcatgctggtgaaccacctgagcaagaggcacccagacatgaagattgaggaggtgcctgagctgaccctgcccatcatcaagcccaacagagactacttctgccagtactgtgacaaggtgtacaagagcgccagcaagaggaaggcccacatcctgaagaaccaccctggagctgagctgcccccatccatcaggaagctgcggcctgctggccctggagagccagaccccatgctgagcacccacacccagctgaccggcaccatcgccaccccacctgtgtgctgcccccactgcagcaagcagtacagcagcaagaccaagatggtgcagcacatcaggaagaagcaccctgagtttgcccagctgagcaacaccatccacacccccctgaccacagctgtgatcagcgccaccccagctgtgctgaccacagattctgccactggagagaccgtggtgaccacagacctgctgacccaggccatgacagagctgagccagaccctgaccacagactaccgcaccccccagggcgactaccagaggatccagtacatccctgtgtcccagagcgccagcggcctgcagcagccccagcacatccagctgcaggtggtgcaggtggcctctgtgtctggccagcccctgagccccagcgcccagcaggcccagcagggcctgagccccagccacatccagggcagcagcagcacccagggccaggccctgcagcagcagcagcagcagcagcagaacagctctgtgcagcacacctacctgcccagcgcctggaacagcttccggggctacagcagcgagatccagatgatgaccctgcccccaggccagtttgtgatcacagacagcggcgtggccacccctgtgaccaccggccaggtgaaggctgtgaccagcggccactacgtgctgtctgagagccagagcgagctggaggagaagcagaccagcgccctgtctggaggagtgcaggtggagcccccagcccacagcgacagcctggacccccagaccaacagccagcagcagaccacccagtacatcatcaccaccaccaccaatggaaatggcagcagcgaggtgcacatcaccaagccctag

SEQ ID NO: 40935 - DNA, 3483 bp, Artificial Sequence
  Description of Artificial Sequence: Synthetic coding sequence
atggacagcaaggatgagagcagccacgtgtggcccaccagcgctgagcacgagcagaatgctgcccaggtgcactttgtgcctgacaccggcaccgtggcccagatcgtgtacacagatgaccaggtgcggcccccccagcaggtggtgtacacagcagatggagccagctacacctctgtggatggccctgagcacaccctggtgtacatccaccctgtggaggccgcccagaccctcttcacagaccccggccaggtggcctacgtgcagcaggatgccacagcccagcaggccagcctgcctgtgcacaaccaggtgctgcccagcattgaatctgtggatggcagtgaccccctggccaccctgcagacccccctgggccgcctggaggccaaggaggaggaggatgaagatgaagatgaggacacagaggaggatgaggaggaggatggagaggacacagacctggatgactgggagccagaccccccccggccctttgacccccatgacctgtggtgtgaggagtgcaacaatgcccacgcctctgtgtgccccaagcacggccccctgcaccccatccccaacagacctgtgctgacccgggcccgggccagcctgcccctggtgctgtacatcgaccgcttcctgggcggcgtcttcagcaagaggcgcatccccaagaggacccagtttggacctgtggagggccccctggtgcggggcagcgagctgaaggactgctacatccacctgaaggtgtccctggacaagggggacaggaaggagcgggacctgcacgaggacctgtggtttgagctgagtgatgagaccctgtgcaactggatgatgtttgtgcggcctgcccagaaccacctggagcagaacctggtggcctaccagtatggccaccacgtgtactacaccaccatcaagaatgtggagcccaagcaggagctgaaggtgtggtacgccgccagctatgcagagtttgtgaaccagaagatccatgacatcagcgaggaggagaggaaggtgctgcgggagcaggagaagaactggccctgctatgagtgcaacagacgcttcatcagcagcgagcagctgcagcagcacctgaacagccatgatgagaagctggatgtgttcagcaggacccggggccggggccggggccggggcaagagaagatttggacctggaagaagacctggccggccccccaagttcatccggctggagatcaccagtgaaaatggagagaagagtgatgatggcacccaggacctgctgcacttccccaccaaggagcagtttgatgaagctgagcccgccaccctgaatggcctggaccagcctgagcagaccaccatccccatcccccagctgccccaggagacccagagcagcctggagcacgagcctgagacccacaccctgcacctgcagccccagcacgaggagagcgtggtgcccacccagagcaccctgacagcagatgacatgaggcgggccaagaggatccggctggagctgcagaatgctgccctgcagcacctgttcatcaggaagagcttccggcccttcaagtgcctgcagtgtgggaaggccttccgggagaaggacaagctggaccagcacctgcgcttccacggccgggagggcaactgccccctgacctgtgacctgtgcaacaagggcttcatcagcagcaccagcctggagagccacatgaagctgcacagcgaccagaagacctacagctgcatcttctgcccagagagctttgaccggctggacctgctgaaggaccacgtggccatccacatcaatgatggctacttcacctgccccacctgcaagaagcgcttcccagacttcatccaggtgaagaagcacgtgcgctccttccacagcgagaagatctaccagtgcacagaatgtgacaaggccttctgcaggccagacaagctgcggctgcacatgctgcggcacagcgacaggaaggacttcctgtgcagcacctgtgggaagcagttcaagaggaaggacaagctgcgggagcacatgcagaggatgcacaaccctgagcgggaggccaagaaggctgaccgcatcagccgcagcaagaccttcaagccccgcatcaccagcacagattatgacagcttcaccttcaagtgccgcctgtgcatgatgggcttcagaagaagaggcatgctggtgaaccacctgagcaagaggcacccagacatgaagattgaggaggtgcctgagctgaccctgcccatcatcaagcccaacagagactacttctgccagtactgtgacaaggtgtacaagagcgccagcaagaggaaggcccacatcctgaagaaccaccctggagctgagctgcccccatccatcaggaagctgcggcctgctggccctggagagccagaccccatgctgagcacccacacccagctgaccggcaccatcgccaccccacctgtgtgctgcccccactgcagcaagcagtacagcagcaagaccaagatggtgcagcacatcaggaagaagcaccctgagtttgcccagctgagcaacaccatccacacccccctgaccacagctgtgatcagcgccaccccagctgtgctgaccacagattctgccactggagagaccgtggtgaccacagacctgctgacccaggccatgacagagctgagccagaccctgaccacagactaccgcaccccccagggcgactaccagaggatccagtacatccctgtgtcccagagcgccagcggcctgcagcagccccagcacatccagctgcaggtggtgcaggtggccagcgccaccagcccccaccagagccagcagagcacagtggatgtgggccagctgcatgacccccagccctacccccagcacgccatccaggtgcagcacatccaggtgtctgagcccacagccagcgcccccagcagcgcccaggtgtctggccagcccctgagccccagcgcccagcaggcccagcagggcctgagccccagccacatccagggcagcagcagcacccagggccaggccctgcagcagcagcagcagcagcagcagaacagctctgtgcagcacacctacctgcccagcgcctggaacagcttccggggctacagcagcgagatccagatgatgaccctgcccccaggccagtttgtgatcacagattctggagtggccacccctgtgaccaccggccaggtgaaggctgtgaccagcggccactacgtgctgtctgagagccagagcgagctggaggagaagcagaccagcgccctgagcggcggcgtgcaggtggagcccccagcccacagcgacagcctggacccccagaccaacagccagcagcagaccacccagtacatcatcaccaccaccaccaatggaaatggcagcagcgaggtgcacatcaccaagccctag

SEQ ID NO: 40936 - DNA, 3471 bp, Artificial Sequence
  Description of Artificial Sequence: Synthetic coding sequence
atggacagcaaggatgagagcagccacgtgtggcccaccagcgctgagcacgagcagaatgctgcccaggtgcactttgtgcctgacaccggcaccgtggcccagatcgtgtacacagatgaccaggtgcggcccccccagcaggtggtgtacacagcagatggagccagctacacctctgtggatggccctgagcacaccctggtgtacatccaccctgtggaggccgcccagaccctcttcacagaccccggccaggtggcctacgtgcagcaggatgccacagcccagcaggccagcctgcctgtgcacaaccaggtgctgcccagcattgaatctgtggatggcagtgaccccctggccaccctgcagacccccctgggccgcctggaggccaaggaggaggaggatgaagatgaagatgaggacacagaggaggatgaggaggaggatggagaggacacagacctggatgactgggagccagaccccccccggccctttgacccccatgacctgtggtgtgaggagtgcaacaatgcccacgcctctgtgtgccccaagcacggccccctgcaccccatccccaacagacctgtgctgacccgggcccgggccagcctgcccctggtgctgtacatcgaccgcttcctgggcggcgtcttcagcaagaggcgcatccccaagaggacccagtttggacctgtggagggccccctggtgcggggcagcgagctgaaggactgctacatccacctgaaggtgtccctggacaagggggacaggaaggagcgggacctgcacgaggacctgtggtttgagctgagtgatgagaccctgtgcaactggatgatgtttgtgcggcctgcccagaaccacctggagcagaacctggtggcctaccagtatggccaccacgtgtactacaccaccatcaagaatgtggagcccaagcaggagctgaaggtgtggtacgccgccagctatgcagagtttgtgaaccagaagatccatgacatcagcgaggaggagaggaaggtgctgcgggagcaggagaagaactggccctgctatgagtgcaacagacgcttcatcagcagcgagcagctgcagcagcacctgaacagccatgatgagaagctggatgtgttcagcaggacccggggccggggccggggccggggcaagagaagatttggacctggaagaagacctggccggccccccaagttcatccggctggagatcaccagtgaaaatggagagaagagtgatgatggcacccaggacctgctgcacttccccaccaaggagcagtttgatgaagctgagcccgccaccctgaatggcctggaccagcctgagcagaccaccatccccatcccccagctgccccaggagacccagagcagcctggagcacgagcctgagacccacaccctgcacctgcagccccagcacgaggagagcgtggtgcccacccagagcaccctgacagcagatgacatgaggcgggccaagaggatcagaaatgctgccctgcagcacctgttcatcaggaagagcttccggcccttcaagtgcctgcagtgtgggaaggccttccgggagaaggacaagctggaccagcacctgcgcttccacggccgggagggcaactgccccctgacctgtgacctgtgcaacaagggcttcatcagcagcaccagcctggagagccacatgaagctgcacagcgaccagaagacctacagctgcatcttctgcccagagagctttgaccggctggacctgctgaaggaccacgtggccatccacatcaatgatggctacttcacctgccccacctgcaagaagcgcttcccagacttcatccaggtgaagaagcacgtgcgctccttccacagcgagaagatctaccagtgcacagaatgtgacaaggccttctgcaggccagacaagctgcggctgcacatgctgcggcacagcgacaggaaggacttcctgtgcagcacctgtgggaagcagttcaagaggaaggacaagctgcgggagcacatgcagaggatgcacaaccctgagcgggaggccaagaaggctgaccgcatcagccgcagcaagaccttcaagccccgcatcaccagcacagattatgacagcttcaccttcaagtgccgcctgtgcatgatgggcttcagaagaagaggcatgctggtgaaccacctgagcaagaggcacccagacatgaagattgaggaggtgcctgagctgaccctgcccatcatcaagcccaacagagactacttctgccagtactgtgacaaggtgtacaagagcgccagcaagaggaaggcccacatcctgaagaaccaccctggagctgagctgcccccatccatcaggaagctgcggcctgctggccctggagagccagaccccatgctgagcacccacacccagctgaccggcaccatcgccaccccacctgtgtgctgcccccactgcagcaagcagtacagcagcaagaccaagatggtgcagcacatcaggaagaagcaccctgagtttgcccagctgagcaacaccatccacacccccctgaccacagctgtgatcagcgccaccccagctgtgctgaccacagattctgccactggagagaccgtggtgaccacagacctgctgacccaggccatgacagagctgagccagaccctgaccacagactaccgcaccccccagggcgactaccagaggatccagtacatccctgtgtcccagagcgccagcggcctgcagcagccccagcacatccagctgcaggtggtgcaggtggccagcgccaccagcccccaccagagccagcagagcacagtggatgtgggccagctgcatgacccccagccctacccccagcacgccatccaggtgcagcacatccaggtgtctgagcccacagccagcgcccccagcagcgcccaggtgtctggccagcccctgagccccagcgcccagcaggcccagcagggcctgagccccagccacatccagggcagcagcagcacccagggccaggccctgcagcagcagcagcagcagcagcagaacagctctgtgcagcacacctacctgcccagcgcctggaacagcttccggggctacagcagcgagatccagatgatgaccctgcccccaggccagtttgtgatcacagattctggagtggccacccctgtgaccaccggccaggtgaaggctgtgaccagcggccactacgtgctgtctgagagccagagcgagctggaggagaagcagaccagcgccctgagcggcggcgtgcaggtggagcccccagcccacagcgacagcctggacccccagaccaacagccagcagcagaccacccagtacatcatcaccaccaccaccaatggaaatggcagcagcgaggtgcacatcaccaagccctag

SEQ ID NO: 40937 - DNA, 3186 bp, Artificial Sequence
  Description of Artificial Sequence: Synthetic coding sequence
atgtctgcctacagcgtgcccagcacctttgcccaggccagcctgcctgtgcacaaccaggtgctgcccagcattgaatctgtggatggcagtgaccccctggccaccctgcagacccccctgggccgcctggaggccaaggaggaggaggatgaagatgaagatgaggacacagaggaggatgaggaggaggatggagaggacacagacctggatgactgggagccagaccccccccggccctttgacccccatgacctgtggtgtgaggagtgcaacaatgcccacgcctctgtgtgccccaagcacggccccctgcaccccatccccaacagacctgtgctgacccgggcccgggccagcctgcccctggtgctgtacatcgaccgcttcctgggcggcgtcttcagcaagaggcgcatccccaagaggacccagtttggacctgtggagggccccctggtgcggggcagcgagctgaaggactgctacatccacctgaaggtgtccctggacaagggggacaggaaggagcgggacctgcacgaggacctgtggtttgagctgagtgatgagaccctgtgcaactggatgatgtttgtgcggcctgcccagaaccacctggagcagaacctggtggcctaccagtatggccaccacgtgtactacaccaccatcaagaatgtggagcccaagcaggagctgaaggtgtggtacgccgccagctatgcagagtttgtgaaccagaagatccatgacatcagcgaggaggagaggaaggtgctgcgggagcaggagaagaactggccctgctatgagtgcaacagacgcttcatcagcagcgagcagctgcagcagcacctgaacagccatgatgagaagctggatgtgttcagcaggacccggggccggggccggggccggggcaagagaagatttggacctggaagaagacctggccggccccccaagttcatccggctggagatcaccagtgaaaatggagagaagagtgatgatggcacccaggacctgctgcacttccccaccaaggagcagtttgatgaagctgagcccgccaccctgaatggcctggaccagcctgagcagaccaccatccccatcccccagctgccccaggagacccagagcagcctggagcacgagcctgagacccacaccctgcacctgcagccccagcacgaggagagcgtggtgcccacccagagcaccctgacagcagatgacatgaggcgggccaagaggatccggctggagctgcagaatgctgccctgcagcacctgttcatcaggaagagcttccggcccttcaagtgcctgcagtgtgggaaggccttccgggagaaggacaagctggaccagcacctgcgcttccacggccgggagggcaactgccccctgacctgtgacctgtgcaacaagggcttcatcagcagcaccagcctggagagccacatgaagctgcacagcgaccagaagacctacagctgcatcttctgcccagagagctttgaccggctggacctgctgaaggaccacgtggccatccacatcaatgatggctacttcacctgccccacctgcaagaagcgcttcccagacttcatccaggtgaagaagcacgtgcgctccttccacagcgagaagatctaccagtgcacagaatgtgacaaggccttctgcaggccagacaagctgcggctgcacatgctgcggcacagcgacaggaaggacttcctgtgcagcacctgtgggaagcagttcaagaggaaggacaagctgcgggagcacatgcagaggatgcacaaccctgagcgggaggccaagaaggctgaccgcatcagccgcagcaagaccttcaagccccgcatcaccagcacagattatgacagcttcaccttcaagtgccgcctgtgcatgatgggcttcagaagaagaggcatgctggtgaaccacctgagcaagaggcacccagacatgaagattgaggaggtgcctgagctgaccctgcccatcatcaagcccaacagagactacttctgccagtactgtgacaaggtgtacaagagcgccagcaagaggaaggcccacatcctgaagaaccaccctggagctgagctgcccccatccatcaggaagctgcggcctgctggccctggagagccagaccccatgctgagcacccacacccagctgaccggcaccatcgccaccccacctgtgtgctgcccccactgcagcaagcagtacagcagcaagaccaagatggtgcagcacatcaggaagaagcaccctgagtttgcccagctgagcaacaccatccacacccccctgaccacagctgtgatcagcgccaccccagctgtgctgaccacagattctgccactggagagaccgtggtgaccacagacctgctgacccaggccatgacagagctgagccagaccctgaccacagactaccgcaccccccagggcgactaccagaggatccagtacatccctgtgtcccagagcgccagcggcctgcagcagccccagcacatccagctgcaggtggtgcaggtggccagcgccaccagcccccaccagagccagcagagcacagtggatgtgggccagctgcatgacccccagccctacccccagcacgccatccaggtgcagcacatccaggtgtctggccagcccctgagccccagcgcccagcaggcccagcagggcctgagccccagccacatccagggcagcagcagcacccagggccaggccctgcagcagcagcagcagcagcagcagaacagctctgtgcagcacacctacctgcccagcgcctggaacagcttccggggctacagcagcgagatccagatgatgaccctgcccccaggccagtttgtgatcacagacagcggcgtggccacccctgtgaccaccggccaggtgaaggctgtgaccagcggccactacgtgctgtctgagagccagagcgagctggaggagaagcagaccagcgccctgtctggaggagtgcaggtggagcccccagcccacagcgacagcctggacccccagaccaacagccagcagcagaccacccagtacatcatcaccaccaccaccaatggaaatggcagcagcgaggtgcacatcaccaagccctag

SEQ ID NO: 40938 - DNA, 3225 bp, Artificial Sequence
  Description of Artificial Sequence: Synthetic coding sequence
atgtctgcctacagcgtgcccagcacctttgcccaggccagcctgcctgtgcacaaccaggtgctgcccagcattgaatctgtggatggcagtgaccccctggccaccctgcagacccccctgggccgcctggaggccaaggaggaggaggatgaagatgaagatgaggacacagaggaggatgaggaggaggatggagaggacacagacctggatgactgggagccagaccccccccggccctttgacccccatgacctgtggtgtgaggagtgcaacaatgcccacgcctctgtgtgccccaagcacggccccctgcaccccatccccaacagacctgtgctgacccgggcccgggccagcctgcccctggtgctgtacatcgaccgcttcctgggcggcgtcttcagcaagaggcgcatccccaagaggacccagtttggacctgtggagggccccctggtgcggggcagcgagctgaaggactgctacatccacctgaaggtgtccctggacaagggggacaggaaggagcgggacctgcacgaggacctgtggtttgagctgagtgatgagaccctgtgcaactggatgatgtttgtgcggcctgcccagaaccacctggagcagaacctggtggcctaccagtatggccaccacgtgtactacaccaccatcaagaatgtggagcccaagcaggagctgaaggtgtggtacgccgccagctatgcagagtttgtgaaccagaagatccatgacatcagcgaggaggagaggaaggtgctgcgggagcaggagaagaactggccctgctatgagtgcaacagacgcttcatcagcagcgagcagctgcagcagcacctgaacagccatgatgagaagctggatgtgttcagcaggacccggggccggggccggggccggggcaagagaagatttggacctggaagaagacctggccggccccccaagttcatccggctggagatcaccagtgaaaatggagagaagagtgatgatggcacccaggacctgctgcacttccccaccaaggagcagtttgatgaagctgagcccgccaccctgaatggcctggaccagcctgagcagaccaccatccccatcccccagctgccccaggagacccagagcagcctggagcacgagcctgagacccacaccctgcacctgcagccccagcacgaggagagcgtggtgcccacccagagcaccctgacagcagatgacatgaggcgggccaagaggatccggctggagctgcagaatgctgccctgcagcacctgttcatcaggaagagcttccggcccttcaagtgcctgcagtgtgggaaggccttccgggagaaggacaagctggaccagcacctgcgcttccacggccgggagggcaactgccccctgacctgtgacctgtgcaacaagggcttcatcagcagcaccagcctggagagccacatgaagctgcacagcgaccagaagacctacagctgcatcttctgcccagagagctttgaccggctggacctgctgaaggaccacgtggccatccacatcaatgatggctacttcacctgccccacctgcaagaagcgcttcccagacttcatccaggtgaagaagcacgtgcgctccttccacagcgagaagatctaccagtgcacagaatgtgacaaggccttctgcaggccagacaagctgcggctgcacatgctgcggcacagcgacaggaaggacttcctgtgcagcacctgtgggaagcagttcaagaggaaggacaagctgcgggagcacatgcagaggatgcacaaccctgagcgggaggccaagaaggctgaccgcatcagccgcagcaagaccttcaagccccgcatcaccagcacagattatgacagcttcaccttcaagtgccgcctgtgcatgatgggcttcagaagaagaggcatgctggtgaaccacctgagcaagaggcacccagacatgaagattgaggaggtgcctgagctgaccctgcccatcatcaagcccaacagagactacttctgccagtactgtgacaaggtgtacaagagcgccagcaagaggaaggcccacatcctgaagaaccaccctggagctgagctgcccccatccatcaggaagctgcggcctgctggccctggagagccagaccccatgctgagcacccacacccagctgaccggcaccatcgccaccccacctgtgtgctgcccccactgcagcaagcagtacagcagcaagaccaagatggtgcagcacatcaggaagaagcaccctgagtttgcccagctgagcaacaccatccacacccccctgaccacagctgtgatcagcgccaccccagctgtgctgaccacagattctgccactggagagaccgtggtgaccacagacctgctgacccaggccatgacagagctgagccagaccctgaccacagactaccgcaccccccagggcgactaccagaggatccagtacatccctgtgtcccagagcgccagcggcctgcagcagccccagcacatccagctgcaggtggtgcaggtggccagcgccaccagcccccaccagagccagcagagcacagtggatgtgggccagctgcatgacccccagccctacccccagcacgccatccaggtgcagcacatccaggtgtctgagcccacagccagcgcccccagcagcgcccaggtgtctggccagcccctgagccccagcgcccagcaggcccagcagggcctgagccccagccacatccagggcagcagcagcacccagggccaggccctgcagcagcagcagcagcagcagcagaacagctctgtgcagcacacctacctgcccagcgcctggaacagcttccggggctacagcagcgagatccagatgatgaccctgcccccaggccagtttgtgatcacagattctggagtggccacccctgtgaccaccggccaggtgaaggctgtgaccagcggccactacgtgctgtctgagagccagagcgagctggaggagaagcagaccagcgccctgagcggcggcgtgcaggtggagcccccagcccacagcgacagcctggacccccagaccaacagccagcagcagaccacccagtacatcatcaccaccaccaccaatggaaatggcagcagcgaggtgcacatcaccaagccctag

SEQ ID NO: 40939 - DNA, 1536 bp, Artificial Sequence
  Description of Artificial Sequence: Synthetic coding sequence
atgctgaagatggccgagcccatcgccagcctgatgattgtggagtgccgggcctgcctgcgctgcagccccctcttcctgtaccagcgggagaaggacaggatgacagagaacatgaaggaatgtctggcccagaccaatgctgctgtgggggacatggtgacagtggtgaagacagaggtgtgcagccccctgcgggaccaggagtatggccagccctgcagccggcggccagacagcagcgccatggaggtggagcccaagaagctgaagggcaagagggacctgattgtgcccaagagcttccagcaggtggacttctggttctgtgagagctgccaggagtactttgtggatgagtgccccaaccacggcccccctgtgtttgtgtctgacacccctgtgcctgtgggcatcccagacagagctgccctgaccatcccccagggcatggaggtggtgaaggacaccagcggggagagtgatgtgcgctgtgtgaatgaagtcatccccaagggccacatcttcggcccctatgagggccagatcagcacccaggacaagtctgctggcttcttctcctggctgattgtggacaagaacaaccgctacaagagcattgatggcagtgatgagaccaaggccaactggatgagatatgtggtgatcagccgggaggagcgggagcagaacctgctggccttccagcacagcgagcgcatctacttccgggcctgccgggacatccggcctggagagtggctgcgggtgtggtacagcgaggactacatgaagaggctgcacagcatgagccaggagaccatccacaggaacctggcccggggggagaagaggctgcagcgggagaagtctgagcaggtgctggacaaccctgaggacctgcggggccccatccacctgtctgtgctgcggcagggcaagagcccctacaagaggggctttgatgaaggagatgtgcacccccaggccaagaagaagaagattgacctgatcttcaaggatgtgctggaggccagcctggagagcgccaaggtggaggcccaccagctggccctgagcaccagcctggtgatcaggaaggtgcccaagtaccaggatgatgcctacagccagtgtgccaccaccatgacccatggagtgcagaacatcggccagacccagggcgagggggactggaaggtgccccagggcgtgtccaaggagcccggccagctggaggatgaggaggaggagcccagcagcttcaaggctgacagccctgctgaggccagcctggccagtgacccccatgagctgcccaccaccagcttctgccccaactgcatccggctgaagaagaaggtgcgggagctgcaggccgagctggacatgctgaagagcggcaagctgcctgagccccctgtgctgcccccccaggtgctggagctgcctgagttcagtgaccctgctgggaagctggtgtggatgaggctgctgtctgagggccgggtgcgcagcggcctgtgtggcggctag

SEQ ID NO: 40940 - DNA, 1536 bp, Artificial Sequence; identical to SEQ ID NO: 40939
  Description of Artificial Sequence: Synthetic coding sequence

SEQ ID NO: 40941 - DNA, 1434 bp, Artificial Sequence
  Description of Artificial Sequence: Synthetic coding sequence
atgacagagaacatgaaggaatgtctggcccagaccaatgctgctgtgggggacatggtgacagtggtgaagacagaggtgtgcagccccctgcgggaccaggagtatggccagccctgcagccggcggccagacagcagcgccatggaggtggagcccaagaagctgaagggcaagagggacctgattgtgcccaagagcttccagcaggtggacttctggttctgtgagagctgccaggagtactttgtggatgagtgccccaaccacggcccccctgtgtttgtgtctgacacccctgtgcctgtgggcatcccagacagagctgccctgaccatcccccagggcatggaggtggtgaaggacaccagcggggagagtgatgtgcgctgtgtgaatgaagtcatccccaagggccacatcttcggcccctatgagggccagatcagcacccaggacaagtctgctggcttcttctcctggctgattgtggacaagaacaaccgctacaagagcattgatggcagtgatgagaccaaggccaactggatgagatatgtggtgatcagccgggaggagcgggagcagaacctgctggccttccagcacagcgagcgcatctacttccgggcctgccgggacatccggcctggagagtggctgcgggtgtggtacagcgaggactacatgaagaggctgcacagcatgagccaggagaccatccacaggaacctggcccggggggagaagaggctgcagcgggagaagtctgagcaggtgctggacaaccctgaggacctgcggggccccatccacctgtctgtgctgcggcagggcaagagcccctacaagaggggctttgatgaaggagatgtgcacccccaggccaagaagaagaagattgacctgatcttcaaggatgtgctggaggccagcctggagagcgccaaggtggaggcccaccagctggccctgagcaccagcctggtgatcaggaaggtgcccaagtaccaggatgatgcctacagccagtgtgccaccaccatgacccatggagtgcagaacatcggccagacccagggcgagggggactggaaggtgccccagggcgtgtccaaggagcccggccagctggaggatgaggaggaggagcccagcagcttcaaggctgacagccctgctgaggccagcctggccagtgacccccatgagctgcccaccaccagcttctgccccaactgcatccggctgaagaagaaggtgcgggagctgcaggccgagctggacatgctgaagagcggcaagctgcctgagccccctgtgctgcccccccaggtgctggagctgcctgagttcagtgaccctgctgggaagctggtgtggatgaggctgctgtctgagggccgggtgcgcagcggcctgtgtggcggctag

SEQ ID NO: 40942 - DNA, 1425 bp, Artificial Sequence
  Description of Artificial Sequence: Synthetic coding sequence
atgagcatccaggccccaccccggctgctggagctggccggccagagcctgctgcgggaccaggccctgagcatcagcgccatggaggagctgccccgggtgctgtacctgcccctcttcatggaggccttcagccgccgccacttccagaccctgactgtgatggtgcaggcctggcccttcacctgcctgcccctgggcagcctgatgaagaccctgcacctggagaccctgaaggccctgctggagggcctgcacatgctgctgacccagaaggaccggccccggcgctggaagctgcaggtgctggacctgagagatgtggatgagaacttctgggcccgctggccaggggcctgggccctgagctgcttccctgagaccaccagcaagaggcagacagctgaggactgccccaggatgggagagcaccagcccctgaaggtgttcatcgacatctgcctgaaggagatcccccaggatgagtgcctgcgctacctgttccagtgggtgtaccagaggcggggcctggtgcacctgtgctgcagcaagctggtgaactacctgacccccatcaagtacctgaggaagagcctgaagatcatctacctgaacagcatccaggagctggagatccggaacatgtcctggcccaggctcatcaggaagctgcgctgctacctgaaggagatgaagaacctgaggaagctggtgttcagccgctgccaccactacaccagtgacaatgagctgcagggccgcctggtggccaagttcagctctgtgttcctgcggctggagcacctgcagctgctgaagatcaagctgatcaccttcttcagcggccacctggagcagctgatccgctgcctgcagaaccccctggagaacctggagctgacctacggctacctgctggaggaggacatgaagtgcctgagccagtaccccagcctgggctacctgaagcacctgaacctgtcctatgtgctgctcttccgcatcagcctggagcccctgggcgccctgctggagaagattgctgccagcctgaagaccctcatcctggagggctgccagatccactacagccagctgagcgccatcctgcctgccctgagccgctgcagccagctgaccaccttctacttcggcaggaactgcatgagcattgatgccctgaaggacctgctgcggcacaccagcggcctgagcaagctgagcctggagacctacccagcccctgaggagagcctgaacagcctggtgcgggtgaactgggagatcttcacccccctgcgggcagagctgatgtgcaccctgcgggaggtgcggcagcccaagaggatcttcatcggccccaccccctgccccagctgtggcagcagccccagcgaggagctggagctgcacctgtgctgctag

SEQ ID NO: 40943 - DNA, 690 bp, Artificial Sequence
  Description of Artificial Sequence: Synthetic coding sequence
atgaagggcggcaaggcccaccagacctgccccttccacaacagaacatctgtgctgaccggcctggtgatcaccaatgaccctgtgtctgacagcctgtttgtgaagggctgctttgagctgcaggagcgctgcctgcagaaccccctggagaacctggagctgacctacggctacctgctggaggaggacatgaagtgcctgagccagtaccccagcctgggctacctgaagcacctgaacctgtcctatgtgctgctcttccgcatcagcctggagcccctgggcgccctgctggagaagattgctgccagcctgaagaccctcatcctggagggctgccagatccactacagccagctgagcgccatcctgcctgccctgagccgctgcagccagctgaccaccttctactttggaagaaactgcatgagcattgatgccctgaaggacctgctgcggcacaccagcggcctgagcaagctgagcctggagacctacccagcccctgaggagagcctgaacagcctggtgcgggtgaactgggagatcttcacccccctgcgggcagagctgatgtgcaccctgcgggaggtgcggcagcccaagaggatcttcatcggccccaccccctgccccagctgtggcagcagccccagcgaggagctggagctgcacctgtgctgctag

SEQ ID NO: 40944 - DNA, 1425 bp, Artificial Sequence
  Description of Artificial Sequence: Synthetic coding sequence
atgagcctgcaggcccccagccggctgctggagctggccggccagagcctgctgaggaaccagttcctgaccatcttcaccctggatgagctgccccgggaggtgttccccctgatgttcatggaggccttctccatgagaagatttgaggccctgaagctgatggtgcaggcctggcccttcctgagcctgcccctgggcagcctgatgaagaccctgcacctggagaccctgcaggccgtgctgcggggcctggacaccctggtggcccagaaggtgcggccccggcgctggaagctgcaggtgctggacctgagagatgtggatgagaacttctggaccatctggagcggggcccgggtgctgagctgcagccctgaggccatgagcaagaggcagacagtggaggactgccccaggatgggagagcaccagcccctgaaggtgttcatcgacctgtgcctgaaggagagcaccctggatgagtgcctgagctacctgtttggctggatccactaccgccggggcctggtgcacctgtgctgcagcaaggtgcagaactacagcatgcccaccagcagcttcaggaacctgctggagcgcatctacccagacagcatccaggagctggaggtgtggaagaagtgcagcctgaacaagacaggcaagtttgccccctacctgagccagatgagcaacctgcgggagctgttcctggccttcggctatgagcgggagctgtatgtgtctgtgcagtggccctgcatcccagacctggacagccccttcctgtgcctgtactacccccagatgctgtacatcaagaagatcagcaacatcaaggagcacctggagcacctgctgcgctacctgaagaaccccctgggcgccttcatcttcagtgatgcctacctgacagaccgggacatggagtgcctgagccagtaccccagcctgagccagctgaaggagctgcggctcatccacatcctgatgtggaccacccacctggagcccctgggcgtgctgctggagaaggtggccgccaccctgaagaccctggtgctgaaggactgccgcatccaggacccccagctgcgggtgctgctgcctgccctgagccactgcagccagctgaccaccttcaacttccatggaaatgagacctccatgaatgccctgaaggacctgctgcggcacactggaggcctgagcaagctgggcctggagctgtacccagcccccctggagagcctggactacaagggccacgtgaactgggagatcctgacccccatccgggcagagctgatgaggaccctgcgggaggtgcggcagcccaagaggatcttcttcggccctgtgccctgccccaactgtggctcctggcccagcgagaaggtggacttccacctgtgcagctag

SEQ ID NO: 40945 - DNA, 1434 bp, Artificial Sequence
  Description of Artificial Sequence: Synthetic coding sequence
atgaagatgagcatccgcatccccccccggctgctggagctgggccgcagcctgctgcgggaccaggccctggccgtgtccaccctggaggagctgcccacagagctgttccccccactcttcatggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcggccccggcgctggaagctgcaggtgctggacctgcaggatgtgtgtgagaacttctggatggtgtggagcgaggccatggcccacggctgcttcctgaatgccaagaggaacaagacccctgtgcaggactgccccaggatgagggagcggcagcccctgactgtgtttgtggagctgtggctgaagaacagaaccctggatgagtacctgacctgcctgctgctgtgggtgaagcagaggcgggacctgctgcacctgtgctgcaagaagctgaagatcctgggcatgcccttcaggaacatccgcagcatcctgaagatggtgaacctggactgcatccaggaggtggaggtgaactgcaagtggatcctgcccatcctgacccagttcaccccctacctgggccacctgaggaacctgcagaagctggtgctgagccacatggatgtgagccgctacgtgtccccagagcagaagaaggagatcgtgacccagttcaccacccagttcctgaagctgcgctgcctgcagaagctgtacatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctgcatggccaccctggagaacctgctgagccacaccatcatcctgaagaacctgtgcctggagctgtacccagccccccaggagagctatggagcagatggcaccctgtgctggagcagatttgcccagatccgggcagagctgatgaagaaggtgcgccacctgcggcaccccaagaggatcctcttctgcacagacaactgcccagaccacggggacaggagcttctatgacctggaggccgaccagtactgctgctag

SEQ ID NO: 40946 - DNA, 1308 bp, Artificial Sequence
  Description of Artificial Sequence: Synthetic coding sequence
atggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcggccccggcgctggaagctgcaggtgctggacctgcaggatgtgtgtgagaacttctggatggtgtggagcgaggccatggcccacggctgcttcctgaatgccaagaggaacaagacccctgtgcaggactgccccaggatgagggagcggcagcccctgactgtgtttgtggagctgtggctgaagaacagaaccctggatgagtacctgacctgcctgctgctgtgggtgaagcagaggcgggacctgctgcacctgtgctgcaagaagctgaagatcctgggcatgcccttcaggaacatccgcagcatcctgaagatggtgaacctggactgcatccaggaggtggaggtgaactgcaagtggatcctgcccatcctgacccagttcaccccctacctgggccacctgaggaacctgcagaagctggtgctgagccacatggatgtgagccgctacgtgtccccagagcagaagaaggagatcgtgacccagttcaccacccagttcctgaagctgcgctgcctgcagaagctgtacatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctgcatggccaccctggagaacctgctgagccacaccatcatcctgaagaacctgtgcctggagctgtacccagccccccaggagagctatggagcagatggcaccctgtgctggagcagatttgcccagatccgggcagagctgatgaagaaggtgcgccacctgcggcaccccaagaggatcctcttctgcacagacaactgcccagaccatggagaccgctccttctatgacctggaggccgaccagtactgctag

SEQ ID NO: 40947 - DNA, 1311 bp, Artificial Sequence
  Description of Artificial Sequence: Synthetic coding sequence
atggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcggccccggcgctggaagctgcaggtgctggacctgcaggatgtgtgtgagaacttctggatggtgtggagcgaggccatggcccacggctgcttcctgaatgccaagaggaacaagacccctgtgcaggactgccccaggatgagggagcggcagcccctgactgtgtttgtggagctgtggctgaagaacagaaccctggatgagtacctgacctgcctgctgctgtgggtgaagcagaggcgggacctgctgcacctgtgctgcaagaagctgaagatcctgggcatgcccttcaggaacatccgcagcatcctgaagatggtgaacctggactgcatccaggaggtggaggtgaactgcaagtggatcctgcccatcctgacccagttcaccccctacctgggccacctgaggaacctgcagaagctggtgctgagccacatggatgtgagccgctacgtgtccccagagcagaagaaggagatcgtgacccagttcaccacccagttcctgaagctgcgctgcctgcagaagctgtacatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctgcatggccaccctggagaacctgctgagccacaccatcatcctgaagaacctgtgcctggagctgtacccagccccccaggagagctatggagcagatggcaccctgtgctggagcagatttgcccagatccgggcagagctgatgaagaaggtgcgccacctgcggcaccccaagaggatcctcttctgcacagacaactgcccagaccatggagaccgctccttctatgacctggaggccgaccagtactgctgctag

SEQ ID NO: 40948 - DNA, 1452 bp, Artificial Sequence
  Description of Artificial Sequence: Synthetic coding sequence
atgagcctgcaggccccaccccggctgctggagctggccgagcagagcctgctgcgggaccgggccctggccatccccaccctggaggagctgccccgggagctgtttcctcctctcttcatggaggccttcacccggcgctgctgtgagaccctgaccaccatggtgcaggcctggcccttcacctgcctgcccctgggcagcctgatgaagagctgcaacctggagatcttccgggctgtgctggagggcctggatgccctgctggcccagaaggtgcggccccggcgctggaagctgcaggtgctggacctgagaaatgtggatgagaacttctggggcatctggagcggggccagcgccctgagccctgaggccctgagcaagagaagaacagctggcaactgccccaggcctgggggccagcagcccctgatggtgatcctggacctgtgcttcaagaatggcatgctggatgagtgcctgacccacttcctggagtggggcaagcagaggaagggcctgctgcacgtgtgctgcaaggagctgcagatcttcggcatcgccatccaccgcatcatcgaggtgctgaacacagtggagctggactgcatccaggaggtggaggtgtgctgcccctgggagctgagcatcctgatccgctttgccccctacctgggccagatgaggaacctgaggaagctggtgctcttcaacatccacgtgtctgcctgcatccccctggacaggaaggagcagtttgtgatccagttcaccagccagttcctgaagctggactacttccagaagctgtacatgcacagcgtgtccttcctggagggccacctggaccagctgctgcgctgcctgcaggcccccctggagaccgtggtgatgacagaatgtctgctgtctgagagtgacctgaagcacctgtcctggtgccccagcatccggcagctgaaggagctggacctgcggggcatcaccctgacccacttcagccctgagcccctgtctgtgctgctggagcaggccgaggccaccctgcagaccctggacctggaggactgtggcatcgtggacagccagctgagcgccatcctgcctgccctgagccgctgcagccagctgagcaccttctccttctgtggcaacctgatctccatggccgccctggagaacctgctgcggcacacagtgggcctgagcaagctgagcctggagctgtacccagcccccctggagagctatgatgcccagggcgccctgtgctggggccgcttcagccagctgggcgctgagctgatgaagaccctgcgggacctgcggcagcccaagatcatcgtgttcagcacagtgccctgcccccgctgtggcatccgggccagctatgacctggagcccagccactgcctgctgaatgcctgctgccagggcggcttcatctag

SEQ ID NO: 40949 - DNA, 1425 bp, Artificial Sequence
  Description of Artificial Sequence: Synthetic coding sequence
atgagcatccaggccccaccccggctgctggagctggccggccagagcctgctgcgggaccaggccctgagcatcagcgccatggaggagctgccccgggtgctgtacctgcccctcttcatggaggccttcagaagaagacacttccagaccctgactgtgatggtgcaggcctggcccttcacctgcctgcccctgggcagcctgatgaagaccctgcacctggagaccctgaaggccctgctggagggcctgcacatgctgctgacccagaaggaccggccccggcgctggaagctgcaggtgctggacctgagagatgtggatgagaacttctgggcccgctggccaggggcctgggccctgagctgcttccctgagaccatgagcaagaggcagacagctgaggactgccccaggatgggagagcaccagcccctgaaggtgttcatcgacatctgcctgaaggagatcccccaggatgagtgcctgcgctacctgttccagtgggtgtaccagaggcggggcctggtgcacctgtgctgcagcaagctggtgaactacctgacccccatcaagcacctgaggaagagcctgaagatcatctacctgaacagcatccagcagctggagatccggaacatgtcctggcccaggctcatcaggaagctgcgctgctacctgaaggagatgaagaacctgaggaagctggtgttcagccgctgccaccacagcatgtctgacaatgagctggagggccgcctggtgaccaagttcagctctgtgttcctgcggctggagcacctgcagctgctgaagatcaagctgatcaccttcttcagcggccacctggagcagctgatccgctgcctgcagaaccccctggagaacctggagctgacctacggctacctgctggaggaggacatgaagtgcctgagccagtaccccagcctgggctacctgaagcacctgaacctgtcctatgtgctgctcttccgcatcagcctggagcccctgggcgccctgctggagaagattgctgccagcctggagaccctcatcctggagggctgccagatccactacagccagctgagcgccatcctgcccggcctgagccactgcagccagctgaccaccttctacttcggcaggaactgcatgtccatgggcgccctgaaggacctgctgcggcacaccagcggcctgagcaagctgagcctggagacctacccagcccctgaggagagcctgaacagcctggtgcgggtggactgggagatctttgccctgctgcgggcagagctgatgtgcaccctgcgggaggtgcggcagcccaagaggatcttcatcggccccaccccctgccccagctgtggcagcagccccagcgaggagctggagctgcacctgtgctgctag

SEQ ID NO: 40950 - DNA, 1425 bp, Artificial Sequence
  Description of Artificial Sequence: Synthetic coding sequence
atgagcatccaggccccaccccggctgctggagctggccggccagagcctgctgcgggaccaggccctgagcatcagcgccatggaggagctgccccgggtgctgtacctgcccctcttcatggaggccttcagaagaagacacttccagaccctgactgtgatggtgcaggcctggcccttcacctgcctgcccctgggcagcctgatgaagaccctgcacctggagaccctgaaggccctgctggagggcctgcacatgctgctgacccagaaggaccggccccggcgctggaagctgcaggtgctggacctgagagatgtggatgagaacttctgggcccgctggccaggggcctgggccctgagctgcttccctgagaccatgagcaagaggcagacagctgaggactgccccaggatgggagagcaccagcccctgaaggtgttcatcgacatctgcctgaaggagatcccccaggatgagtgcctgcgctacctgttccagtgggtgtaccagaggcggggcctggtgcacctgtgctgcagcaagctggtgaactacctgacccccatcaagcacctgaggaagagcctgaagatcatctacctgaacagcatccagcagctggagatccggaacatgtcctggcccaggctcatcaggaagctgcgctgctacctgaaggagatgaagaacctgaggaagctggtgttcagccgctgccaccacagcatgtctgacaatgagctggagggccgcctggtgaccaagttcagctctgtgttcctgcggctggagcacctgcagctgctgaagatcaagctgatcaccttcttcagcggccacctggagcagctgatccgctgcctgcagaaccccctggagaacctggagctgacctacggctacctgctggaggaggacatgaagtgcctgagccagtaccccagcctgggctacctgaagcacctgaacctgtcctatgtgctgctcttccgcatcagcctggagcccctgggcgccctgctggagaagattgctgccagcctggagaccctcatcctggagggctgccagatccactacagccagctgagcgccatcctgcccggcctgagccactgcagccagctgaccaccttctacttcggcaggaactgcatgtccatgggcgccctgaaggacctgctgtgccacaccagcggcctgagcaagctgagcctggagacctacccagcccctgaggagagcctgaacagcctggtgcgggtggactgggagatctttgccctgctgcgggcagagctgatgtgcaccctgcgggaggtgcggcagcccaagaggatcttcatcggccccaccccctgccccagctgtggcagcagccccagcgaggagctggagctgcacctgtgctgctag

SEQ ID NO: 40951 - DNA, 1281 bp, Artificial Sequence
  Description of Artificial Sequence: Synthetic coding sequence
atgagcatccaggccccaccccggctgctggagctggccggccagagcctgctgcgggaccaggccctgagcatcagcgccatggaggagctgccccgggtgctgtacctgcccctcttcatggaggccttcagaagaagacacttccagaccctgactgtgatggtgcaggcctggcccttcacctgcctgcccctgggcagcctgatgaagaccctgcacctggagaccctgaaggccctgctggagggcctgcacatgctgctgacccagaaggaccggccccggcgctggaagctgcaggtgctggacctgagagatgtggatgagaacttctgggcccgctggccaggggcctgggccctgagctgcttccctgagaccatgagcaagaggcagacagctgaggactgccccaggatgggagagcaccagcccctgaaggtgttcatcgacatctgcctgaaggagatcccccaggatgagtgcctgcgctacctgttccagtgggtgtaccagaggcggggcctggtgcacctgtgctgcagcaagctggtgaactacctgacccccatcaagcacctgaggaagagcctgaagatcatctacctgaacagcatccagcagctggagatccggaacatgtcctggcccaggctcatcaggaagctgcgctgctacctgaaggagatgaagaacctgaggaagctggtgttcagccgctgcctgcagaaccccctggagaacctggagctgacctacggctacctgctggaggaggacatgaagtgcctgagccagtaccccagcctgggctacctgaagcacctgaacctgtcctatgtgctgctcttccgcatcagcctggagcccctgggcgccctgctggagaagattgctgccagcctggagaccctcatcctggagggctgccagatccactacagccagctgagcgccatcctgcccggcctgagccactgcagccagctgaccaccttctacttcggcaggaactgcatgtccatgggcgccctgaaggacctgctgtgccacaccagcggcctgagcaagctgagcctggagacctacccagcccctgaggagagcctgaacagcctggtgcgggtggactgggagatctttgccctgctgcgggcagagctgatgtgcaccctgcgggaggtgcggcagcccaagaggatcttcatcggccccaccccctgccccagctgtggcagcagccccagcgaggagctggagctgcacctgtgctgctag

SEQ ID NO: 40952 - DNA, 1437 bp, Artificial Sequence
  Description of Artificial Sequence: Synthetic coding sequence
atgaagatgagcatccgcaccccaccccggctgctggagctggccggccgcagcctgctgcgggaccaggccctggccatgagcaccctggaggagctgcccacagagctgtttcctcctctcttcatggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcggccccggcgctggaagctgcaggtgctggacctgcaggatgtgtgtgagaacttctggatggtgtggagcgaggccatggcccacggctgcttcctgaatgccaagaggaacaagaagcctgtgcaggactgccccaggatgaggggccggcagcccctgactgtgtttgtggagctgtggctgaagaacagaaccctggatgagtacctgacctacctgctgctgtgggtgaagcagaggaaggacctgctgcacctgtgctgcaagaagctgaagatcctgggcatgcccttcaggaacatccgcagcatcctgaagatggtgaacctggactgcatccaggaggtggaggtgaactgcaagtgggtgctgcccatcctgacccagttcaccccctacctgggccacatgaggaacctgcagaagctggtgctgagccacatggatgtgagccgctacgtgtccccagagcagaagaaggagatcgtgacccagttcaccacccagttcctgaagctgcgctgcctgcagaagctgtacatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctgcatggccaccctggagaacctgctgagccacaccatcatcctgaagaacctgtgtgtggagctgtacccagccccccgggagagctatggagcagatggcaccctgtgctggagcagatttgcccagatccgggcagagctgatgaacagagtgcgggacctgcggcaccccaagaggatcctcttctgcacagactactgcccagactgtggcaacagaagcttctatgacctggaggccgaccagtactgctgctag

SEQ ID NO: 40953 - DNA, 1437 bp, Artificial Sequence; identical to SEQ ID NO: 40952
  Description of Artificial Sequence: Synthetic coding sequence

SEQ ID NO: 40954 - DNA, 1425 bp, Artificial Sequence
  Description of Artificial Sequence: Synthetic coding sequence
atgagcctgcagagccccagccggctgctggagctggccggccagagcctgctgaggaaccagttcctgaccatcttcatcctggatgagctgccccgggaggtgttccccctgatgttcatggaggccagctccatgaggcactttgaggccctgaagctgatggtgcaggcctggcccttcctgcggctgcccctgggcagcctgatgaagaccccccacctggagaccctgcaggccgtgctgaagggcctggacaccctgctggcccagaagctgcggccccggcgctggaagctgcaggtgctggacctgagagatgtggatggcaacttctggaccatctggagcggggcccgggccctgagctgcagccctgaggccatgaggaagaggcagacagtggaggactaccccaggactggagagcaccagcccctgaaggtgttcatcgacctgtgccagaaggagagcaccctggatgagtgcctgagctacctgtgccgctggatccactaccgccggggcctggtgcacctgtgctgcaacaaggtgcagaactacagcatgcccaccagcagcttcaggaacctgctgaagagggtgtacccagacagcatccaggagctggagatcaagaggaagtgcagcctgaacaagacaggcaagtttgccccctacctgagccagatgagcaacctgaggaagctgttcctggccttcggctatgatgatgagctgtatgtgtctggccagcagcagtttgtgcctgacctggactgccccttcctgtgcctgtactacccccagatgctgtacatcaggaagatcagcaacatcaaggagcacctggagcacctgctgcgctgcctgaagaaccccctgggcaccttcatcttctgccacgcctacctggccgaccaggacatggagtgcctgagccagtaccccagcctgagccagctgaaggagctgcacctgatccacatcctgatgtggaccaccaacctggagcccctgggcgccctgctggagaaggtggccgccaccctggagatcctgaccctgaaggactgccagatccaggacagccagctgcgggtgctgctgcctgccctgagccgctgcagccagctgaccaccttctacttcagaggaaatgagaccagcaccaatgccctgaaggacctgctgtgccacactggaggcctgagcaagctgggcctggagctgtacccagcccccctggagtgcctggacaacagaggccacgtgaactgggagatcctggcccccatccgggcagagctgatgtgcaccctgcgggaggtgcggcagcccaagaggatcttcttcggccccatcccctgccccagctgtggctcctggcccagcgagaaggtggacttccacctgtgcagctag

SEQ ID NO: 40955 - DNA, 1425 bp, Artificial Sequence
  Description of Artificial Sequence: Synthetic coding sequence
atgagcctgcagagccccagccggctgctggagctggccggccagagcctgctgaggaaccagttcctgaccatcttcatcctggatgagctgccccgggaggtgttccccctgatgttcatggaggccagctccatgaggcactttgaggccctgaagctgatggtgcaggcctggcccttcctgcggctgcccctgggcagcctgatgaagaccccccacctggagaccctgcaggccgtgctgaagggcctggacaccctgctggcccagaagctgcggccccggcgctggaagctgcaggtgctggacctgagagatgtggatggcaacttctggaccatctggagcggggcccgggccctgagctgcagccctgaggccatgagcaagaggcagacagtggaggactaccccaggactggagagcaccagcccctgaaggtgttcatcgacctgtgccagaaggagagcaccctggatgagtgcctgagctacctgtgccgctggatccactaccgccggggcctggtgcacctgtgctgcaacaaggtgcagaactacagcatgcccaccagcagcttcaggaacctgctgaagagggtgtacccagacagcatccaggagctggagatcaagaggaagtgcagcctgaacaagacaggcaagtttgccccctacctgagccagatgagcaacctgaggaagctgttcctggccttcggctatgatgatgagctgtatgtgtctggccagcagcagtttgtgcctgacctggactgccccttcctgtgcctgtactacccccagatgctgtacatcaggaagatcagcaacatcaaggagcacctggagcacctgctgcgctgcctgaagaaccccctgggcaccttcatcttctgccacgcctacctggccgaccaggacatggagtgcctgagccagtaccccagcctgagccagctgaaggagctgcacctgatccacatcctgatgtggaccaccaacctggagcccctgggcgccctgctggagaaggtggccgccaccctggagatcctgaccctgaaggactgccagatccaggacagccagctgcgggtgctgctgcctgccctgagccgctgcagccagctgaccaccttctacttcagaggaaatgagaccagcaccaatgccctgaaggacctgctgtgccacactggaggcctgagcaagctgggcctggagctgtacccagcccccctggagtgcctggacaacagaggccacgtgaactgggagatcctggcccccatccgggcagagctgatgtgcaccctgcgggaggtgcggcagcccaagaggatcttcttcggccccatcccctgccccagctgtggctcctggcccagcgagaaggtggacttccacctgtgcagctag

SEQ ID NO: 40956 - DNA, 1440 bp, Artificial Sequence
  Description of Artificial Sequence: Synthetic coding sequence
atgtccttccaggccccccggcggctgctggagctggccggccagagcctgctgcgggaccaggccctggccatctctgtgctggatgagctgccccgggagctgttcccccggctgtttgtggaggccttcaccagcagaagatgtgaggtgctgaaggtgatggtgcaggcctggcccttcccctgcctgcccctgggcagcctgatgaagaccccagacctggagatcctgcactacgtggtggatggcatcgactgcctgctggcccagaaggtgcggccccggcgctggaagctgcaggtgctggagatgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagtctgtggatgaggacctgtccttcttcagcggctgggtgcagcacagaagaagatctgtgcacctgtgctgcaccaaggtggtgaactacagcatgaacatcctgaacttcaggaacatcctggagaccgtgtacccagacagcatccaggtgctggagatctggaacatgtgctggccctgcatggtggccgaggtgagccgctacctgagccagatgaagaacctgaggaagctgttcatcagtgatggctgcggctacctgcccagctttgagagccagggccagctggtggccgagttcagctctgtgttcctgcggctggagtacctgcagatgctgtacatgaggcgcatccgcttctttgagggctacctggaccagctgatccgctgcctgaagagccccctggagaccctggccctgacctacggcagcctggatgaggaggacctgaagtgcctgccctggtaccccagcctgagccagctgaagcagctgaacctgagccacggcaccctgcgcttcatccggctggagcccctgcgggccctgctggagaaggtggccgccaccctgcagaccctcttcctggtggactgtggcattggagacagcaagctgcgggtcatcctgcctgccctgagccgctgcagcaacctgaccaccttctgcttccatggaaatgacacctccatggatggcctgaaggacctgctgcggcacacaggccgcctgagcaacctgagcctggagacctacccagccccccgggagagcctggacaacagaggccgggtcatcagcgagctgctgacccccctgcaggccgagctgatgaggatcctgcgggaggtgcgggagcccaaccgcatcttcttcggccctgtgtcctgcccctgctgcggcatgagccccacagagcagctggagttcaacttctgcctgcggggccggcctgcctag

SEQ ID NO: 40957 - DNA, 1233 bp, Artificial Sequence
  Description of Artificial Sequence: Synthetic coding sequence
atgaagaccccagacctggagatcctgcactacgtggtggatggcatcgactgcctgctggcccagaaggtgcggccccggcgctggaagctgcaggtgctggagatgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagtctgtggatgaggacctgtccttcttcagcggctgggtgcagcacagaagaagatctgtgcacctgtgctgcaccaaggtggtgaactacagcatgaacatcctgaacttcaggaacatcctggagaccgtgtacccagacagcatccaggtgctggagatctggaacatgtgctggccctgcatggtggccgaggtgagccgctacctgagccagatgaagaacctgaggaagctgttcatcagtgatggctgcggctacctgcccagctttgagagccagggccagctggtggccgagttcagcagcgtcttcctgcggctggagtacctgcagatgctgtacatgaggcgcatccgcttctttgagggctacctggaccagctgatccgctgcctgaagagccccctggagaccctggccctgacctacggcagcctggatgaggaggacctgaagtgcctgccctggtaccccagcctgagccagctgaagcagctgaacctgagccacggcaccctgcgcttcatccggctggagcccctgcgggccctgctggagaaggtggccgccaccctgcagaccctcttcctggtggactgtggcatcggctacagcaagctgcgggtcatcctgcctgccctgagccgctgcagcaacctgaccaccttctgcttccacggcaatgacacctccatggatggcctgaaggacctgctgcggcacacaggccgcctgagcaacctgagcctggagacctacccagccccccgggagagcctggacaacagaggccgggtcatcagcgagctgctgacccccctgcaggccgagctgatgaggatcctgcgggaggtgcgggagcccaaccgcatcttctttggacctgtgtcctgcccctgctgcggcatgagccccacagagcagctggagttcaacttctgcctgcggggccgcccagcctag

SEQ ID NO: 40958 - DNA, 1440 bp, Artificial Sequence
  Description of Artificial Sequence: Synthetic coding sequence
atgtccttccaggccccccggcggctgctggagctggccggccagagcctgctgcgggaccaggccctggccatctctgtgctggatgagctgccccgggagctgttcccccggctgtttgtggaggccttcaccagcagaagatgtgaggtgctgaaggtgatggtgcaggcctggcccttcccctgcctgcccctgggcagcctgatgaagaccccagacctggagatcctgcactacgtggtggatggcatcgactgcctgctggcccagaaggtgcggccccggcgctggaagctgcaggtgctggagatgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagtctgtggatgaggacctgtccttcttcagcggctgggtgcagcacagaagaagatctgtgcacctgtgctgcaccaaggtggtgaactacagcatgaacatcctgaacttcaggaacatcctggagaccgtgtacccagacagcatccaggtgctggagatctggaacatgtgctggccctgcatggtggccgaggtgagccgctacctgagccagatgaagaacctgaggaagctgttcatcagtgatggctgcggctacctgcccagctttgagagccagggccagctggtggccgagttcagctctgtgttcctgcggctggagtacctgcagatgctgtacatgaggcgcatccgcttctttgagggctacctggaccagctgatccgctgcctgaagagccccctggagaccctggccctgacctacggcagcctggatgaggaggacctgaagtgcctgccctggtaccccagcctgagccagctgaagcagctgaacctgagccacggcaccctgcgcttcatccggctggagcccctgcgggccctgctggagaaggtggccgccaccctgcagaccctcttcctggtggactgtggcatcggctacagcaagctgcgggtcatcctgcctgccctgagccgctgcagcaacctgaccaccttctgcttccatggaaatgacacctccatggatggcctgaaggacctgctgcggcacacaggccgcctgagcaacctgagcctggagacctacccagccccccgggagagcctggacaacagaggccgggtcatcagcgagctgctgacccccctgcaggccgagctgatgaggatcctgcgggaggtgcgggagcccaaccgcatcttcttcggccctgtgtcctgcccctgctgcggcatgagccccacagagcagctggagttcaacttctgcctgcggggccggcctgcctag

SEQ ID NO: 40959 - DNA, 1425 bp, Artificial Sequence
  Description of Artificial Sequence: Synthetic coding sequence
atgagcatccaggccccaccccggctgctggagctggccggccagagcctgctgcgggaccaggccctgagcatcagcgccatggaggagctgccccgggtgctgtacctgcccctcttccgggaggccttcagccgccgccacttccagaccctgactgtgatggtgcaggcctggcccttcacctgcctgcccctggtgtccctgatgaagaccctgcacctggagcccctgaaggccctgctggagggcctgcacatgctgctgacccagaaggaccggccccggcgctggaagctgcaggtgctggacctgagagatgtggatgagaacttctgggcccgctggccaggggcctgggccctgagctgcttccctgaggccatgagcaagaggcagacagctgaggactgccccaggactggagagcaccagcccctgaaggtgttcatcgacatctgcctgaaggagatcccccaggatgagtgcctgcgctacctgttccagtgggtgtaccagaggcggggcctggtgcacctgtgctgcagcaagctggtgaactacctgacccccatcaagtacctgaggaagagcctgaagatcatctacatcaacagcattggagagctggagatccacaacacctgctggccccacctgatcaggaagctgtactgctacctgaaggagatgaagaccctgtgcaagctggtgttcagccgctgccaccactacaccagtgacaatgagctggagggctggctggtgacccgcttcacctctgtgttcctgcggctggagcacctgcagctgctgaagatcaagctgatcaccttcttcagcggccacctggagcagctgatccgctgcctgcagaaccccctggagaacctggagctgacctgtggcaacctgctggaggaggacctgaagtgcctgagccagttccccagcctgggctacctgaagcacctgaacctgtcctatgtgctgctcttccgcatcagcctggagcccctgggcgccctgctggagaagattgctgccagcctggagaccctggtgctggagggctgccagatccactacagccagctgagcgccatcctgcccggcctgagctgctgcagccagctgaccaccttctacttcggcagcaactgcatgagcattgatgccctgaaggacctgctgcggcacaccagcggcctgagcaagctgagcctggagacctacccagcccctgaggagagcctgaacagcctggtgcgggtgaactgggagatcttcacccccctgcgggcagagctgatgtgcaccctgcgggagttccggcagcccaagaggatcttcatcggccccaccccctgccccagctgtggcagcagccccagcgaggagctggagctgcacctgtgctgctag

SEQ ID NO: 40960 - DNA, 1428 bp, Artificial Sequence
  Description of Artificial Sequence: Synthetic coding sequence
atgagcatccgcaccccaccccggctgctggagctggccggccgcagcctgctgagagatgaggccctggccatcagcaccctggaggagctgcccacagagctgtttcctcctctcttcatggaggccttcagccgccgccactgtgaggccctgaagctgatggtgcaggcctggcccttcctgcggctgcccctgggcagcctgatgaagaggccctgcccagagaccttccaggccgtgctggatggcctggatgccctgctgacccaccgggtgcggctgcggcgctggaagctgcaggtgctggacctgcaggatgtgtctgagaacttctggatggtgtggagcgaggccatggcccggcgctgcctgcccaatgccatgatgaacaggaagcctgtgcaggactgccccaggatgaggggccagcagcccctgaccgtcttcatcgacctgtgcctgaagaacagaaccctggatgagtacttcacctgcctcttcctgtgggtgaagcagcgggagggcctggtgcacctgtgctgcaagaagctgaagatgctgggcatgctgttccacaacatccggaacatcctgaagacagtgaacctggactgcatccaggaggtggaggtgaactgcaactggaccctgcctgtgctggccgagttcaccccctacctgggccagatgaggaacctgaggaagctggtgctgagtgacatcgacagccgctacatcagccctgagcagaagaaggagtttgtgacccagttcaccacccagttcctgaagctgcgctgcctgcagaagctgtacatgaacagcgtgtccttcctggagggccacctggaccagatgctgagctgcctgaagaccagcctgaacatcctggccatcaccaactgtgtgctgctggagagtgacctgaagcacctgagcaagtaccccagcatcggccagctgaagaccctggacctgagcggcacccggctggccaacttcagcctggtgcccctgcaggtgctgctggagaaggtggccgccaccctggagtacctggacctggatgactgtggcatcgtggacagccaggtgaatgccatcctgcctgccctgagccgctgctttgagctgaccaccttctccttccggggcaaccccatcagcacagccaccctggagaacctgctgtgccacaccatccggctgaacaacctgtgcctggagctgtacccagccccccgggagagctatgatgtgcggggcatcgtgtgccgcagcagatttgcccagctgggcgctgagctgatgggccgggtgcgggccctgcgggagcctgagcgcatcctcttctgcacagactactgcccccagtgtggcaacagaagcctgtatgacctggaggtggaccgctgctgctgctag

SEQ ID NO: 40961 - DNA, 1428 bp, Artificial Sequence; identical to SEQ ID NO: 40960
  Description of Artificial Sequence: Synthetic coding sequence

SEQ ID NO: 40962 - DNA, 1428 bp, Artificial Sequence; identical to SEQ ID NO: 40960
  Description of Artificial Sequence: Synthetic coding sequence

SEQ ID NO: 40963 - DNA, 1446 bp, Artificial Sequence
  Description of Artificial Sequence: Synthetic coding sequence
atgaggatgagcctgcaggccccccggcggctgctggagctggccggccagagcctgctgggggaccaggccctggccatcagcatcctggatgagctgccccgggagctgtttcctcccctgtttgtggaggccttcaccagcagaagatgtgaggtgctgaaggtgatggtgcaggcctggcccttcccctgcctgcccctgggcagcctgatgaagaccccagacctggagatcctgcactacgtggtggatggcatcgactgcctgctggcccagaaggtgcggccccggcgctggaagctgcaggtgctggagctgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagttcatggatgaggacctgtccttcttcagcggctgggtgcagcaccggcggggctctgtgcacctgtgctgcaccaaggtggtgaactacagcatgagcatcctgaacttcaggaacatcctggagaccgtgtacccagacagcatccaggtgctggagatctggaacatgtgctggccctgcatgattgtggagttcagccgctacctgagccagatgaggaacctgaggaagctgttcatcagtgatggctgccgctacctgctgagcagtgacagccaggagcagctggtggccgagttcagctctgtgctgctgcggctggagtacctgcagatgctgtatgtgagaagagtgtgcttcttccggggccacctggaccagctgatccgctgcctgcggagccccctggagaccctggccctgacctacggcttcctggagaaggtggacctgaagtgcctgccccgctaccccagcctgagccagctgaagcagctgaacctgagccatggagccctgcgcttcatccggctggagcccctgcgggccctgctggagaaggtggccgccaccctgcagaccctcttcctggtggactgtggcatccgggacagcaagctgcgggtcatcctgcctgccctgagctgctgcagcaacctgaccaccttctgcttccatggaaatgacacctccatggatggcctgaaggacctgctgcggcacacaggccgcctgagcaacctgagcctggagacctacccagccccccgggagagcctggatgaccggggccgggtcatcagcgagctgctgacccccctgcaggccgagctgatgaggatcctgcgggaggtgcgggagcccaagaggatcttcttcggccctgtgtcctgcccctgctgcggcaccagccccacagagcagctggagttcaacttctgcctgtggggccggcctgcctag

SEQ ID NO: 40964 - DNA, 1440 bp, Artificial Sequence
  Description of Artificial Sequence: Synthetic coding sequence
atgagcctgcaggccccccggcggctgctggagctggccggccagagcctgctgggggaccaggccctggccatcagcatcctggatgagctgccccgggagctgtttcctcccctgtttgtggaggccttcaccagcagaagatgtgaggtgctgaaggtgatggtgcaggcctggcccttcccctgcctgcccctgggcagcctgatgaagaccccagacctggagatcctgcactacgtggtggatggcatcgactgcctgctggcccagaaggtgcggcccaggaggaggaagctgcaggtgctggagctgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagttcatggatgaggacctgtccttcttcagcggctgggtgcagcaccggcggggctctgtgcacctgtgctgcaccaaggtggtgaactacagcatgagcatcctgaacttcaggaacatcctggagaccgtgtacccagacagcatccaggtgctggagatctggaacatgtgctggccctgcatgattgtggagttcatccgctacctgagccagatgaggaacctgaggaagctgttcatcagtgatggctgccgctacctgctgagcagtgacagccaggagcagctggtggccgagttcagctctgtgctgctgcggctggagtacctgcagatgctgtatgtgagaagagtgtgcttcttccggggccacctggaccagctgatccgctgcctgcggagccccctggagaccctggccctgacctacggcttcctggagaaggtggacctgaagtgcctgccccgctaccccagcctgagccagctgaagcagctgaacctgagccatggagccctgcgcttcatccggctggagcccctgcgggccctgctggagaaggtggccgccaccctgcagaccctcttcctggtggactgtggcatccgggacagcaagctgcgggtcatcctgcctgccctgagctgctgcagcaacctgaccaccttctgcttccatggaaatgacacctccatggatggcctgaaggacctgctgcggcacacaggccgcctgagcaacctgagcctggagacctacccagccccccgggagagcctggatgaccggggccgggtcatcagcgagctgctgacccccctgcaggccgagctgatgaggatcctgcgggaggtgcgggagcccaagaggatcttcttcggccctgtgtcctgcccctgctgcggcaccagccccacagagcagctggagttcaacttctgcctgtggggccggcctgcctag

SEQ ID NO: 40965 - DNA, 1446 bp, Artificial Sequence
  Description of Artificial Sequence: Synthetic coding sequence
atgaggatgagcctgcaggccccccggcggctgctggagctggccggccagagcctgctgggggaccaggccctggccatcagcatcctggatgagctgccccgggagctgtttcctcccctgtttgtggaggccttcaccagcagaagatgtgaggtgctgaaggtgatggtgcaggcctggcccttcccctgcctgcccctgggcagcctgatgaagaccccagacctggagatcctgcactacgtggtggatggcatcgactgcctgctggcccagaaggtgcggcccaggaggaggaagctgcaggtgctggagctgagagatgtggatgagaacttctggaccatctggagcggggcccggcccctgagctgcagccctgaggccatgagcaagaggcagacagtggaggactgccccaggactggagagaagcagcccctgaaggtgttcatggatgtgtgcctgaaggagaagttcatggatgaggacctgtccttcttcagcggctgggtgcagcaccggcggggctctgtgcacctgtgctgcaccaaggtggtgaactacagcatgagcatcctgaacttcaggaacatcctggagaccgtgtacccagacagcatccaggtgctggagatctggaacatgtgctggccctgcatgattgtggagttcatccgctacctgagccagatgaggaacctgaggaagctgttcatcagtgatggctgccgctacctgctgagcagtgacagccaggagcagctggtggccgagttcagctctgtgctgctgcggctggagtacctgcagatgctgtatgtgagaagagtgtgcttcttccggggccacctggaccagctgatccgctgcctgcggagccccctggagaccctggccctgacctacggcttcctggagaaggtggacctgaagtgcctgccccgctaccccagcctgagccagctgaagcagctgaacctgagccatggagccctgcgcttcatccggctggagcccctgcgggccctgctggagaaggtggccgccaccctgcagaccctcttcctggtggactgtggcatccgggacagcaagctgcgggtcatcctgcctgccctgagctgctgcagcaacctgaccaccttctgcttccatggaaatgacacctccatggatggcctgaaggacctgctgcggcacacaggccgcctgagcaacctgagcctggagacctacccagccccccgggagagcctggatgaccggggccgggtcatcagcgagctgctgacccccctgcaggccgagctgatgaggatcctgcgggaggtgcgggagcccaagaggatcttcttcggccctgtgtcctgcccctgctgcggcaccagccccacagagcagctggagttcaacttctgcctgtggggccggcctgcctag

SEQ ID NO: 40966 - DNA, 1437 bp, Artificial Sequence
  Description of Artificial Sequence: Synthetic coding sequence
atgaagatgagcatctggaccccaccccggctgctggagctggccggccgcagcctgctgcgggaccaggccctggccatgagcaccctggaggagctgcccacagagctgtttcctcctctcttcatggaggccttcagcagaagaagatgtgaggccctgaagctgatggtgcagagctggcccttccggcggctgcccctgcggcccctcatcaagatgccctgcctggaggccttccaggccgtgctggatggcctggatgccctgctgaacctgggcgtgcggccccggcgctggaagctgcaggtgctggacctgcaggatgtgtgtgagaacttctggatggtgtggagcgaggccatggcccacggctgcttcctgaatgccaagaggaacaagaagcctgtggaggactgccccaggatgaggggccggcagcccctgactgtgtttgtggagctgtggctgaagaacagaaccctggatgagtacctgacctgcctgctgctgtgggtgaagcagaggaaggacctgctgcacctgtgctgcaagaagctgaagatcctgggcatgcccttcaggaacatccgcagcatcctgaagatggtgaacctggactgcatccaggaggtggaggtgaactgcaagtgggtgctgcccatcctgacccagttcaccccctacctgggccacatgaggaacctgcagaagctgatcctgagccacatggatgtgagccgctacgtgtccccagagcagaagaaggagatcgtgacccagttcaccacccagttcctgaagctgcgctgcctgcagaagctgtacatgaacagcgtgtccttcctggagggccacctggaccagctgctgagctgcctgaagaccagcctgaagttcctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctgcatggccaccctggagaacctgctgagccacaccatcatcctgaagaacctgtgtgtggagctgtacccagccccccgggagagctatggagcagatggcaccctgtgctggagcagatttgcccagatccgggcagagctgatgaacagagtgcgggacctgcggcaccccaagaggatcctcttctgcacagactactgcccagactgtggcaacagaagcttctatgacctggaggccgaccagtactgctgctag

SEQ ID NO: 40967 - DNA, 1431 bp, Artificial Sequence
  Description of Artificial Sequence: Synthetic coding sequence
atgagcatccgcaccccaccccggctgctggagctggccggccgcagcctgctgcgggaccaggccctggccatgagcaccctggaggagctgcccacagagctgtttcctcctctcttcatggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcacccccggcgctggaagctgcaggtgctggacctgcaggatgtgtgtgagaacttctggatggtgtggagcgaggccatggcccacggctgcttcctgaatgccaagaggaacaagaagcctgtgcaggactgccccaggatgaggggccagcagcccctgactgtgtttgtggagctgtggctgaagaacagaaccctggatgagtacctgacctgcctgctgctgtgggtgaagcagaggaaggacctgctgcacctgtgctgcaagaagctgaagatcctgggcatgcccttcaggaacatccgcagcatcctgaagatggtgaacctggactgcatccaggaggtggaggtgaactgcaagtgggtgctgcccatcctgacccagttcaccccctacctgggccacatgaggaacctgcagaagctggtgctgagccacatggatgtgagccgctacgtgtccccagagcagaagaaggagatcgtgacccagttcaccacccagttcctgaagctgtgctgcctgcagaagctgtccatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctccatggccaccctggagaacctgctgagccacaccatcatcctgaagaacctgtgtgtggagctgtacccagccccccgggagagctatgatgctgatggcaccctgtgctggagcagatttgcccagatccgggcagagctgatgaagagggtgcgggacctgcggcaccccaagaggatcctcttctgcacagactgctgcccagactgtggcaacagaagcttctatgacctggaggccgaccagtgctgctgctag

SEQ ID NO: 40968 - DNA, 1431 bp, Artificial Sequence
  Description of Artificial Sequence: Synthetic coding sequence
atgagcatccgcaccccaccccggctgctggagctggccggccgcagcctgctgcgggaccaggccctggccatgagcaccctggaggagctgcccacagagctgtttcctcctctcttcatggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcacccccggcgctggaagctgcaggtgctggacctgcaggatgtgtgtgagaacttctggatggtgtggagcgaggccatggcccggggctgcttcctgaatgccaagaggaacaagacccctgtgcaggactgccccaggatgaggggccagcagcccctgactgtgtttgtggagctgtggctgaagaacagaaccctggatgagtacctgacctgcctgctgctgtgggtgaagcagaggaaggacctgctgcacctgtgctgcaagaagctgaagatcctgggcatgcccttcaggaacatccgcagcatcctgaagatggtgaacctggactgcatccaggaggtggaggtgaactgcaagtgggtgctgcccatcctgacccagttcaccccctacctgggccacatgaggaacctgcagaagctggtgctgagccacatggatgtgagccgctacgtgtccccagagcagaagaaggagatcgtgacccagttcaccacccagttcctgaagctgtgctgcctgcagaagctgtccatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagccgctgctttgagctgaacaccttctccttctgtggcaaccccatctccatggccaccctggagaacctgctgagccacaccatcatcctgaagaacctgtgtgtggagctgtacccagccccccgggagagctatgatgctgatggcaccctgtgctggagcagatttgcccagatccgggcagagctgatgaagagggtgcgggacctgcggcaccccaagaggatcctcttctgcacagactgctgcccagactgtggcaacagaagcttctatgacctggaggccgaccagtgctgctgctag

SEQ ID NO: 40969 - DNA, 1431 bp, Artificial Sequence
  Description of Artificial Sequence: Synthetic coding sequence
atgagcatccgcaccccaccccggctgctggagctggccggccgcagcctgctgcgggaccaggccctggccatgagcaccctggaggagctgcccacagagctgtttcctcctctcttcatggaggccttcagcagaagaagatgtgaggccctgaagctgatggtgcaggcctggcccttccggcggctgcccctgcggcccctcatcaagatgccctgcctggaggccttccaggccgtgctggatggcctggatgccctgctgacccagggcgtgcacccccggcgctggaagctgcaggtgctggacctgcaggatgtgtgtgagaacttctggatggtgtggagcgaggccatggcccacggctgcttcctgaatgccaagaggaacaagaagcctgtgcaggactgccccaggatgaggggccagcagcccctgactgtgtttgtggagctgtggctgaagaacagaaccctggatgagtacctgacctgcctgctgctgtgggtgaagcagaggaaggacctgctgcacctgtgctgcaagaagctgaagatcctgggcatgcccttcaggaacatccgcagcatcctgaagatggtgaacctggactgcatccaggaggtggaggtgaactgcaagtgggtgctgcccatcctgacccagttcaccccctacctgggccacatgaggaacctgcagaagctggtgctgagccacatggatgtgagccgctacgtgtccccagagcagaagaaggagatcgtgacccagttcaccacccagttcctgaagctgtgctgcctgcagaagctgtccatgaacagcgtgtccttcctggagggccacctggaccagctgctgagctgcctgaagaccagcctgaaggtgctgaccatcaccaactgtgtgctgctggagagtgacctgaagcacctgagccagtgccccagcatcagccagctgaagaccctggacctgagcggcatccggctgaccaactacagcctggtgcccctgcagatcctgctggagaaggtggccgccaccctggagtacctggacctggatgactgtggcatcatcgacagccaggtgaatgccatcctgcctgccctgagctgctgctttgagctgaacaccttctccttctgtggcaaccccatctccatggccaccctggagaacctgctgagccacaccatcatcctgaagaacctgtgtgtggagctgtacccagccccccgggagagctatgatgctgatggcaccctgtgctggagccgcttcccccagatccgggcagagctgatgaagagggtgcgggacctgcggcaccccaagaggatcctcttctgcacagactgctgcccagactgtggcaacagaagcttctatgacctggaggccgaccagtgctgctgctag

SEQ ID NO: 40970 - DNA, 1431 bp, Artificial Sequence; identical to SEQ ID NO: 40968
  Description of Artificial Sequence: Synthetic coding sequence

SEQ ID NO: 40971 - DNA, 1431 bp, Artificial Sequence; identical to SEQ ID NO: 40967
  Description of Artificial Sequence: Synthetic coding sequence

SEQ ID NO: 40972 - DNA, 1431 bp, Artificial Sequence; identical to SEQ ID NO: 40969
  Description of Artificial Sequence: Synthetic coding sequence

SEQ ID NO: 40973 - DNA, 1431 bp, Artificial Sequence; identical to SEQ ID NO: 40968
  Description of Artificial Sequence: Synthetic coding sequence

SEQ ID NO: 40974 - DNA, 1425 bp, Artificial Sequence
  Description of Artificial Sequence: Synthetic coding sequence
atgagcatccgggccccaccccggctgctggagctggcccggcagaggctgctgcgggaccaggccctggccatcagcaccatggaggagctgccccgggagctgttccccaccctcttcatggaggccttcagcagaagaagatgtgagaccctgaagaccatggtgcaggcctggcccttcacccggctgcccctgggcagcctgatgaagagcccccacctggagagcctgaagtctgtgctggagggcgtggatgtgctgctgacccaggaggtgcggccccggcagagcaagctgcaggtgctggacctgagaaatgtggatgagaacttctgtgacatcttcagcggggccacagccagcttccctgaggccctgagccagaagcagacagctgacaactgccccggcaccggccggcagcagcccttcatggtgttcatcgacctgtgcctgaagaacagaaccctggatgagtgcctgacccacctgctggagtggggcaagcagaggaagggcctgctgcacgtgtgctgcaaggagctgcaggtgtttggcatgcccatccacagcatcatcgaggtgctgaacatggtggagctggactgcatccaggaggtggaggtgtgctgcccctgggagctgagcaccctggtgaagtttgccccctacctgggccagatgaggaacctgaggaagctggtgctcttcaacatccgggccagcgcctgcatccccccagacaacaagggccagttcatcgcccgcttcaccagccagttcctgaagctggactacttccagaacctgtccatgcacagcgtgtccttcctggagggccacctggaccagctgctgcgctgcctgcaggccagcctggagatggtggtgatgacagactgcctgctgtctgagagtgacctgaagcacctgtcctggtgccccagcatccggcagctgaaggagctggacctgcggggcgtgaccctgacccacttcagccctgagcccctgaccggcctgctggagcaggtggtggccaccctgcagaccctggacctggaggactgtggcatcatggacagccagctgagcgccatcctgcctgtgctgagccgctgcagccagctgagcaccttctccttctgtggcaacctgatctccatggccgccctggagaacctgctgcggcacacagtgggcctgagcaagctgagcctggagctgtacccagcccccctggagagctatgacacccagggcgccctgtgctggggccgctttgctgagctgggcgctgagctgatgaagaccccccgggacctgcggcagcccaagatcatcgtgttctgcaccgtgccctgcccccgctgtggcatccgggccagctatgacctggagcccagccactgcctgtgctag

SEQ ID NO: 40975 - DNA, 1425 bp, Artificial Sequence; identical to SEQ ID NO: 40974
  Description of Artificial Sequence: Synthetic coding sequence

SEQ ID NO: 40976 - DNA, 1425 bp, Artificial Sequence
  Description of Artificial Sequence: Synthetic coding sequence
atgagcatccgggccccaccccggctgctggagctggcccggcagaggctgctgcgggaccaggccctggccatcagcaccatggaggagctgccccgggagctgttccccaccctcttcatggaggccttcagcagaagaagatgtgagaccctgaagaccatggtgcaggcctggcccttcacccggctgcccctgggcagcctgatgaagagcccccacctggagagcctgaagtctgtgctggagggcgtggatgtgctgctgacccaggaggtgcggccccggcagagcaagctgcaggtgctggacctgagaaatgtggatgagaacttctgtgacatcttcagcggggccacagccagcttccctgaggccctgagccagaagcagacagctgacaactgccccggcaccggccggcagcagcccttcatggtgttcatcgacctgtgcctgaagaacagaaccctggatgagtgcctgacccacctgctggagtggggcaagcagaggaagggcctgctgcacgtgtgctgccaggagctgcaggtgtttggcatgcccatccacagcatcatcgaggtgctgaacatggtggagctggactgcatccaggaggtggaggtgtgctgcccctgggagctgagcaccctggtgaagtttgccccctacctgggccagatgaggaacctgaggaagctggtgctcttcaacatccgggccagcgcctgcatccccccagacaacaagggccagttcatcgcccgcttcaccagccagttcctgaagctggactacttccagaacctgtccatgcacagcgtgtccttcctggagggccacctggaccagctgctgcgctgcctgcaggccagcctggagatggtggtgatgacagactgcctgctgtctgagagtgacctgaagcacctgtcctggtgccccagcatccggcagctgaaggagctggacctgcggggcgtgaccctgacccacttcagccctgagcccctgaccggcctgctggagcaggtggtggccaccctgcagaccctggacctggaggactgtggcatcatggacagccagctgagcgccatcctgcctgtgctgagccgctgcagccagctgagcaccttctccttctgtggcaacctgatctccatggccgccctggagaacctgctgcggcacacagtgggcctgagcaagctgagcctggagctgtacccagcccccctggagagctatgacacccagggcgccctgtgctggggccgctttgctgagctgggcgctgagctgatgaagaccctgcgggacctgcggcagcccaagatcatcgtgttctgcaccgtgccctgcccccgctgtggcatccgggccagctatgacctggagcccagccactgcctgtgctag

SEQ ID NO: 40977 - DNA, 1437 bp, Artificial Sequence; identical to SEQ ID NO: 40952
  Description of Artificial Sequence: Synthetic coding sequence

SEQ ID NO: 40978 - DNA, 522 bp, Artificial Sequence
  Description of Artificial Sequence: Synthetic coding sequence
atgtttgcccggggcagcagaagaagaagaagtggccgggcccctcctgaggctgaagatcctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgacagcggctgtgccagcgaggagtatgcctgggtgcccccaggcctgaagccagagcaggtgtaccagttcttcagctgcctgcctgaggacaaggtgccctacgtgaacagccctggagagaagtaccgcatcaagcagctgctgcaccagctgccccctcatgattctgaggtgcggcgggagaagacaggccgggcctgccaggcccagcacacagcctgggccaatgccggccagggccagaggaggaaaggagagctgatctag

SEQ ID NO: 40979 - DNA, 1848 bp, Artificial Sequence
  Description of Artificial Sequence: Synthetic coding sequence
atgtttgcccggggcagcagaagaagaagaagtggccgggcccctcctgaggctgaagatcctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgacagcggctgtgccagcgaggagtatgcctgggtgcccccaggcctgaagccagagcaggtgtaccagttcttcagctgcctgcctgaggacaaggtgccctacgtgaacagccctggagagaagtaccgcatcaagcagctgctgcaccagctgccccctcatgattctgaggcccagtactgcacagccctggaggaggaggagaagaaggagctgcgggccttcagccagcagaggaagcgggagaacctgggccggggcatcgtgcgcatcttccctgtgaccatcaccggggccatctgtgaggagtgtgggaagcagattggaggaggagacattgctgtgtttgccagcagagctggcctgggcgcctgctggcacccccagtgctttgtgtgcaccacctgccaggagctgctggtggacctgatctacttctaccacgtgggcaaggtgtactgcggccgccaccacgcagaatgtctgcggccccgctgccaggcctgtgatgagatcatcttcagccctgagtgcacagaggccgagggccgccactggcacatggaccacttctgctgctttgaatgtgaggccagcctgggcggccagcgctacgtgatgaggcagagccggccccactgctgtgcctgctatgaggcccggcatgctgagtactgtgatggctgtggggagcacatcggcctggaccagggccagatggcctatgagggccagcactggcacgccagtgaccgctgcttctgctgcagccgctgtggccgggccctgctgggccggcccttcctgccccggcggggcctcatcttctgcagccgggcctgcagcctgggcagcgagcccacagcccctggccccagcagaagatcctggagcgctggccctgtgacagcccccctggccgccagcacagccagcttctctgctgtgaagggggccagcgagaccaccaccaagggcaccagcacagagctggccccagccaccggccctgaggagcccagccgcttcctgcggggggccccccaccgccacagcatgcctgagctgggcctgcggtctgtgcctgagcccccacctgagagccctggccagcccaacctgcggccagatgacagcgccttcggccggcagagcaccccccgggtgtccttccgggaccccctggtgtctgagggcggccccaggaggaccctgagcgcccccccagcccagaggcggcggcccaggagccccccaccccgggcccccagcagaagaagacaccaccaccacaaccaccaccaccaccacaacagacaccccagcagaagaagacactaccagtgtgatgctggcagcggcagtgacagcgagagctgcagcagcagccccagcagcagcagcagcgagagcagtgaagatgatggcttcttcctgggggagcgcatccccctgcccccccacctgtgccggcccatgcctgcccaggacacagccatggagaccttcaacagccccagcctgagcctgccccgggacagcagagctggcatgccccggcaggcccgggacaagaactgcatcgtggcctag

SEQ ID NO: 40980 - DNA, 453 bp, Artificial Sequence
  Description of Artificial Sequence: Synthetic coding sequence
atgtttgcccggggcagcagaagaagaagaagtggccgggcccctcctgaggctgaagatcctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgacagcggctgtgccagcgaggagtatgcctgggtgcccccaggcctgaagccagagcaggtgacccggggccagcccagcaccctggccgtgcagtgggtgcacaccaatgcccacacccacacccacacccaggtgggcacctacttctggggctacgcccgggtgtgcagccagacagagggccccagcggcccctag

SEQ ID NO: 40981 - DNA, 996 bp, Artificial Sequence
  Description of Artificial Sequence: Synthetic coding sequence
tgaccacccctgccccggctgtgcccagccccaccccacagcggccgctgccccagcctgcccagcgctgcccagcccccagaggccgaggaccctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgattctggctgtgccagcgaggagtatgcctgggtgcccccaggcctgaagccagagcaggtgtaccagttcttcagctgcctgcctgaggacaaggtgccctacgtgaacagccctggagagaagtaccgcatcaagcagctgctgcaccagctgccccctcatgacagcgaggcccagtactgcacagccctggaggaggaggagaagaaggagctgcgggccttcagccagcagaggaagcgggagaacctgggccggggcatcgtgcgcatcttccctgtgaccatcactggagccatctgtgaagaatgtgggaagcagatcggcggcggggacattgctgtgtttgccagccgggccggcctgggcgcctgctggcacccccagtgctttgtgtgcaccacctgccaggagctgctggtggacctgatctacttctaccacgtgggcaaggtgtactgcggccgccaccacgccgagtgcctgcggccccgctgccaggcctgtgatgagatcatcttctccccagaatgtacagaagctgagggccgccactggcacatggaccacttctgctgctttgaatgtgaggccagcctgggcggccagagatatgtgatgaggcagagccggccccactgctgtgcctgctatgaggcccggcatgctgagtactgtgatggctgtggggagcacatcggcggctag

SEQ ID NO: 40982 - DNA, 1887 bp, Artificial Sequence
  Description of Artificial Sequence: Synthetic coding sequence
tgagtggagggccgggccctgaccagccccagcctgctgccccggctgacccggccctgcatctgcccccggcccctgcagcccccagaggccgaggaccctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgattctggctgtgccagcgaggagtatgcctgggtgcccccaggcctgaagccagagcaggtgtaccagttcttcagctgcctgcctgaggacaaggtgccctacgtgaacagccctggagagaagtaccgcatcaagcagctgctgcaccagctgccccctcatgacagcgaggcccagtactgcacagccctggaggaggaggagaagaaggagctgcgggccttcagccagcagaggaagcgggagaacctgggccggggcatcgtgcgcatcttccctgtgaccatcactggagccatctgtgaagaatgtgggaagcagatcggcggcggggacattgctgtgtttgccagccgggccggcctgggcgcctgctggcacccccagtgctttgtgtgcaccacctgccaggagctgctggtggacctgatctacttctaccacgtgggcaaggtgtactgcggccgccaccacgccgagtgcctgcggccccgctgccaggcctgtgatgagatcatcttctccccagaatgtacagaagctgagggccgccactggcacatggaccacttctgctgctttgaatgtgaggccagcctgggcggccagagatatgtgatgaggcagagccggccccactgctgtgcctgctatgaggcccggcatgctgagtactgtgatggctgtggggagcacatcggcctggaccagggccagatggcctatgagggccagcactggcacgccagtgaccgctgcttctgctgcagccgctgtggccgggccctgctgggccggcccttcctgccccggcggggcctcatcttctgcagccgggcctgcagcctgggcagcgagcccacagcccctggccccagccgccgctcctggagcgctggccctgtgacagcccccctggccgccagcacagccagcttctctgctgtgaagggggccagcgagaccaccaccaagggcaccagcacagagctggccccagccactggacctgaggagcccagccgcttcctgcggggggccccccaccgccacagcatgcctgagctgggcctgcggtctgtgcctgagcccccacctgagagccctggccagcccaacctgcggccagatgattctgccttcggccggcagagcaccccccgggtgtccttccgggaccccctggtgtctgagggcggccccaggaggaccctgagcgcccccccagcccagaggagaagacccaggagccccccaccccgggcccccagcagaagaagacaccaccaccacaaccaccaccaccaccacaacagacaccccagcagaagaagacactaccagtgtgatgctggcagcggcagtgacagcgagagctgcagcagcagccccagcagcagcagcagcgagagcagtgaagatgatggcttcttcctgggggagcgcatccccctgcccccccacctgtgccggcccatgcctgcccaggacacagccatggagaccttcaacagccccagcctgagcctgccccgggacagccgggccggcatgccccggcaggcccgggacaagaactgcatcgtggcctag

SEQ ID NO: 40983 - DNA, 1605 bp, Artificial Sequence
  Description of Artificial Sequence: Synthetic coding sequence
atgtgccgcctcatcagtgacttccagaggcacagcatcagtgatgatgacagcggctgtgccagcgaggagtatgcctgggtgcccccaggcctgaagccagagcaggtgacccggggccagcccagcaccctggccgtgcagtgggtgcacaccaatgcccacacccacacccacacccaggcccagtactgcacagccctggaggaggaggagaagaaggagctgcgggccttcagccagcagaggaagcgggagaacctgggccggggcatcgtgcgcatcttccctgtgaccatcactggagccatctgtgaagaatgtgggaagcagatcggcggcggggacattgctgtgtttgccagccgggccggcctgggcgcctgctggcacccccagtgctttgtgtgcaccacctgccaggagctgctggtggacctgatctacttctaccacgtgggcaaggtgtactgcggccgccaccacgccgagtgcctgcggccccgctgccaggcctgtgatgagatcatcttctccccagaatgtacagaagctgagggccgccactggcacatggaccacttctgctgctttgaatgtgaggccagcctgggcggccagagatatgtgatgaggcagagccggccccactgctgtgcctgctatgaggcccggcatgctgagtactgtgatggctgtggggagcacatcggcctggaccagggccagatggcctatgagggccagcactggcacgccagtgaccgctgcttctgctgcagccgctgtggccgggccctgctgggccggcccttcctgccccggcggggcctcatcttctgcagccgggcctgcagcctgggcagcgagcccacagcccctggccccagccgccgctcctggagcgctggccctgtgacagcccccctggccgccagcacagccagcttctctgctgtgaagggggccagcgagaccaccaccaagggcaccagcacagagctggccccagccactggacctgaggagcccagccgcttcctgcggggggccccccaccgccacagcatgcctgagctgggcctgcggtctgtgcctgagcccccacctgagagccctggccagcccaacctgcggccagatgattctgccttcggccggcagagcaccccccgggtgtccttccgggaccccctggtgtctgagggcggccccaggaggaccctgagcgcccccccagcccagaggagaagacccaggagccccccaccccgggcccccagcagaagaagacaccaccaccacaaccaccaccaccaccacaacagacaccccagcagaagaagacactaccagtgtgatgctggcagcggcagtgacagcgagagctgcagcagcagccccagcagcagcagcagcgagagcagtgaagatgatggcttcttcctgggggagcgcatccccctgcccccccacctgtgccggcccatgcctgcccaggacacagccatggagaccttcaacagccccagcctgagcctgccccgggacagccgggccggcatgccccggcaggcccgggacaagaactgcatcgtggcctag

SEQ ID NO: 40984 - DNA, 1320 bp, Artificial Sequence
  Description of Artificial Sequence: Synthetic coding sequence
atgtttgcccggggcagcagaagaagaagaagtggccgggcccctcctgaggctgaagatcctgaccggggccagccctgcaacagctgccgggagcagtgccccggcttcctgctgcacggctggaggaagatctgccagcactgcaagtgcccccgggaggagcacgctgtgcatgctgtgcctgtggacctggagcgcatcatgtgccgcctcatcagtgacttccagaggcacagcatcagtgatgatgacagcggctgtgccagcgaggagtatgcctgggtgcccccaggcctgaagccagagcaggtgacccggggccagcccagcaccctggccgtgcagtgggtgcacaccaatgcccacacccacacccacacccaggcccagtactgcacagccctggaggaggaggagaagaaggagctgcgggccttcagccagcagaggaagcgggagaacctgggccggggcatcgtgcgcatcttccctgtgaccatcactggagccatctgtgaagaatgtgggaagcagatcggcggcggggacattgctgtgtttgccagccgggccggcctgggcgcctgctggcacccccagtgctttgtgtgcaccacctgccaggagctgctggtggacctgatctacttctaccacgtgggcaaggtgtactgcggccgccaccacgccgagtgcctgcggccccgctgccaggcctgtgatgagatcatcttctccccagaatgtaccccaggcccccggcccggccctgaggagcccagccgcttcctgcggggggccccccaccgccacagcatgcctgagctgggcctgcggtctgtgcctgagcccccacctgagagccctggccagcccaacctgcggccagatgacagcgccttcggccggcagagcaccccccgggtgtccttccgggaccccctggtgtctgagggcggccccaggaggaccctgagcgcccccccagcccagaggagaagaagacaccaccaccacaaccaccaccaccaccacaacagacaccccagcagaagaagacactaccagtgtgatgctggcagcggcagtgacagcgagagctgcagcagcagccccagcagcagcagcagcgagagcagtgaagatgatggcttcttcctgggggagcgcatccccctgcccccccacctgtgccggcccatgcctgcccaggacacagccatggagaccttcaacagccccagcctgagcctgccccgggacagcagagctggcatgccccggcaggcccgggacaagaactgcatcgtggcctag

SEQ ID NO: 40985 - DNA, 1644 bp, Artificial Sequence
  Description of Artificial Sequence: Synthetic coding sequence
atgtgccgcctcatcagtgacttccagaggcacagcatcagtgatgatgacagcggctgtgccagcgaggagtatgcctgggtgcccccaggcctgaagccagagcaggtgtaccagttcttcagctgcctgcctgaggacaaggtgccctacgtgaacagccctggagagaagtaccgcatcaagcagctgctgcaccagctgccccctcatgattctgaggcccagtactgcacagccctggaggaggaggagaagaaggagctgcgggccttcagccagcagaggaagcgggagaacctgggccggggcatcgtgcgcatcttccctgtgaccatcaccggggccatctgtgaggagtgtgggaagcagattggaggaggagacattgctgtgtttgccagcagagctggcctgggcgcctgctggcacccccagtgctttgtgtgcaccacctgccaggagctgctggtggacctgatctacttctaccacgtgggcaaggtgtactgcggccgccaccacgcagaatgtctgcggccccgctgccaggcctgtgatgagatcatcttcagccctgagtgcacagaggccgagggccgccactggcacatggaccacttctgctgctttgaatgtgaggccagcctgggcggccagcgctacgtgatgaggcagagccggccccactgctgtgcctgctatgaggcccggcatgctgagtactgtgatggctgtggggagcacatcggcctggaccagggccagatggcctatgagggccagcactggcacgccagtgaccgctgcttctgctgcagccgctgtggccgggccctgctgggccggcccttcctgccccggcggggcctcatcttctgcagccgggcctgcagcctgggcagcgagcccacagcccctggccccagcagaagatcctggagcgctggccctgtgacagcccccctggccgccagcacagccagcttctctgctgtgaagggggccagcgagaccaccaccaagggcaccagcacagagctggccccagccaccggccctgaggagcccagccgcttcctgcggggggccccccaccgccacagcatgcctgagctgggcctgcggtctgtgcctgagcccccacctgagagccctggccagcccaacctgcggccagatgacagcgccttcggccggcagagcaccccccgggtgtccttccgggaccccctggtgtctgagggcggccccaggaggaccctgagcgcccccccagcccagaggcggcggcccaggagccccccaccccgggcccccagcagaagaagacaccaccaccacaaccaccaccaccaccacaacagacaccccagcagaagaagacactaccagtgtgatgctggcagcggcagtgacagcgagagctgcagcagcagccccagcagcagcagcagcgagagcagtgaagatgatggcttcttcctgggggagcgcatccccctgcccccccacctgtgccggcccatgcctgcccaggacacagccatggagaccttcaacagccccagcctgagcctgccccgggacagcagagctggcatgccccggcaggcccgggacaagaactgcatcgtggcctag

SEQ ID NO: 40986 - DNA, 1665 bp, Artificial Sequence
  Description of Artificial Sequence: Synthetic coding sequence
atgcacatcaacttccaccggcccccagccaagcccaagccccagaaggtgaaggagattgagtaccagaacctgcgcttccctgtggacctgagcaacccctttgctgtggccaccgtgctgaaccaggagcccgggaagctgaagatcaaggagctgcgggaggtgctggaccagggcacagagatcagcaagacccggcagatgaaggaggccctgtttgagcagaaggtgcggcaggacatccacgaggagatggagaaccacctgaagtggcaggtgcacctgggcaaggaccccatgtccttcaagctgaagaaggagctgacagaggagtggcagaaggcctgtgccaagtacaagctggacagaggagaccccatcctggatgaggagttccagaggctgaagacagaggtgagccacaagagggtggtgaggaaccaggaggagaagatcaaggagttccaccccacctttgaccccctcatcaacaacacctggctgagccgcagccgggcccagaagcgcttccagcaggtggccaggaaggtgatgatccagggccgcctcttcaacatgctgtctgctgtgcgggagatggacaaggagagcatcctgaggaagattggccaggccaagcagagcatcgcccaggaggccaacttcttcaagttcttcctgcggcgcatcagccaggatgactacaccagccgcttctctgtgagccccaaggaggtgctgccctttgccttcccagactgcagccccccccaggacagcaatgagctggccccagatggcctgggcctggtgcccatcaagagcagcgaggtgcagatcaagcagagctacagcttcttcaacctgcaggtgccccagctgtacaagatcaagcgctaccagcccttctctgtgcacaagagcagcaccagctaccggccccagaagctggcccgggccctgaagcagggcgcagaagatgaggtgaccaccatcacagccctgcccaagcaggacagcaccacccagctgagcggcaagacctctgtgctgtccatgaagcccccagaggccctggccatgagcctggactatgaccccctgtatgtgttcaaccccaaccctggcctgtttgctgtgatgcaccccctgacctacgccgagaccctgattgactaccacctgtgcagccaccccaagtacaagttcaccaaggagagccgccacggcagcagcatccctgtgacccagaagcagttcctgcaccacacagacatcatccctggcatcatgcactggaagagcttccagagcctggtgctgagcagcctgcctgaccccagcaagatggagaccaccaagagctgtgacagcttcaacagcttcatgctgcccattgatgtgcctgccatcctggatgccctgcctgaagaagatcggctggagaccgtggagcgggagctgtgtgagcagaatgtggaggtgatgctgaccccagagatgatcaaggtggagttccccatgctgaactacaaggacatcaggaaggagaaggaggtgaaggaccaggcccagcctgctgagaaggccggggagaagctgctggaggagatgaggaacctgcggggcaaggccctgaacacctacctgatcctggagtag

SEQ ID NO: 40987 - DNA, 2523 bp, Artificial Sequence
  Description of Artificial Sequence: Synthetic coding sequence
atggctgtggtgaagacccccagccggggcctgaagaatgccaaggagcccttcaacaatgccagcccccacctgctgaagaacctggtggaggagcccaagaagaggaaggaggtgcccaaccacctgctggagagcaaggtgtatgccaagctggtgaacaacaaggtgatccaggcccggcccggcatcatccactttggaggctaccaggtggagaagcagcaccagcagatcctgcacctggtgaatgtgtccaatgaagacaccagggtgcacatcctgcccccccagaccaagtactttgagatcaactacgtgaggaaggagcaccacctggtgcccggcctgagcctgactgtgacagtgaccttctccccagatgagtggagatactactatgactgcatccgggtgcactgcaagggagatgacaccctgctggtgcccatccacgcctaccctgtgatgaacagcctggacttccccagcttcatcaacctgagcaatgtgctgctgggggagagcaagacctacgtgatccccctgcagtgcagctgccctgtggactttgagttctacatcaccctcatccagagccaccaggcctttgccatcgagcccaccagcggcatcatcccagccaacgggaagatgacagtgaccatcaagttcacccccttccagtatggaacagcccagatcaagatgcagctgtggatcagccagttcaacagccagccctatgaatgtgtgttcaccggcacctgctaccccaacatggccctgcccctggaggagtttgagcggctgaacaccctgagcaagaaggtgaatgtgcccccagagaaggccatgatgcacatcaacttccaccggcccccagccaagcccaagccccagaaggtgaaggagattgagtaccagaacctgcgcttccctgtggacctgagcaacccctttgctgtggccaccgtgctgaaccaggagcccgggaagctgaagatcaaggagctgcgggaggtgctggaccagggcacagagatcagcaagacccggcagatgaaggaggccctgtttgagcagaaggtgcggcaggacatccacgaggagatggagaaccacctgaagtggcaggtgcacctgggcaaggaccccatgtccttcaagctgaagaaggagctgacagaggagtggcagaaggcctgtgccaagtacaagctggacagaggagaccccatcctggatgaggagttccagaggctgaagacagaggtgagccacaagagggtggtgaggaaccaggaggagaagatcaaggagttccaccccacctttgaccccctcatcaacaacacctggctgagccgcagccgggcccagaagcgcttccagcaggtggccaggaaggtgatgatccagggccgcctcttcaacatgctgtctgctgtgcgggagatggacaaggagagcatcctgaggaagattggccaggccaagcagagcatcgcccaggaggccaacttcttcaagttcttcctgcggcgcatcagccaggatgactacaccagccgcttctctgtgagccccaaggaggtgctgccctttgccttcccagactgcagccccccccaggacagcaatgagctggccccagatggcctgggcctggtgcccatcaagagcagcgaggtgcagatcaagcagagctacagcttcttcaacctgcaggtgccccagctgtacaagatcaagcgctaccagcccttctctgtgcacaagagcagcaccagctaccggccccagaagctggcccgggccctgaagcagggcgcagaagatgaggtgaccaccatcacagccctgcccaagcaggacagcaccacccagctgagcggcaagacctctgtgctgtccatgaagcccccagaggccctggccatgagcctggactatgaccccctgtatgtgttcaaccccaaccctggcctgtttgctgtgatgcaccccctgacctacgccgagaccctgattgactaccacctgtgcagccaccccaagtacaagttcaccaaggagagccgccacggcagcagcatccctgtgacccagaagcagttcctgcaccacacagacatcatccctggcatcatgcactggaagagcttccagagcctggtgctgagcagcctgcctgaccccagcaagatggagaccaccaagagctgtgacagcttcaacagcttcatgctgcccattgatgtgcctgccatcctggatgccctgcctgaagaagatcggctggagaccgtggagcgggagctgtgtgagcagaatgtggaggtgatgctgaccccagagatgatcaaggtggagttccccatgctgaactacaaggacatcaggaaggagaaggaggtgaaggaccaggcccagcctgctgagaaggccggggagaagctgctggaggagatgaggaacctgcggggcaaggccctgaacacctacctgatcctggagtag

SEQ ID NO: 40988 - DNA, 564 bp, Artificial Sequence
  Description of Artificial Sequence: Synthetic coding sequence
atggctgtggtgaagacccccagccggggcctgaagaatgccaaggagcccttcaacaatgccagcccccacctgctgaagaacctggtggaggagcccaagaagaggaaggaggtgcccaaccacctgctggagagcaaggtgtatgccaagctggtgaacaacaaggtgatccaggcccggcccggcatcatccactttggaggctaccaggtggagaagcagcaccagcagatcctgcacctggtgaatgtgtccaatgaagacaccagggtgcacatcctgcccccccagaccaagtactttgagatcaactacgtgaggaaggagcaccacctggtgcccggcctgagcctgactgtgacagtgaccttctccccagatgagtggagatactactatgactgcatccgggtgcactgcaagggagatgacaccctgctggtgcccatccacgcctaccctgtgatgaacagcctggacttccccagcttcatcaacctgagcaatgtgctgctgggggagagcctgcccaacagcgtcttcctggtgcctgacaactag

SEQ ID NO: 40989 - DNA, 1200 bp, Artificial Sequence
  Description of Artificial Sequence: Synthetic coding sequence
tgacaccccacctttgaccccctcatcaacaacacctggctgagccgcagccgggcccagaagcgcttccagcaggtggccaggaaggtgatgatccagggccgcctcttcaacatgctgtctgctgtgcgggagatggacaaggagagcatcctgaggaagattggccaggccaagcagagcatcgcccaggaggccaacttcttcaagttcttcctgcggcgcatcagccaggatgactacaccagccgcttctctgtgagccccaaggaggtgctgccctttgccttcccagactgcagccccccccaggacagcaatgagctggccccagatggcctgggcctggtgcccatcaagagcagcgaggtgcagatcaagcagagctacagcttcttcaacctgcaggtgccccagctgtacaagatcaagcgctaccagcccttctctgtgcacaagagcagcaccagctaccggccccagaagctggcccgggccctgaagcagggcgcagaagatgaggtgaccaccatcacagccctgcccaagcaggacagcaccacccagctgagcggcaagacctctgtgctgtccatgaagcccccagaggccctggccatgagcctggactatgaccccctgtatgtgttcaaccccaaccctggcctgtttgctgtgatgcaccccctgacctatgcagagaccctgattgactaccacctgtgcagccaccccaagtacaagttcaccaaggagagcagacatggcagcagcatccctgtgacccagaagcagttcctgcaccacacagacatcatccctggcatcatgcactggaagagcttccagagcctggtgctgagcagcctgcctgaccccagcaagatggagaccaccaagagctgtgacagcttcaacagcttcatgctgcccattgatgtgcctgccatcctggatgccctgcctgaggaggaccggctggagaccgtggagcgggagctgtgtgagcagaatgtggaggtgatgctgaccccagagatgatcaaggtggagttccccatgctgaactacaaggacatcaggaaggagaaggaggtgaaggaccaggcccagcctgctgagaaggccggggagaagctgctggaggagatgaggaacctgcggggcaaggccctgaacacctacctgatcctggagtag

SEQ ID NO: 40990 - DNA, 1665 bp, Artificial Sequence; identical to SEQ ID NO: 40986
  Description of Artificial Sequence: Synthetic coding sequence

SEQ ID NO: 40991 - DNA, 555 bp, Artificial Sequence
  Description of Artificial Sequence: Synthetic coding sequence
atggccagccctgctgccagctctgtgcggcccccccggcccaagaaggagccccagaccctggtgatccccaagaatgctgctgaggagcagaagctgaagctggagcggctgatgaagaacccagacaaggctgtgcccatccctgagaagatgtctgagtgggcccccaggcctcctcctgagtttgtgagagatgtgatgggcagcagcgctggggccggcagcggggagttccacgtgtaccgccacctgcggcggcgggagtaccagaggcaggactacatggatgccatggccgagaagcagaagctggatgctgagttccagaagaggctggagaagaacaagattgctgctgaggagcagacagccaagaggaggaagaagaggcagaagctgaaggagaagaagctgctggccaagaagatgaagctggagcagaagaagcaggagggccctggccagcccaaggagcagggcagcagcagcagcgctgaggccagcggcacagaggaggaggaggaggtgcccagcttcaccatgggccgctag

SEQ ID NO: 40992 - DNA, 786 bp, Artificial Sequence
  Description of Artificial Sequence: Synthetic coding sequence
atggcccagaacctgaaggacctggccggccgcctgcctgctggcccccggggcatgggcacagccctgaagctgctgctgggcgctggagctgtggcctacggcgtgcgggagagcgtcttcaccgtggagggcggccaccgggccatcttcttcaacagaattggaggagtgcagcaggacaccatcctggccgagggcctgcacttccgcatcccctggttccagtaccccatcatctatgacatccgggcccggcccaggaagatcagcagccccaccggcagcaaggacctgcagatggtgaacatcagcctgcgggtgctgagccggcccaatgcccaggagctgcccagcatgtaccagaggctgggcctggactatgaggagcgggtgctgcccagcatcgtgaatgaggtgctgaagtctgtggtggccaagttcaatgccagccagctgatcacccagagggcccaggtgtccctgctgatcagaagagagctgacagagcgggccaaggacttcagcctcatcctggatgatgtggccatcacagagctgtccttcagccgggagtacacagctgctgtggaggccaagcaggtggccctgagcaagaaccctggctacatcaagctgaggaagatccgggccgcccagaacatcagcaagaccatcgccaccagccagaaccgcatctacctgacagctgacaacctggtgctgaacctgcaggatgagagcttcacccggggcagtgacagcctcatcaagggcaagaagtag

SEQ ID NO: 40993 - DNA, 2769 bp, Artificial Sequence
  Description of Artificial Sequence: Synthetic coding sequence
atggacaagaagagctttgagatggtgctggatgagatcaggaaggtggtggacctgctgcgctacttctcctgggccgagccccagctgaaggccatgaaggccctgcagcacaagatggtggccgtgcagcccacagaggtggtgaacatcctgaactgcttcaccttcagcaaggacaagctggtggccctggagctgctggccagcaacatcattgatgcccagaacagccggcccatcgaggacctcttccgggtgaacatgtctgagaagaagcgctgcaagaggatcctggagcaggccttcaagggcggctgcaaggcccctcatgccatgatcagcagctgtggcaccatccctggcaacccctaccccaagggccggcccagccgcatcaatggcatcttccctggcacccccctgaagaaggatggagaggagtgcaccaatgaaggcaagggcattgctgcccgcatcctgggccccagcaagcccccacccagcacctacaacccccacaagcctgtgccctaccccatccccccctgccggccccacgccaccatcgcccccagcgcctacaacaatgccggcctggtgcccctggccaacgtgattgcccctcctcctccaccctacacccccaaccctgtgggcacagaaaatgaagacctgagcaaccccagcaagcccatccagaaccagaccttcagcaccccagccagccagctgttcagcccccacggcagcaaccccagcaccccagctgccacccctgtgcccacagccagccctgtgaaggccatcaaccaccccagcgccagcgctgctgccaccgtgtctggcatgaacctgctgaacacagtgctgcccgtcttccctggccaggtgagcagcgctgtgcacaccccccagcccagcatccccaaccccaccgtcatccgcacccccagcctgcccacagcccctgtgaccagcatccacagcaccaccaccacccctgtgcccagcatcttcagcggcctggtgtccctgcccggccccagcgccacccccacagctgccacccccaccccaggccccacccccaggagcaccctgggcagcagcgaggcctttgccagcaccagcgcccccttcaccagcctgcccttcagcaccagcagcagcgctgccagcaccagcaaccccaacagcgccagcctgagctctgtgtttgctggcctgcccctgcccctgccccccaccagccagggcctgagcaaccccacccctgtgattgctgggggcagcaccccatctgtggccggccccctgggcgtgaacagccccctgctgagcgccctgaagggcttcctgaccagcaatgacaccaacctgatcaacagcagcgccctgagcagcgctgtgaccagcggcctggccagcctgagcagcctgaccctgcagaacagcgacagcagcgccagcgcccccaacaagtgctacgcccccagcgccatccccaccccccagaggaccagcaccccaggcctggccctcttccctggcctgcccagccctgtggccaacagcaccagcacccccctgaccctgcctgtgcagagccccctggccacagctgccagcgccagcacctctgtgcctgtgtcctgtggcagcagcgccagcctgctgcggggcccccaccctggcaccagtgacctgcacatcagcagcaccccagctgccaccaccctgcctgtgatgatcaagacagagcccaccagccccaccccatctgccttcaagggccccagccacagcggcaaccccagccacggcaccctgggcctgagcggcaccctgggccgggcctacaccagcacctctgtgcccatcagcctgagcgcctgcctgaacccagccctgagcggcctgagcagcctgagcacccccctgaatggcagcaaccccctgagcagcatcagcctgcccccccacggcagcagcacccccatcgcccctgtgttcaccgccctgcccagcttcaccagcctgaccaacaacttccccctgaccggcaaccccagcctgaaccccagcgtgtccctgcccggcagcctcatcgccaccagcagcacagctgccaccagcaccagcctgccccaccccagcagcacagctgctgtgctgagcggcctgagcgccagcgcccctgtgtctgctgcccccttccccctgaacctgagcacagctgtgcccagcctcttctctgtgacccagggccccctgagcagcagcaaccccagctacccaggcttctctgtgagcaacacccccagcgtgaccccagccctgcccagcttccctggcctgcaggcccccagcacagtggccgctgtgacccccctgcctgtggccgccacagcccccagccctgcccctgtgctgcccggctttgccagcgccttcagcagcaacttcaacagcgccctggtggcccaggccggcctgagcagcggcctgcaggccgccggcagctctgtgtttcctggcctgctgagcctgcccggcatccctggcttcccccagaaccccagccagagcagcctgcaggagctgcagcacaatgctgctgcccagagcgccctgctgcagcaggtgcacagcgccagcgccctggagagctacccagcccagccagatggcttccccagctaccccagcgcccctggcacccccttcagcctgcagcccagcctgagccagagcggctggcagtag

SEQ ID NO: 40994 - DNA, 2835 bp, Artificial Sequence
  Description of Artificial Sequence: Synthetic coding sequence
atggacaagaagagctttgagatggtgctggatgagatcaggaaggctgtgctgacagagtacaagctgaaggccatcgagtatgtgcacggctacttcagcagcgagcaggtggtggacctgctgcgctacttctcctgggccgagccccagctgaaggccatgaaggccctgcagcacaagatggtggccgtgcagcccacagaggtggtgaacatcctgaactgcttcaccttcagcaaggacaagctggtggccctggagctgctggccagcaacatcattgatgcccagaacagccggcccatcgaggacctcttccgggtgaacatgtctgagaagaagcgctgcaagaggatcctggagcaggccttcaagggcggctgcaaggcccctcatgccatgatcagcagctgtggcaccatccctggcaacccctaccccaagggccggcccagccgcatcaatggcatcttccctggcacccccctgaagaaggatggagaggagtgcaccaatgaaggcaagggcattgctgcccgcatcctgggccccagcaagcccccacccagcacctacaacccccacaagcctgtgccctaccccatccccccctgccggccccacgccaccatcgcccccagcgcctacaacaatgccggcctggtgcccctggccaacgtgattgcccctcctcctccaccctacacccccaaccctgtgggcacagaaaatgaagacctgagcaaccccagcaagcccatccagaaccagaccttcagcaccccagccagccagctgttcagcccccacggcagcaaccccagcaccccagctgccacccctgtgcccacagccagccctgtgaaggccatcaaccaccccagcgccagcgctgctgccaccgtgtctggcatgaacctgctgaacacagtgctgcccgtcttccctggccaggtgagcagcgctgtgcacaccccccagcccagcatccccaaccccaccgtcatccgcacccccagcctgcccacagcccctgtgaccagcatccacagcaccaccaccacccctgtgcccagcatcttcagcggcctggtgtccctgcccggccccagcgccacccccacagctgccacccccaccccaggccccacccccaggagcaccctgggcagcagcgaggcctttgccagcaccagcgcccccttcaccagcctgcccttcagcaccagcagcagcgctgccagcaccagcaaccccaacagcgccagcctgagctctgtgtttgctggcctgcccctgcccctgccccccaccagccagggcctgagcaaccccacccctgtgattgctgggggcagcaccccatctgtggccggccccctgggcgtgaacagccccctgctgagcgccctgaagggcttcctgaccagcaatgacaccaacctgatcaacagcagcgccctgagcagcgctgtgaccagcggcctggccagcctgagcagcctgaccctgcagaacagcgacagcagcgccagcgcccccaacaagtgctacgcccccagcgccatccccaccccccagaggaccagcaccccaggcctggccctcttccctggcctgcccagccctgtggccaacagcaccagcacccccctgaccctgcctgtgcagagccccctggccacagctgccagcgccagcacctctgtgcctgtgtcctgtggcagcagcgccagcctgctgcggggcccccaccctggcaccagtgacctgcacatcagcagcaccccagctgccaccaccctgcctgtgatgatcaagacagagcccaccagccccaccccatctgccttcaagggccccagccacagcggcaaccccagccacggcaccctgggcctgagcggcaccctgggccgggcctacaccagcacctctgtgcccatcagcctgagcgcctgcctgaacccagccctgagcggcctgagcagcctgagcacccccctgaatggcagcaaccccctgagcagcatcagcctgcccccccacggcagcagcacccccatcgcccctgtgttcaccgccctgcccagcttcaccagcctgaccaacaacttccccctgaccggcaaccccagcctgaaccccagcgtgtccctgcccggcagcctcatcgccaccagcagcacagctgccaccagcaccagcctgccccaccccagcagcacagctgctgtgctgagcggcctgagcgccagcgcccctgtgtctgctgcccccttccccctgaacctgagcacagctgtgcccagcctcttctctgtgacccagggccccctgagcagcagcaaccccagctacccaggcttctctgtgagcaacacccccagcgtgaccccagccctgcccagcttccctggcctgcaggcccccagcacagtggccgctgtgacccccctgcctgtggccgccacagcccccagccctgcccctgtgctgcccggctttgccagcgccttcagcagcaacttcaacagcgccctggtggcccaggccggcctgagcagcggcctgcaggccgccggcagctctgtgtttcctggcctgctgagcctgcccggcatccctggcttcccccagaaccccagccagagcagcctgcaggagctgcagcacaatgctgctgcccagagcgccctgctgcagcaggtgcacagcgccagcgccctggagagctacccagcccagccagatggcttccccagctaccccagcgcccctggcacccccttcagcctgcagcccagcctgagccagagcggctggcagtag

SEQ ID NO: 40995 - DNA, 3123 bp, Artificial Sequence
  Description of Artificial Sequence: Synthetic coding sequence
atggctgctgctgtgctgagcggccccagcgctggcagcgctgctggggtgcctgggggcactggaggcctgtctgctgtgagcagcggcccccggctgcggctgctgctgctggagagcgtgtctggcctgctgcagcccaggactggatctgctgtggcccctgtgcacccccccaacagaagtgccccccacctgcccggcctgatgtgcctgctgcggctgcacggctctgtgggcggggcccagaacctgagcgccctgggcgccctggtgtccctgagcaatgcccggctgagcagcatcaagaccaggtttgagggcctgtgcctgctgagcctgctggtgggggagagccccacagagctgttccagcagcactgtgtgtcctggctgcggagcatccagcaggtgctgcagacccaggaccccccagccaccatggagctggccgtggccgtgctgcgggacctgctgcgctatgctgcccagctgcctgccctcttccgggacatctccatgaaccacctgcccggcctgctgaccagcctgctgggcctgcggccagaatgtgagcagagcgccctggagggcatgaaggcctgcatgacctacttcccccgggcctgtggcagcctgaagggcaagctggccagcttcttcctgagccgggtggatgccctgagcccccagctgcagcagctggcctgtgagtgctacagccggctgcccagcctgggcgccggcttcagccagggcctgaagcacacagagagctgggagcaggagctgcacagcctgctggccagcctgcacaccctgctgggcgccctgtatgaaggagctgagacagcccctgtgcagaatgaaggacctggggtggagatgctgctgagcagtgaagatggagatgcccacgtgctgctgcagctgcggcagcgcttcagcggcctggcccgctgcctgggcctgatgctgagcagcgagtttggagcccctgtgtctgtgcctgtgcaggagatcctggacttcatctgcaggaccctgtctgtgagcagcaagaacatcagcctgcatggagacccctgtggctgctgctgctgccccctgagcaccctggccctggacctgctgagcgccctgatcctggcctgtggcagccggctgctgcgcttcggcatcctgattggccgcctgctgccccaggtgctgaacagctggagcatcggccgggacagcctgagccctggccaggagcggccctacagcacagtgaggaccaaggtgtatgccatcctggagctgtgggtgcaggtgtgtggggccagcgctggcatgctgcagggcggggccagcggggaggccctgctgacccacctgctgagtgacatcagccccccagcagatgccctgaagctgcggagcccccggggcagcccagatggcagcctgcagacaggcaagcccagcgcccccaagaagctgaagctggatgtgggggaggccatggccccacccagccaccggctgctgcctgtgccctgcaagcccagccccagcgccagcgagaagatcgccctgcggagccccctgtgcagcgaggccctggtgacctgtgccgccctgacccacccccgggtgccccccctgcagcccatgggccccacctgccccaccccagcccctgtgcccctgcggccccaccggcccagcggcccccacaggagcatcctgcgggccccctgcccccagtgggccccctgcccccagcaggccccctgcagcgctggccccatgcccagcgctggccctgtgcccagcgcccggcccggcccccccaccacagccaaccacctgggcctgtctgtgcccggcctggtgtctgtgcccccccggctgctgcccggccctgagaaccaccgggccggcagcaatgaagaccccatcctggcccccagcggcaccccaccacccaccatccccccagatgagaccttcggcggccgggtgcccaggcctgcctttgtgcactatgacaaggaggaggccagtgatgtggagatcagcctggagagtgacagtgatgattctgtggtgattgtgcctgagggcctgccccccctgcccccacctccacccagcggggccaccccaccacccatcgcccccaccggccccccaacagccagcccccctgtgcctgccaaggaggagcctgaggagctgcctgctgcccctggccccctgcccccacctcctcctcctcctcctcctgtgcccggccctgtgaccctgcccccaccccagctggtgcctgagggcacccctgggggcggcggccccccagccctggaggaggacctgaccgtcatcaacatcaacagcagtgatgaggaggaggaggaggaggaggaggaggaggaggaggaggaggaggaggaggaggaggaggaggactttgaggaggaggaggaggatgaggaggagtactttgaggaggaggaggaggaggaggaggagtttgaggaggagtttgaggaggaggagggggagctggaggaggaggaggaggaggaggatgaggaggaggaggaggagctggaggaggtggaggacctggagtttggaacagctggaggagaggtggaggagggcgcccctcctccacccaccctgcccccagccctgcccccacctgagagcccccccaaggtgcagcctgagcctgagcctgagcccggcctgctgctggaggtggaggagcccggcacagaggaggagagaggagctgacacagcccccaccctggcccctgaggccctgcccagccagggcgaggtggagcgggagggggagagccctgctgctggccccccaccccaggagctggtggaggaggagcccagcgccccacccaccctgctggaggaggagacagaagatggcagtgacaaggtgcagcccccacctgagaccccagctgaggaggagatggagacagaaacagaggccgaggccctgcaggagaaggagcaggatgacacagctgccatgctggccgacttcatcgactgccccccagatgatgagaagcccccaccacccacagagccagacagctag

SEQ ID NO: 40996 - DNA, 3825 bp, Artificial Sequence
  Description of Artificial Sequence: Synthetic coding sequence
atggctgctgctgtgctgagcggccccagcgctggcagcgctgctggggtgcctgggggcactggaggcctgtctgctgtgagcagcggcccccggctgcggctgctgctgctggagagcgtgtctggcctgctgcagcccaggactggatctgctgtggcccctgtgcacccccccaacagaagtgccccccacctgcccggcctgatgtgcctgctgcggctgcacggctctgtgggcggggcccagaacctgagcgccctgggcgccctggtgtccctgagcaatgcccggctgagcagcatcaagaccaggtttgagggcctgtgcctgctgagcctgctggtgggggagagccccacagagctgttccagcagcactgtgtgtcctggctgcggagcatccagcaggtgctgcagacccaggaccccccagccaccatggagctggccgtggccgtgctgcgggacctgctgcgctatgctgcccagctgcctgccctcttccgggacatctccatgaaccacctgcccggcctgctgaccagcctgctgggcctgcggccagaatgtgagcagagcgccctggagggcatgaaggcctgcatgacctacttcccccgggcctgtggcagcctgaagggcaagctggccagcttcttcctgagccgggtggatgccctgagcccccagctgcagcagctggcctgtgagtgctacagccggctgcccagcctgggcgccggcttcagccagggcctgaagcacacagagagctgggagcaggagctgcacagcctgctggccagcctgcacaccctgctgggcgccctgtatgaaggagctgagacagcccctgtgcagaatgaaggacctggggtggagatgctgctgagcagtgaagatggagatgcccacgtgctgctgcagctgcggcagcgcttcagcggcctggcccgctgcctgggcctgatgctgagcagcgagtttggagcccctgtgtctgtgcctgtgcaggagatcctggacttcatctgcaggaccctgtctgtgagcagcaagaacatcgtgtctggcatctgccacctgttccgggccctggcccaggacacccggcagcccgggaagtactggggccctgagagcccccagacagtgtcctcctggagccggccccgggagctgcccacctttgtgcagatcaccagcctgcccatgtgccgggacaccggggcccagtgccagagcgtggccaatgccagcctgggggagggggagtttggagatgctgagagcctgctgcggggccctgccatcctgctgaccttccaccctggcagcatcctggaggaccggggcctcatcctgctgggggagctgcggtctggagtgggcttcctgacctacgtgtacatctgcaagtggagcttccctgtgtctgtgtccctgtggctgagcctgagcagcagcaccctgtacctgtgccccttcttcctgcagagcctgcatggagatggccccctgcggctgctgctgctgcccagcatccacctggaggccctggacctgctgagcgccctgatcctggcctgtggcagccggctgctgcgcttcggcatcctgattggccgcctgctgccccaggtgctgaacagctggagcatcggccgggacagcctgagccctggccaggagcggccctacagcacagtgaggaccaaggtgtatgccatcctggagctgtgggtgcaggtgtgtggggccagcgctggcatgctgcagggcggggccagcggggaggccctgctgacccacctgctgagtgacatcagccccccagcagatgccctgaagctgcggagcccccggggcagcccagatggcagcctgcagacaggcaagcccagcgcccccaagaagctgaagctggatgtgggggaggccatggccccacccagccacaggaagggggacagcaatgccaacagtgatgtgtgtgccgccgccctgcggggcctgagcaggaccatcctgatgtgtggccccctcatcaaggaggagacccaccggcggctgcatgacctggtgctgcccctggtgatgggcgtgcagcagggcgaggtgctgggcagcagcccctacaccagcagccgctgccggcgggagctgtactgcctgctgctggccctgctgctggcccccagcccccgctgccccccacccctggcctgtgccctgcaggccttcagcctgggccagcgggaggacagcctggaggtgagcagcttctgcagcgaggccctggtgacctgtgccgccctgacccacccccgggtgccccccctgcagcccatgggccccacctgccccaccccagcccctgtgcccccacctgaggcccccagccccttccgggccccacccttccaccccccaggccccatgcccagcgtgggctccatgcccagcgctggccccatgcccagcgctggccccatgcccagcgctggccctgtgcccagcgcccggcccggcccccccaccacagccaaccacctgggcctgtctgtgcccggcctggtgtctgtgcccccccggctgctgcccggccctgagaaccaccgggccggcagcaatgaagaccccatcctggcccccagcggcaccccaccacccaccatccccccagatgagaccttcggcggccgggtgcccaggcctgcctttgtgcactatgacaaggaggaggccagtgatgtggagatcagcctggagagtgacagtgatgattctgtggtgattgtgcctgagggcctgccccccctgcccccacctccacccagcggggccaccccaccacccatcgcccccaccggccccccaacagccagcccccctgtgcctgccaaggaggagcctgaggagctgcctgctgcccctggccccctgcccccacctcctcctcctcctcctcctgtgcccggccctgtgaccctgcccccaccccagctggtgcctgagggcacccctgggggcggcggccccccagccctggaggaggacctgaccgtcatcaacatcaacagcagtgatgaggaggaggaggaggaggaggaggaggaggaggaggaggaggaggaggaggaggaggaggaggactttgaggaggaggaggaggatgaggaggagtactttgaggaggaggaggaggaggaggaggagtttgaggaggagtttgaggaggaggagggggagctggaggaggaggaggaggaggaggatgaggaggaggaggaggagctggaggaggtggaggacctggagtttggaacagctggaggagaggtggaggagggcgcccctcctccacccaccctgcccccagccctgcccccacctgagagcccccccaaggtgcagcctgagcctgagcctgagcccggcctgctgctggaggtggaggagcccggcacagaggaggagagaggagctgacacagcccccaccctggcccctgaggccctgcccagccagggcgaggtggagcgggagggggagagccctgctgctggccccccaccccaggagctggtggaggaggagcccagcgccccacccaccctgctggaggaggagacagaagatggcagtgacaaggtgcagcccccacctgagaccccagctgaggaggagatggagacagaaacagaggccgaggccctgcaggagaaggagcaggatgacacagctgccatgctggccgacttcatcgactgccccccagatgatgagaagcccccaccacccacagagccagacagctag

SEQ ID NO: 40997 - DNA, 2721 bp, Artificial Sequence
  Description of Artificial Sequence: Synthetic coding sequence
atggagctggccgtggccgtgctgcgggacctgctgcgctatgctgcccagctgcctgccctcttccgggacatctccatgaaccacctgcccggcctgctgaccagcctgctgggcctgcggccagaatgtgagcagagcgccctggagggcatgaaggcctgcatgacctacttcccccgggcctgtggcagcctgaagggcaagctggccagcttcttcctgagccgggtggatgccctgagcccccagctgcagcagctggcctgtgagtgctacagccggctgcccagcctgggcgccggcttcagccagggcctgaagcacacagagagctgggagcaggagctgcacagcctgctggccagcctgcacaccctgctgggcgccctgtatgagggcgctgagacagcccctgtgcagaatgaaggacctggggtggagatgctgctgagcagtgaagatggagatgcccacgtgctgctgcagctgcggcagcgcttcagcggcctggcccgctgcctgggcctgatgctgagcagcgagtttggagcccctgtgtctgtgcctgtgcaggagatcctggacttcatctgcaggaccctgtctgtgagcagcaagaacatcagcctgcatggagatggccccctgcggctgctgctgctgcccagcatccacctggaggccctggacctgctgagcgccctgatcctggcctgtggcagccggctgctgcgcttcggcatcctgattggccgcctgctgccccaggtgctgaacagctggagcatcggccgggacagcctgagccctggccaggagcggccctacagcacagtgaggaccaaggtgtatgccatcctggagctgtgggtgcaggtgtgtggggccagcgctggcatgctgcagggcggggccagcggggaggccctgctgacccacctgctgagtgacatcagccccccagcagatgccctgaagctgcggagcccccggggcagcccagatggcagcctgcagacaggcaagcccagcgcccccaagaagctgaagctggatgtgggggaggccatggccccacccagccacaggaaaggagacagcaatgccaacagtgatgtgtgtgccgccgccctgcggggcctgagcaggaccatcctgatgtgtggccccctcatcaaggaggagacccaccggcggctgcatgacctggtgctgcccctggtgatgggcgtgcagcagggcgaggtgctgggcagcagcccctacaccagcagccgctgcagaagagagctgtactgcctgctgctggccctgctgctggcccccagcccccgctgccccccacccctggcctgtgccctgcaggccttcagcctgggccagcgggaggacagcctggaggtgtcctccttctgcagcgaggccctggtgacctgtgccgccctgacccacccccgggtgccccccctgcagcccatgggccccacctgccccaccccagcccctgtgcccccacctgaggcccccagccccttccgggccccacccttccaccccccaggccccatgcccagcgtgggctccatgcccagcgctggccccatgcccagcgctggccccatgcccagcgctggccctgtgcccagcgcccggcccggcccccccaccacagccaaccacctgggcctgtctgtgcccggcctggtgtctgtgcccccccggctgctgcccggccctgagaaccacagagctggcagcaatgaagaccccatcctggcccccagcggcaccccaccacccaccatccccccagatgagacctttggaggccgggtgcccaggcctgcctttgtgcactatgacaaggaggaggccagtgatgtggagatcagcctggagagtgacagtgatgacagcgtggtgattgtgcctgagggcctgccccccctgcccccacctcctccttctggggccaccccaccacccatcgcccccactggaccacccacagccagcccccctgtgcctgccaaggaggagcctgaggagctgcctgctgcccctggccccctgcccccacctcctcctcctcctcctcctgtgcccggccctgtgaccctgcccccaccccagctggtgcctgagggcaccccaggcggcggcggccccccagccctggaggaggacctgaccgtcatcaacatcaacagcagtgatgaggaggaggaggaggaggaggaggaggaggaggaggaggaggaggaggaggaggaggaggaggactttgaggaggaggaggaggatgaggaggagtactttgaggaggaggaggaggaggaggaggagtttgaggaggagtttgaggaggaggagggggagctggaggaggaggaggaggaggaggatgaggaggaggaggaggagctggaggaggtggagcgggagggggagagccctgctgctggccccccaccccaggagctggtggaggaggagcccagcgccccacccaccctgctggaggaggagacagaagatggcagtgacaaggtgcagcccccacctgagaccccagctgaggaggagatggagacagaaacagaggccgaggccctgcaggagaaggagcaggatgacacagctgccatgctggccgacttcatcgactgccccccagatgatgagaagcccccaccacccacagagccagacagctag

SEQ ID NO: 40998 - DNA, 3543 bp, Artificial Sequence
  Description of Artificial Sequence: Synthetic coding sequence
atgctgctgcccagcctgagcccccgggtgcagcctgccttcacccagtgtgcccggccccagcccccacctcatgcccccagccctgtgggcggcagaagaggagtgtttgccagcagcagacatgccaccaccggcacccggggcaagatggctgctgctgtgctgagcggccccagcgctggcagcgctgctggggtgcctgggggcactggaggcctgtctgctgtgagcagcggcccccggctgcggctgctgctgctggagagcgtgtctggcctgctgcagcccaggactggatctgctgtggcccctgtgcacccccccaacagaagtgccccccacctgcccggcctgatgtgcctgctgcggctgcacggctctgtgggcggggcccagaacctgagcgccctgggcgccctggtgtccctgagcaatgcccggctgagcagcatcaagaccaggtttgagggcctgtgcctgctgagcctgctggtgggggagagccccacagagctgttccagcagcactgtgtgtcctggctgcggagcatccagcaggtgctgcagacccaggaccccccagccaccatggagctggccgtggccgtgctgcgggacctgctgcgctatgctgcccagctgcctgccctcttccgggacatctccatgaaccacctgcccggcctgctgaccagcctgctgggcctgcggccagaatgtgagcagagcgccctggagggcatgaaggcctgcatgacctacttcccccgggcctgtggcagcctgaagggcaagctggccagcttcttcctgagccgggtggatgccctgagcccccagctgcagcagctggcctgtgagtgctacagccggctgcccagcctgggcgccggcttcagccagggcctgaagcacacagagagctgggagcaggagctgcacagcctgctggccagcctgcacaccctgctgggcgccctgtatgaaggagctgagacagcccctgtgcagaatgaaggacctggggtggagatgctgctgagcagtgaagatggagatgcccacgtgctgctgcagctgcggcagcgcttcagcggcctggcccgctgcctgggcctgatgctgagcagcgagtttggagcccctgtgtctgtgcctgtgcaggagatcctggacttcatctgcaggaccctgtctgtgagcagcaagaacatcagcctgcatggagatggccccctgcggctgctgctgctgcccagcatccacctggaggccctggacctgctgagcgccctgatcctggcctgtggcagccggctgctgcgcttcggcatcctgattggccgcctgctgccccaggtgctgaacagctggagcatcggccgggacagcctgagccctggccaggagcggccctacagcacagtgaggaccaaggtgtatgccatcctggagctgtgggtgcaggtgtgtggggccagcgctggcatgctgcagggcggggccagcggggaggccctgctgacccacctgctgagtgacatcagccccccagcagatgccctgaagctgcggagcccccggggcagcccagatggcagcctgcagacaggcaagcccagcgcccccaagaagctgaagctggatgtgggggaggccatggccccacccagccacaggaagggggacagcaatgccaacagtgatgtgtgtgccgccgccctgcggggcctgagcaggaccatcctgatgtgtggccccctcatcaaggaggagacccaccggcggctgcatgacctggtgctgcccctggtgatgggcgtgcagcagggcgaggtgctgggcagcagcccctacaccagcagccgctgccggcgggagctgtactgcctgctgctggccctgctgctggcccccagcccccgctgccccccacccctggcctgtgccctgcaggccttcagcctgggccagcgggaggacagcctggaggtgagcagcttctgcagcgaggccctggtgacctgtgccgccctgacccacccccgggtgccccccctgcagcccatgggccccacctgccccaccccagcccctgtgcccccacctgaggcccccagccccttccgggccccacccttccaccccccaggccccatgcccagcgtgggctccatgcccagcgctggccccatgcccagcgctggccccatgcccagcgctggccctgtgcccagcgcccggcccggcccccccaccacagccaaccacctgggcctgtctgtgcccggcctggtgtctgtgcccccccggctgctgcccggccctgagaaccaccgggccggcagcaatgaagaccccatcctggcccccagcggcaccccaccacccaccatccccccagatgagaccttcggcggccgggtgcccaggcctgcctttgtgcactatgacaaggaggaggccagtgatgtggagatcagcctggagagtgacagtgatgattctgtggtgattgtgcctgagggcctgccccccctgcccccacctccacccagcggggccaccccaccacccatcgcccccaccggccccccaacagccagcccccctgtgcctgccaaggaggagcctgaggagctgcctgctgcccctggccccctgcccccacctcctcctcctcctcctcctgtgcccggccctgtgaccctgcccccaccccagctggtgcctgagggcacccctgggggcggcggccccccagccctggaggaggacctgaccgtcatcaacatcaacagcagtgatgaggaggaggaggaggaggaggaggaggaggaggaggaggaggaggaggaggaggaggaggaggactttgaggaggaggaggaggatgaggaggagtactttgaggaggaggaggaggaggaggaggagtttgaggaggagtttgaggaggaggagggggagctggaggaggaggaggaggaggaggatgaggaggaggaggaggagctggaggaggtggaggacctggagtttggaacagctggaggagaggtggaggagggcgcccctcctccacccaccctgcccccagccctgcccccacctgagagcccccccaaggtgcagcctgagcctgagcctgagcccggcctgctgctggaggtggaggagcccggcacagaggaggagagaggagctgacacagcccccaccctggcccctgaggccctgcccagccagggcgaggtggagcgggagggggagagccctgctgctggccccccaccccaggagctggtggaggaggagcccagcgccccacccaccctgctggaggaggagacagaagatggcagtgacaaggtgcagcccccacctgagaccccagctgaggaggagatggagacagaaacagaggccgaggccctgcaggagaaggagcaggatgacacagctgccatgctggccgacttcatcgactgccccccagatgatgagaagcccccaccacccacagagccagacagctag

SEQ ID NO: 40999 - DNA, 1083 bp, Artificial Sequence
  Description of Artificial Sequence: Synthetic coding sequence
atgcccaagttcaagcagaggaggaggaagctgaaggccaaggccgagcggctcttcaagaagaaggaggccagccacttccagagcaagctgatcaccccacctcctcctccacccagccctgagcgggtgggcatcagcagcattgacatcagccagagccgctcctggctgaccagctcctggaacttcaacttccccaacatcagagatgccatcaagctgtggaccaacagagtgtggagcatctacagctggtgccagaactgcatcacccagagcctggaggtgctgaaggacaccatcttccccagccgcatctgccaccgggagctgtacagcgtgaagcagcagttctgcatcctggagagcaagctgtgcaagctgcaggaggccctgaagaccatcagcgagagcagcagctgccccagctgtggccagacctgccacatgtctgggaagctgaccaacgtgcctgcctgtgtgctgatcacccctggggacagcaaggctgtgctgccccccaccctgccccagcctgccagccacttccccccacctcctcctcctccacccctgcccccacctcctccacccctggcccctgtgctgctgaggaagcccagcctggccaaggccctgcaggccggccccctgaagaaggatggccccatgcagatcaccgtgaaggacctgctgactgtgaagctgaagaagacccagagcctggatgagaagaggaagctgatccccagccccaaggccaggaaccccctggtgacagtgtctgacctgcagcacgtgaccctgaagcccaacagcaaggtgctgagcaccagggtgaccaacgtgctgatcacccctgggaagagccagatggacctgaggaagctgctgaggaaggtggatgtggagaggagccctgggggcacccccctgaccaacaaggagaacatggagactggaacaggcctgacccctgtgatgacccaggccctgcggaggaagttccagctggcccaccccaggagccccacccccaccctgcccctgagcaccagcagctttgatgagcagaactag

SEQ ID NO: 41000 - DNA, 3651 bp, Artificial Sequence
  Description of Artificial Sequence: Synthetic coding sequence
atggagcagctgcccggggtgcccccaggccccccccaccctgtgcggcccccaccacccaaccccccaccacccatgcccctgcagctggaggcccacctgcggagccacggcctggagcctgctgcccccagcccccggctgcggcctgaggagagcctggaccccccaggggccatgcaggagctgctgggcgccctggagcccctgcccccagcccctggggacacaggagtgggcccccccaacagcgagggcaaggaccctgctggggcctaccgcagccccagcccccagggcaccaaggcccccaggtttgtgcccctgaccagcatctgcttcccagacagcctgctgcaggatgaggagaggagcttcttccccaccatggaggagatgtttggaggaggagctgctgatgattatggcaaggccggccccccagaagatgaaggagaccccaaggccggggccggccccccacctggccccccagcctatgacccctacggcccctactgccccggccgggccagcggggccggccctgagaccccaggcctgggcctggaccccaacaagcccccagagctgcccagcacagtgaatgctgagcccctgggcctcatccagagcggcccccaccaggccgcccctcctcctcctcctcctcctcctcctcctccagccccagccagcgagcccaagggcggcctgaccagccccatcttctgcagcaccaagcccaagaagctgctgaagaccagcagcttccacctgctgcggcggcgggacccccccttccagacccccaagaagctgtatgcccaggagtatgaatttgaagcagatgaggacaaggcagatgtgcctgctgacatccggctgaacccccggcggctgcctgacctggtgagcagctgccgcagcaggcctgccctgagccccctgggggacatcgacttctgcccccccaaccctggcccagatggcccccggcggcggggcaggaagcccaccaaggccaagagagatggccccccccggccccggggccggccccgcatccggcccctggaggtgcccaccacagctggccctgccagcgccagcacccccacagatggagccaagaagccccggggccggggccggggccggggcaggaaggccgaggaggccggcggcacccggctggagcccctgaagcccctgaagatcaagctgtctgtgcccaaggccggggagggcctgggcaccagcagtggagatgccatctctggaacagaccacaacagcctggacagcagcctgacccgggagaagattgaggccaagatcaaggaggtggaggagaagcagcctgagatgaagagcggcttcatggccagcttcctggacttcctgaagagcggcaagaggcacccccccctgtaccaggccggcctgaccccacccctgagcccccccaagtctgtgccccccagcgtgcctgcccggggcctgcagccccagcccccagccaccccagctgtgccccaccccccacccagcggggccttcggcctgggcggggccctggaggccgctgagagcgagggcctgggcctgggctgccccagcccctgcaagaggctggatgaggagctgaagaggaacctggagaccctgcccagcttcagcagtgatgaagaagattctgtggccaagaacagagacctgcaggagagcatcagcagcgccatcagcgccctggatgacccccccctggccggccccaaggacaccagcaccccagatggcccccccctggccccagctgctgctgtgcccggccccccacccctgcccggcctgcccagcgccaacagcaatggcaccccagagccccccctgctggaggagaagcccccacccaccccacctccagcccccaccccccagccccagcccccacctcctcctcctccaccccagcctgccctgcccagccccccacccctggtggcccccacccccagcagccccccacctccacccctgcccccacctcctcctccagccatgcccagccccccacctcctcctcctcctgctgctgcccccctggccgcccctcctgaggagcctgctgcccccagccctgaggaccctgagctgcctgacacccggcccctgcacctggccaagaagcaggagacagctgctgtgtgtggggagacagatgaggaggccggggagagcggcggggagggcatcttccgggagagagatgaatttgtgatccgggcagaggacatccccagcctgaagctggccctgcagacaggccgggagcccccacccatctggagggtgcagaaggccctgctgcagaagttcaccccagagatcaaggatggccagaggcagttctgtgccaccagcaactacctgggctactttggagatgccaagaaccgctaccagaggctgtatgtgaagttcctggagaatgtgaacaagaaggactatgtgcgggtgtgtgccaggaagccctggcaccggccccctgtgcctgtgagaagaagtggccaggccaagaaccctgtgtctgctgggggcagcagcgcccccccacccaaggccccagcccccccacccaagccagagaccccagagaagaccaccagcgagaagcccccagagcagaccccagagacagccatgcctgagcccccagcccctgagaagcccagcctgctgcggcctgtggagaaggagaaggagaaggagaaggtgaccagaggagagcggcccctgcggggggagcgggccaccagcggccggcagaccaggcctgagaggagcctggccaccggccagcctgccaccagccggctgcccaaggcccggcccaccaaggtgaaggccgagcccccacccaagaagaggaagaagtggctgaaggaggccggcggcaatgccacagctgggggcggccccccaggcagcagcagtgacagcgagagcagccctggggcccccagtgaagatgaaagagctgtgcccggccgcctgctgaagacccgggccatgagggagatgtaccgctcctatgtggagatgctggtgtccacagccctggaccctgacatgatccaggccctggaggacacccatgatgagctgtacctgccccccatgaggaagattgatggcctgctgaatgagcacaagaagaaggtgctgaagaggctgagcctgagccctgccctgcaggatgccctgcacaccttcccccagctgcaggtggagcagagcggggagggcagccctgaggagggcgctgtgcggctgcggcctgctggggagccctacaacaggaagaccctgagcaagctgaagaggtctgtggtgcgggcccaggagttcaaggtggagctggagaagagcggctactacaccctgtaccacagcctgcaccactacaagtaccacaccttcctgcgctgccgggaccagaccctggccatcgagggcggcgctgaggacctgggccaggaggaggtggtgcagcagtgcatgaggaaccagccctggctggagcagctgtttgacagcttcagtgacctgctggcccaggcccaggcccacagccgctgtggctag

SEQ ID NO: 41001 - DNA, 3435 bp, Artificial Sequence
  Description of Artificial Sequence: Synthetic coding sequence
atggagcagctgcccggggtgcccccaggccccccccaccctgtgcggcccccaccacccaaccccccaccacccatgcccctgcagctggaggcccacctgcggagccacggcctggagcctgctgcccccagcccccggctgcggcctgaggagagcctggaccccccaggggccatgcaggagctgctgggcgccctggagcccctgcccccagcccctggggacacaggagtgggcccccccaacagcgagggcaaggaccctgctggggcctaccgcagccccagcccccagggcaccaaggcccccaggtttgtgcccctgaccagcatctgcttcccagacagcctgctgcaggatgaggagaggagcttcttccccaccatggaggagatgtttggaggaggagctgctgatgattatggcaaggccggccccccagaagatgaaggagaccccaaggccggggccggccccccacctggccccccagcctatgacccctacggcccctactgccccggccgggccagcggggccggccctgagaccccaggcctgggcctggaccccaacaagcccccagagctgcccagcacagtgaatgctgagcccctgggcctcatccagagcggcccccaccaggccgcccctcctcctcctcctcctcctcctcctcctccagccccagccagcgagcccaagggcggcctgaccagccccatcttctgcagcaccaagcccaagaagctgctgaagaccagcagcttccacctgctgcggcggcgggacccccccttccagacccccaagaagctgtatgcccaggagtatgaatttgaagcagatgaggacaaggcagatgtgcctgctgacatccggctgaacccccggcggctgcctgacctggtgagcagctgccgcagcaggcctgccctgagccccctgggggacatcgacttctgcccccccaaccctggcccagatggcccccggcggcggggcaggaagcccaccaaggccaagagagatggccccccccggccccggggccggccccgcatccggcccctggaggtgcccaccacagctggccctgccagcgccagcacccccacagatggagccaagaagccccggggccggggccggggccggggcaggaaggccgaggaggccggcggcacccggctggagcccctgaagcccctgaagatcaagctgtctgtgcccaaggccggggagggcctgggcaccagcagtggagatgccatctctggaacagaccacaacagcctggacagcagcctgacccgggagaagattgaggccaagatcaaggaggtggaggagaagcagcctgagatgaagagcggcttcatggccagcttcctggacttcctgaagagcggcaagaggcacccccccctgtaccaggccggcctgaccccacccctgagcccccccaagtctgtgccccccagcgtgcctgcccggggcctgcagccccagcccccagccaccccagctgtgccccaccccccacccagcggggccttcggcctgggcggggccctggaggccgctgagagcgagggcctgggcctgggctgccccagcccctgcaagaggctggatgaggagctgaagaggaacctggagaccctgcccagcttcagcagtgatgaagaagattctgtggccaagaacagagacctgcaggagagcatcagcagcgccatcagcgccctggatgacccccccctggccggccccaaggacaccagcaccccagatggcccccccctggccccagctgctgctgtgcccggccccccacccctgcccggcctgcccagcgccaacagcaatggcaccccagagccccccctgctggaggagaagcccccacccaccccacctccagcccccaccccccagccccagcccccacctcctcctcctccaccccagcctgccctgcccagccccccacccctggtggcccccacccccagcagccccccacctccacccctgcccccacctcctcctccagccatgcccagccccccacctcctcctcctcctgctgctgcccccctggccgcccctcctgaggagcctgctgcccccagccctgaggaccctgagctgcctgacacccggcccctgcacctggccaagaagcaggagacagctgctgtgtgtggggagacagatgaggaggccggggagagcggcggggagggcatcttccgggagagagatgaatttgtgatccgggcagaggacatccccagcctgaagctggccctgcagacaggccgggagcccccacccatctggagggtgcagaaggccctgctgcagaagttcaccccagagatcaaggatggccagaggcagttctgtgccaccagcaactacctgggctactttggagatgccaagaaccgctaccagaggctgtatgtgaagttcctggagaatgtgaacaagaaggactatgtgcgggtgtgtgccaggaagccctggcaccggccccctgtgcctgtgagaagaagtggccaggccaagaaccctgtgtctgctgggggcagcagcgcccccccacccaaggccccagcccccccacccaagccagagaccccagagaagaccaccagcgagaagcccccagagcagaccccagagacagccatgcctgagcccccagcccctgagaagcccagcctgctgcggcctgtggagaaggagaaggagaaggagaaggtgaccagaggagagcggcccctgcggggggagcgggccaccagcggccggcagaccaggcctgagaggagcctggccaccggccagcctgccaccagccggctgcccaaggcccggcccaccaaggtgaaggccgagcccccacccaagaagaggaagaagtggctgaaggaggccggcggcaatgccacagctgggggcggccccccaggcagcagcagtgacagcgagagcagccctggggcccccagtgaagatgaaagagctgtgcccggccgcctgctgaagacccgggccatgagggagatgtaccgctcctatgtggagatgctggtgtccacagccctggaccctgacatgatccaggccctggaggacacccatgagctgaagaggtctgtggtgcgggcccaggagttcaaggtggagctggagaagagcggctactacaccctgtaccacagcctgcaccactacaagtaccacaccttcctgcgctgccgggaccagaccctggccatcgagggcggcgctgaggacctgggccaggaggaggtggtgcagcagtgcatgaggaaccagccctggctggagcagctgtttgacagcttcagtgacctgctggcccaggcccaggcccacagccgctgtggctag

SEQ ID NO: 41002 - DNA, 6111 bp, Artificial Sequence
  Description of Artificial Sequence: Synthetic coding sequence
atggacaggaactaccccagcgctggctttggagaccccctgggcgctggggccggctggagctatgaaagaagtgccaaggccagcctggtgtatggcagcagcaggaccagccaccctgagacagacatcctgcaccggcaggcctatgctgccccccaccccctgcagagctatgccaccaaccaccaccctgctggcctgagcggcctgtttgacaccggcctgcaccacgccggcagcgctggcccagatgcctctgtgatgaacctgatcagcgccctggagagccggggcccccagcccggccccagcgccagcagcctgctgagccagttccgcagccccagctggcagacagccatgcacaccccaggccccacagagctgttcatcagcggggccctgcccggcagcagcaccttccccagcagcagcgccctgagcgcctaccagcacccagccagctttggcagccggcccttccctgtgcccagcagcctgagcctgcaggacccccccttcagccccccagccaacggcctgctgagcccccatgatgtgctgcacctgaagcccagccaggcccccaccgtgcccagcagcctgggctttgagcggctggccggcggcggcgtgctgggccctgctggcctgggccctgcccagaccccaccctacagacctggccccccagaccccccacctccacccaggcacctgcccacccagttcaacctgctggccagcagcagcgctgctgctgctgctgctgagcagagcagcccccagctgtacaacttctctggagctgcccctggccccccacctcctgagcgggccctgccccggcaggacaccgtcatcaagcactaccagaggcctgccagcgcccagcccccacctcctcctcctccagcccacgccctgcagcactacctgagctgtggcggcagctaccccagcatgggccaccgggccaacctggcctgcagccccctgggcggcggggagcccagccctggagctggggagcccagcaaggccggccccagcggggccacagctggggccagcggccgggccactggacctgaggccgccggcggcggcggggccggcggcggcggcggcggctaccggcccatcatccagagccctggctacaagacaggaaaaggaggctacggggctgctgctgggggcgccacccggcccccaccacccaggagcacagccacccccaagtgccagagcctgggcggccctgctgctgcctatgccaccgggaaggccagcggggccggcggggccggcggccaggcctacagccctggccagccccagggcctgctgggcccccaggcctacggccagggctttggaggcggccaggcccaggacctgagcaaggcccccagctacagcggcggccccccccagccccccagcggccccccacctcctggcctggccacctgccagagctacagcccagaccagctgcagggccagctgtatggagtgcagggcgagccctacccaggccctgctgcccacagccagggcctgcccacagccagccccagcctgagctacagcacaggccacagccctgccctgagcggccacggcggcggctggggccccagcagcctgggcggcggcggggaggccagccccagccacatcatccggcccctgcagagccccccagccaccggccggcccccaggagtgggcagccctggggcccctgggaagtacctgagctctgtgctggccagcgcccccttcctggcccctcctggagctggcagctatgctgctggggccggcggctacaagggcaaaggagatggcagcgagctgctggccggccctgggggccccccagctgagaggacagaagatgaggagttcctgatccagcacctgctgcaggcccccagcccccccaggaccagcggggctgatggcctggtgggggaggatggagctgctgatgccagcaagggcctgggcggcagcggcggggccggcggccccccaggcaccccctatgagctggccaaggaggacccccagcgctaccacctgcagagcgtcatccgcaccagcgccagcctggatgaaggagccacagctgccctggagctgggcctgggccgcctgaaggagaagaagaagggccctgagcggggcggggagaccccagagggcctggccacctctgtggtgcactatggagctggggccaaggagctgggcgccttcctgcagaagagccccccacctcctccacccacagcccagagcacccagcccacccctcatggcctgctgctggaggccggcggccctgacctgcccctggtgctgcccccacctccaccccagctgctgcccagcgtgctgagccacgcccccagccccagccccagcgccagcaaggtgggcgtgcacctgctggagcccgccaccagagatggagccccccagcccccacctcctcctcctcctcctcctccacccatgcccctgcagctggaggcccacctgcggagccacggcctggagcctgctgcccccagcccccggctgcggcctgaggagagcctggaccccccaggggccatgcaggagctgctgggcgccctggagcccctgcccccagcccctggggacacaggagtgggcccccccaacagcgagggcaaggaccctgctggggcctaccgcagccccagcccccagggcaccaaggcccccaggtttgtgcccctgaccagcatctgcttcccagacagcctgctgcaggatgaggagaggagcttcttccccaccatggaggagatgtttggaggaggagctgctgatgattatggcaaggccggccccccagaagatgaaggagaccccaaggccggggccggccccccacctggccccccagcctatgacccctacggcccctactgccccggccgggccagcggggccggccctgagaccccaggcctgggcctggaccccaacaagcccccagagctgcccagcacagtgaatgctgagcccctgggcctcatccagagcggcccccaccaggccgcccctcctcctcctcctcctcctcctcctcctccagccccagccagcgagcccaagggcggcctgaccagccccatcttctgcagcaccaagcccaagaagctgctgaagaccagcagcttccacctgctgcggcggcgggacccccccttccagacccccaagaagctgtatgcccaggagtatgaatttgaagcagatgaggacaaggcagatgtgcctgctgacatccggctgaacccccggcggctgcctgacctggtgagcagctgccgcagcaggcctgccctgagccccctgggggacatcgacttctgcccccccaaccctggcccagatggcccccggcggcggggcaggaagcccaccaaggccaagagagatggccccccccggccccggggccggccccgcatccggcccctggaggtgcccaccacagctggccctgccagcgccagcacccccacagatggagccaagaagccccggggccggggccggggccggggcaggaaggccgaggaggccggcggcacccggctggagcccctgaagcccctgaagatcaagctgtctgtgcccaaggccggggagggcctgggcaccagcagtggagatgccatctctggaacagaccacaacagcctggacagcagcctgacccgggagaagattgaggccaagatcaaggaggtggaggagaagcagcctgagatgaagagcggcttcatggccagcttcctggacttcctgaagagcggcaagaggcacccccccctgtaccaggccggcctgaccccacccctgagcccccccaagtctgtgccccccagcgtgcctgcccggggcctgcagccccagcccccagccaccccagctgtgccccaccccccacccagcggggccttcggcctgggcggggccctggaggccgctgagagcgagggcctgggcctgggctgccccagcccctgcaagaggctggatgaggagctgaagaggaacctggagaccctgcccagcttcagcagtgatgaagaagattctgtggccaagaacagagacctgcaggagagcatcagcagcgccatcagcgccctggatgacccccccctggccggccccaaggacaccagcaccccagatggcccccccctggccccagctgctgctgtgcccggccccccacccctgcccggcctgcccagcgccaacagcaatggcaccccagagccccccctgctggaggagaagcccccacccaccccacctccagcccccaccccccagccccagcccccacctcctcctcctccaccccagcctgccctgcccagccccccacccctggtggcccccacccccagcagccccccacctccacccctgcccccacctcctcctccagccatgcccagccccccacctcctcctcctcctgctgctgcccccctggccgcccctcctgaggagcctgctgcccccagccctgaggaccctgagctgcctgacacccggcccctgcacctggccaagaagcaggagacagctgctgtgtgtggggagacagatgaggaggccggggagagcggcggggagggcatcttccgggagagagatgaatttgtgatccgggcagaggacatccccagcctgaagctggccctgcagacaggccgggagcccccacccatctggagggtgcagaaggccctgctgcagaagttcaccccagagatcaaggatggccagaggcagttctgtgccaccagcaactacctgggctactttggagatgccaagaaccgctaccagaggctgtatgtgaagttcctggagaatgtgaacaagaaggactatgtgcgggtgtgtgccaggaagccctggcaccggccccctgtgcctgtgagaagaagtggccaggccaagaaccctgtgtctgctgggggcagcagcgcccccccacccaaggccccagcccccccacccaagccagagaccccagagaagaccaccagcgagaagcccccagagcagaccccagagacagccatgcctgagcccccagcccctgagaagcccagcctgctgcggcctgtggagaaggagaaggagaaggagaaggtgaccagaggagagcggcccctgcggggggagcgggccaccagcggccggcagaccaggcctgagaggagcctggccaccggccagcctgccaccagccggctgcccaaggcccggcccaccaaggtgaaggccgagcccccacccaagaagaggaagaagtggctgaaggaggccggcggcaatgccacagctgggggcggccccccaggcagcagcagtgacagcgagagcagccctggggcccccagtgaagatgaaagagctgtgcccggccgcctgctgaagacccgggccatgagggagatgtaccgctcctatgtggagatgctggtgtccacagccctggaccctgacatgatccaggccctggaggacacccatgatgagctgtacctgccccccatgaggaagattgatggcctgctgaatgagcacaagaagaaggtgctgaagaggctgagcctgagccctgccctgcaggatgccctgcacaccttcccccagctgcaggtggagcagagcggggagggcagccctgaggagggcgctgtgcggctgcggcctgctggggagccctacaacaggaagaccctgagcaagctgaagaggtctgtggtgcgggcccaggagttcaaggtggagctggagaagagcggctactacaccctgtaccacagcctgcaccactacaagtaccacaccttcctgcgctgccgggaccagaccctggccatcgagggcggcgctgaggacctgggccaggaggaggtggtgcagcagtgcatgaggaaccagccctggctggagcagctgtttgacagcttcagtgacctgctggcccaggcccaggcccacagccgctgtggctag

SEQ ID NO: 41003 - DNA, 1677 bp, Artificial Sequence
  Description of Artificial Sequence: Synthetic coding sequence
ggccggcccctgggcggagatgcccggcgggagggcgcctctgtgggcggcaccagccgggactggagcgaggagggcatctgcctgactgtggacccctggggcagcaccctgagcagcgagatgctgcagctgggcccccccctgtctgagaggagctttgctgccctgaagctgaccggggagggcaaggccagccctggccggcaggccggctggagcagccaggcccggcccccagaccccctgtgcctgtgccgggagcccctgagccgcatccacaggaccagcagcaccctgcggcggcgcagcaggaccaccccaggccctgaggagggccccagccagaaggtggaccgggccccccagcccaccctggtggtgatgctggaggacatcgccagcccccggcccccagctgagggcttcattgatgagacccccaacttcatcatcccagcccagagagctgagcccatgagaattgtgcggcagcccaccccacctcctggggacctggagccccccttccagcccagcgccctgcctgctgaccccctggagagccccccaacagccccagaccctgccctggagctgcccagcaccccaccacccagcagcctgctgcggccccggctgagcccctggggcctggcccccctcttccgctctgtgcgcagcaagctggagagctttgctgacatcttcctgacccccaacaagaccccccagcccccaccacccagcccccccatgaagctggagctgaagatcgccatcagcgaggccgagcagagcggggctgctgagggcacagcctctgtgagcccccggccccccatccggcagtggaggacccaggaccacaacaccccagccctgctgcccaagcccagcctgggccgcagctacagctgcccagacctgggccccccaggccctggcacctgcacctggcccccagccccaccccagcccagccggccccggcccaggaggcacacagtgggcggcggggagatggcccgggcccctcctccaccccggccctgcctgaggaaggaggtgttccccctgggcggcgtgggcgccagccccagcctgaccaccagctgcagcagcacagccagcaccagcttcagcgagcctgctgagccccggctgggcagcaccaagggcaaggagccccgggccagcaaggaccaggtgctgtctgagcctgagaccaagaccatgggcaaggtgagccgcttccgcatccggaggaccccagcccggccccagctgaacctgacccccatgggcctgccccggcccatccggctgaacaagaaggagttcagcctggaggagatctacaccaacaagaactaccagagccccaccaccaggaggacctttgagaccatctttgaggagccccgggagagaaatggcaccctcatcttcaccagcagcaggaagctgcggcgggctgtggagttccgggacagcagcctgcccaggagcagaagacccagccggggcgtgcgggccgccggcggccgcacagtgccccccaacgtggcccccagcccagatgtgggccccctgctgcagcagaggctggaggagctggatgccctgctgctggaggaggagaccgtggaccgggagcagccccactggacctag

SEQ ID NO: 41004 - DNA, 1758 bp, Artificial Sequence
  Description of Artificial Sequence: Synthetic coding sequence
atggacctgcccggggacagcagccccccaggccagccccggctgtgccggcagcccctgacccgggccctgtggggcgcccggagccccaagaggccccggctgcagctgcccggggcccccagccccctggagaaggccagcagaagagtgctggccgtggtgctggaggatgtgatggctgtgcacatggtgcctgtggtgcccagcaagcagaccagcatcccccagcaccacagctaccaccaggaccctgtgcaccggcagcccccagccagccccccccggcaggccggctggagcagccaggcccggcccccagaccccctgtgcctgtgccgggagcccctgagccgcatccacaggaccagcagcaccctgcggcggcgcagcaggaccaccccaggccctgaggagggccccagccagaaggtggaccgggccccccagcccaccctggtggtgatgctggaggacatcgccagccccaggcctcctgctgagggcttcattgatgagacccccaacttcatcatcccagcccagagagctgagcccatgagaattgtgcggcagcccaccccacctcctggggacctggagccccccttccagcccagcgccctgcctgctgaccccctggagagccccccaacagccccagaccctgccctggagctgcccagcaccccaccacccagcagcctgctgcggccccggctgagcccctggggcctggcccccctcttccgctctgtgcgcagcaagctggagagctttgctgacatcttcctgacccccaacaagaccccccagcccccaccacccagcccccccatgaagctggagctgaagatcgccatcagcgaggccgagcagagcggggctgctgagggcacagcctctgtgagccccaggcctcccatccggcagtggaggacccaggaccacaacaccccagccctgctgcccaagcccagcctgggccgcagctacagctgcccagacctgggccccccaggccctggcacctgcacctggcccccagccccaccccagcccagccggccccggccccggcggcacacagtgggcggcggggagatggcccgggcccctcctccaccccggccctgcctgaggaaggaggtgttccccctgggcggcgtgggcgccagccccagcctgaccaccagctgcagcagcacagccagcaccagcttcagcgagcctgctgagccccggctgggcagcaccaagggcaaggagccccgggccagcaaggaccaggtgctgtctgagcctgagaccaagaccatgggcaaggtgagccgcttccgcatccggaggaccccagcccggccccagctgaacctgacccccatgggcctgccccggcccatccggctgaacaagaaggagttcagcctggaggagatctacaccaacaagaactaccagagccccaccaccaggaggacctttgagaccatctttgaggagccccgggagagaaatggcaccctcatcttcaccagcagcaggaagctgcggcgggctgtggagttccgggacagcagcctgcccaggagccggcggcccagcagaggagtgcgggctgctgggggccgcacagtgcccccaaatgtggcccccagcccagatgtgggccccctgctgcagcagaggctggaggagctggatgccctgctgctggaggaggagaccgtggaccgggagcagccccactggacctag

SEQ ID NO: 41005 - DNA, 1758 bp, Artificial Sequence; identical to SEQ ID NO: 41004
  Description of Artificial Sequence: Synthetic coding sequence

SEQ ID NO: 41006 - DNA, 6450 bp, Artificial Sequence
  Description of Artificial Sequence: Synthetic coding sequence
atgctgagcagcggcgtggagacccagcctgtgcccctggacagctccatgtctgctgtggtgcaggagctgtacagcgagctgcctgtgtctgtgtcccgggagctgcacgccgaccctgagcccagcgtcatcccagatgtgaagccaggggccagcagcagcctgctgagccagaacagagccctgcccctggagctgcagaggacccacgtggagagctgctgtgaggagacctatgagaccctggaccacggcagcgagcccggccgctgtggcctggtggacagcacagctgggggctctgtggccagcggcatcctggaccgggccaagaggtctgagagcatggagcccaaggtgttccgggaccccggcggccaggccggcatcatccgggagcccagcgagggcgccaaggaggacccccaccagcacagcacagctgctgaggagaagaccagccccagccaggaggacctgctgatgcagagcagcaaggagctgagccacgtggacctgcctgaggacttcctgcggagcaaggagggcaatgtgcagatcacagctgagaccctgctgaagtctgctgaggtgcagggcatgaaggtgaatggcaccaagacagacaacaatgaaggccacaagaatggaaatgtgtccaaggacctgtctgctggctgtggggagttccaggaggtggacaagatcatgaccagtgatgaggtgtctgagaccagcaccctggtgaccccagagcccctgacctttgtggaccctgtgctgacagaggccacccccaaggagaaggaatgtgaggagctgaagagctgcccctggctgagcctgcccggcaacagcgccatcagcaatgtggacaacgggaaggaggagctgtgcaagcccaacctggtgtgtgaggctgatgacaaccaccagcagctgcacggccaccacaatgagcagcccagcagcacccatgacagccccacagccaccagccccctgaaggagaacagcgaggtgtcctgcttcaccagtgacctgagcggccctgagagcaggaccatcagcctggagaactgtggctttgagggcggcggcctgctgaagaggtctgctgagaagacagacagcagctacttctacagaggagatgaccagggcaagaacctggccagccgggaggagaatgaggagcggctgctgatccccaggtctgagcggggcggccccttcctgttcaatgcccgggagcctgagaaggagatcagcggccgctgcagcggggagaaggagcctgtggtgagccccaaggagaacatccacaacaactgcatccaggacagcctgcacactggaaacagcagcagcctgatgcccaacagcttcacagaggccacagaggtgatgctgaacaagaatgacctgaagatcaccgtgcacgtgcagggcaacctgaccaaccctgaggaccacaaggagaccttcaccaacatgagccaccctgggggccacagcgaggagagcagcttcagcagcctgatgcagatcgaggaggccggccagaccacccctgtggagcccaacatcctgagcaagagcttctacaccaaggactgcaacagcctggtgtccatccagaggaacctggagggcaacacccagctgaatgaggccagctgcaatgacttcctgtttgagaggaagagcatcgtgtccctgatgcctgaggaccagatcagccctgtgtctgaggtgctgaagcccaagcagggcacagccctgctgctgcccagccctgagtttgactacagacctgagagcgagaaggtgatccagaccagccatgatgacatccccctgctggatgagcagagcatcgcctgtgagatgaatgagctgagctgcaccaatgagctggtggtgaacaaggtggagagtgaatgtgtgctgaaccagcaggtgtccctgaacagccaggagcacgccaacctgcccacagacagcctgctgcacctgaacaaggagatgcccctggccaccggcagagatgcccaccagagccaccacccccccctggagggccgggcagatgtgattgctgacatccagaccatccccatccagaccaagatcaaggacatcagccccccaggcaaccagacctgtggggccagcagcaactgccccaccctgaacatcaagcctgtgtccctggagaggaagaaggagatggctgacagcggcaccaaggccctgcacagccggctgcggagcaacaagcgggaggccgccggcttcccccaggtggtgtctgtgattgagtgccacagcgtgcagagccaggacatcagcagctgccaccgggtgaggaagaatgtgtcccaggagaacatgtgcagcgccagcgctgccttcaagagcagcaagatcagcctgcaggtggacaacagcctcatcaccaagtatgaaaatgccttccagcaccgggaccactgctgccagggcaccggccacagcgtggagaagagcagctgcaaggtgtcctacaccagccaggagcgggagctggatggcaaggagaccaacggcagcctgcccggggacaagatccggaacaagatggtggccggcctgctgaacagcggcatcagcaacaagaccatccacaccagcagcagcatcaagctgtctgaggagggcctggagggcaaggagcaggatgtgtccaaggagaccgtcttctgcaagtacaacatcagtgaccacgccatccaggagctgaaccagacagtgaacatccctggccctgagaaggtgctggaccagagccccaccgtgatgttcagcagcttcaagaatgtgaagtctgtggagaccctggaccagaaggcagatgaggtgctggactgccagagcaaccagaacagaccagatgagtgcaagtctgagggccagagcgccaaggagatgctgagcagtgaccagcgggagaccgtgacagagccccatggagaggtgaaccacaaccagaaggacctgctggtgagcagcggcagcaacaacagcctgccctgtggcagccccaagaagtgcaacctgaagggggcctttgtgaagatgagcggctgtgatgagagcacagagggcatggtggacatcgtgtacacagactgcagcaacaagctggccgagggcgtgctggatgtgaaggccagcaacctgctggactgtggggcccggcaggagaagctggccttccaggaggacagccgcagcaccctgagccggcgggagctggatgctgcccacacaggcaccaccggccaggacagcgacttccctgtgacagctgccagcacagtggacttcctgaagatcaagaagagctgtgaggagaatgtgtgccgcagcctgaaggactgtgagatggagaagtgcccagacagctgtgcccacgagatggagagcgtggccgaccacgagcccaacaagaggatcctgggccgggtgaacctgagcctgaatgacagccactacggccagcaggacaagggcaccagcctgcgggagacccaggagatgacagagggcagccggctggagcccaacagcgagtttgggaaggagagcaccttcggcatcagcagcaaggagagcatgagctgccatgatgagagctctgtgtccctgcggagcctgaagagcattgagatcatgcccagccaggagaacagcgagaccaacgtgaacagcgaggagacagacctgaagaacctgtgcaagcccaaggatggagagatgctgtgtgaaaatgtgaaggactgcaccgtgctgcctgagatgaaggagatcgtgtcccgggactggagcaacagcagtgaccgggacagcgtgtgcacctgtgtggagaagaatgcctgcaaggcctgccacccccatgagaacagcagtgacagacacctgcccctgactgtgaagacagacatcaaggtgaagggggaggagacagaggagcaccagaggggccgcctgggctacctgactgtgggggagcagagcgaggagctggtgacccgggagactggagatggagaccctgtgagcaacatcagccagacccacttcaagtgccggggcatcctgaaccacgccgagaagcagcagagccctgaggtgctggactacatgctgcagaaggaggagaagtacatccggcagcagaaggcccacaccatcagccagcagtgcatcagcagcagcctgctgctggatgatgcccagaaccagaaccagcccaaggctgacaaggatgagagcaccatgatcaatgagatcaccctggccaagctggccaaggacagcatcgtggcccagacccagaagctggaggaccagaaggaggagcggctgcaccaccccctgaggaaggacacagagagctgcaccagcccctgcctgctgggcgcccccaggaaggcccaggaccccagcagcgctggctgtgaccagatccatggagcctttgccaagaagggcgtgctgcccctgaagaagcagccccacaggacctgcaagaaggtgtcctaccaggagcagatcatcgtgggcaggaagattggcaagatccgcagcagcgccttcctgaagagcagcagcaaccccatccccaccaaggcccaccggctgctgagcctgtgcaccctgagcgcccccacccggctggagcctgagacagcccccaccaagagcctggtgagccacatccccaagcagatgagcaccccctgccaccccctgcggagcctgaacttcaggaagaccaccaaggagagcgccctgctgaacaagctgagcatcctggccagcaagctggccccagccatgaagacccagaagctgcgctaccgccgctgcagcagcgagctgctgcccatggccaagagctacaagaggctgcgctacaagaggctgctggatggcttcagcagcagcacagagcagctgaacccctacctggccgccagcggctgggacaagaggcccaacagcaagcccatggccctgtacagcctggagagcatcaagatgaccttcatcgacctgagcaacaagatgcccagcctgctgtttggcagcgagatcttccctgtgtccttccacgtgaagagcagcagcagtgactgcaccacagagagcagcaggaccttccctgagcactgtgccccagcccggctggccctgggggaggccctgcagtgccccagccagccccccaagtggaccttctccttcttcctgagccacggctgccccggcatggccaccttccgggaggacaccggggtgcacagccagacccacacccaggccccaccccagcccccagcccccctgcaggactatggaggaacagccatcgtgcagaccagggctgactgcagcgtgctgggcctgcacaccctgctggccctgtgcagccctggctgctaccgcatctggaccaagaagaggagcttcagcagccacatgcccaccatgcagaggctcttcatgacccagttcacccagggcctgaagggcctgcggagccctgccagcattgctgacaaggtgttctgcagcctgccctacagcgtgggccgggtgctgagcatctggagccagcacggccccagcgtgtgcagctttgagatcagcagcctgcacagcccccactgcaagaggcagcccagcctgggcaccaccagcagccacaccatgctgccctacgtgcccctgcccggcatggaggccacctacaacaccagcggcagccagacccggctggagccccccttccctgccctggtgcccaagagctgcctggtggccgagagcgctgtgtccaagctgctgctgagcgccagcgagttccaggtgcggggcctggatgagctggatggagtgaaggccgcctgcccctgcccccagagcagccccccagagcagaaggaggccgagcctgagaagaggcccaagaaggtgtcccagatccgcatcaggaagaccatccccaggccagaccccaacctgacccccatgggcctgccccggcccaagaggctgaagaagaaggagttcagcctggaggagatctacaccaacaagaactacaagagccccccagccaacagagacctggacagcagctgccccagcacagattctgaaacaggccacttcctggtgtttggctacgcccagaggcaggcccagccccaccccctgctggccagcagaagactcatcggctgcagcagccctgagggccggggccaccccaggagctacccctactggaggcggctgctggtgctgtgctggtacctgcccggctggagggctggccgggtgacctggctgcggctggccacctgggccggccgcggggacagcagcctgtag

SEQ ID NO: 41007 - DNA, 6021 bp, Artificial Sequence
  Description of Artificial Sequence: Synthetic coding sequence
atgctgagcagcggcgtggagacccagcctgtgcccctggacagctccatgtctgctgtggtgcaggagctgtacagcgagctgcctgtgtctgtgtcccgggagctgcacgccgaccctgagcccagcgtcatcccagatgtgaagccaggggccagcagcagcctgctgagccagaacagagccctgcccctggagctgcagaggacccacgtggagagctgctgtgaggagacctatgagaccctggaccacggcagcgagcccggccgctgtggcctggtggacagcacagctgggggctctgtggccagcggcatcctggaccgggccaagaggtctgagagcatggagcccaaggtgttccgggaccccggcggccaggccggcatcatccgggagcccagcgagggcgccaaggaggacccccaccagcacagcacagctgctgaggagaagaccagccccagccaggaggacctgctgatgcagagcagcaaggagctgagccacgtggacctgcctgaggacttcctgcggagcaaggagggcaatgtgcagatcacagctgagaccctgctgaagtctgctgaggtgcagggcatgaaggtgaatggcaccaagacagacaacaatgaaggccacaagaatggaaatgtgtccaaggacctgtctgctggctgtggggagttccaggaggtggacaagatcatgaccagtgatgaggtgtctgagaccagcaccctggtgaccccagagcccctgacctttgtggaccctgtgctgacagaggccacccccaaggagaaggaatgtgaggagctgaagagctgcccctggctgagcctgcccggcaacagcgccatcagcaatgtggacaacgggaaggaggagctgtgcaagcccaacctggtgtgtgaggctgatgacaaccaccagcagctgcacggccaccacaatgagcagcccagcagcacccatgacagccccacagccaccagccccctgaaggagaacagcgaggtgtcctgcttcaccagtgacctgagcggccctgagagcaggaccatcagcctggagaactgtggctttgagggcggcggcctgctgaagaggtctgctgagaagacagacagcagctacttctacagaggagatgaccagggcaagaacctggccagccgggaggagaatgaggagcggctgctgatccccaggtctgagcggggcggccccttcctgttcaatgcccgggagcctgagaaggagatcagcggccgctgcagcggggagaaggagcctgtggtgagccccaaggagaacatccacaacaactgcatccaggacagcctgcacactggaaacagcagcagcctgatgcccaacagcttcacagaggccacagaggtgatgctgaacaagaatgacctgaagatcaccgtgcacgtgcagggcaacctgaccaaccctgaggaccacaaggagaccttcaccaacatgagccaccctgggggccacagcgaggagagcagcttcagcagcctgatgcagatcgaggaggccggccagaccacccctgtggagcccaacatcctgagcaagagcttctacaccaaggactgcaacagcctggtgtccatccagaggaacctggagggcaacacccagctgaatgaggccagctgcaatgacttcctgtttgagaggaagagcatcgtgtccctgatgcctgaggaccagatcagccctgtgtctgaggtgctgaagcccaagcagggcacagccctgctgctgcccagccctgagtttgactacagacctgagagcgagaaggtgatccagaccagccatgatgacatccccctgctggatgagcagagcatcgcctgtgagatgaatgagctgagctgcaccaatgagctggtggtgaacaaggtggagagtgaatgtgtgctgaaccagcaggtgtccctgaacagccaggagcacgccaacctgcccacagacagcctgctgcacctgaacaaggagatgcccctggccaccggcagagatgcccaccagagccaccacccccccctggagggccgggcagatgtgattgctgacatccagaccatccccatccagaccaagatcaaggacatcagccccccaggcaaccagacctgtggggccagcagcaactgccccaccctgaacatcaagcctgtgtccctggagaggaagaaggagatggctgacagcggcaccaaggccctgcacagccggctgcggagcaacaagcgggaggccgccggcttcccccaggtggtgtctgtgattgagtgccacagcgtgcagagccaggacatcagcagctgccaccgggtgaggaagaatgtgtcccaggagaacatgtgcagcgccagcgctgccttcaagagcagcaagatcagcctgcaggtggacaacagcctcatcaccaagtatgaaaatgccttccagcaccgggaccactgctgccagggcaccggccacagcgtggagaagagcagctgcaaggtgtcctacaccagccaggagcgggagctggatggcaaggagaccaacggcagcctgcccggggacaagatccggaacaagatggtggccggcctgctgaacagcggcatcagcaacaagaccatccacaccagcagcagcatcaagctgtctgaggagggcctggagggcaaggagcaggatgtgtccaaggagaccgtcttctgcaagtacaacatcagtgaccacgccatccaggagctgaaccagacagtgaacatccctggccctgagaaggtgctggaccagagccccaccgtgatgttcagcagcttcaagaatgtgaagtctgtggagaccctggaccagaaggcagatgaggtgctggactgccagagcaaccagaacagaccagatgagtgcaagtctgagggccagagcgccaaggagatgctgagcagtgaccagcgggagaccgtgacagagccccatggagaggtgaaccacaaccagaaggacctgctggtgagcagcggcagcaacaacagcctgccctgtggcagccccaagaagtgcaacctgaagggggcctttgtgaagatgagcggctgtgatgagagcacagagggcatggtggacatcgtgtacacagactgcagcaacaagctggccgagggcgtgctggatgtgaaggccagcaacctgctggactgtggggcccggcaggagaagctggccttccaggaggacagccgcagcaccctgagccggcgggagctggatgctgcccacacaggcaccaccggccaggacagcgacttccctgtgacagctgccagcacagtggacttcctgaagatcaagaagagctgtgaggagaatgtgtgccgcagcctgaaggactgtgagatggagaagtgcccagacagctgtgcccacgagatggagagcgtggccgaccacgagcccaacaagaggatcctgggccgggtgaacctgagcctgaatgacagccactacggccagcaggacaagggcaccagcctgcgggagacccaggagatgacagagggcagccggctggagcccaacagcgagtttgggaaggagagcaccttcggcatcagcagcaaggagagcatgagctgccatgatgagagctctgtgtccctgcggagcctgaagagcattgagatcatgcccagccaggagaacagcgagaccaacgtgaacagcgaggagacagacctgaagaacctgtgcaagcccaaggatggagagatgctgtgtgaaaatgtgaaggactgcaccgtgctgcctgagatgaaggagatcgtgtcccgggactggagcaacagcagtgaccgggacagcgtgtgcacctgtgtggagaagaatgcctgcaaggcctgccacccccatgagaacagcagtgacagacacctgcccctgactgtgaagacagacatcaaggtgaagggggaggagacagaggagcaccagaggggccgcctgggctacctgactgtgggggagcagagcgaggagctggtgacccgggagactggagatggagaccctgtgagcaacatcagccagacccacttcaagtgccggggcatcctgaaccacgccgagaagcagcagagccctgaggtgctggactacatgctgcagaaggaggagaagtacatccggcagcagaaggcccacaccatcagccagcagtgcatcagcagcagcctgctgctggatgatgcccagaaccagaaccagcccaaggctgacaaggatgagagcaccatgatcaatgagatcaccctggccaagctggccaaggacagcatcgtggcccagacccagaagctggaggaccagaaggaggagcggctgcaccaccccctgaggaaggacacagagagctgcaccagcccctgcctgctgggcgcccccaggaaggcccaggaccccagcagcgctggctgtgaccagatccatggagcctttgccaagaagggcgtgctgcccctgaagaagcagccccacaggacctgcaagaaggtgtcctaccaggagcagatcatcgtgggcaggaagattggcaagatccgcagcagcgccttcctgaagagcagcagcaaccccatccccaccaaggcccaccggctgctgagcctgtgcaccctgagcgcccccacccggctggagcctgagacagcccccaccaagagcctggtgagccacatccccaagcagatgagcaccccctgccaccccctgcggagcctgaacttcaggaagaccaccaaggagagcgccctgctgaacaagctgagcatcctggccagcaagctggccccagccatgaagacccagaagctgcgctaccgccgctgcagcagcgagctgctgcccatggccaagagctacaagaggctgcgctacaagaggctgctggatggcttcagcagcagcacagagcagctgaacccctacctggccgccagcggctgggacaagaggcccaacagcaagcccatggccctgtacagcctggagagcatcaagatgaccttcatcgacctgagcaacaagatgcccagcctgctgtttggcagcgagatcttccctgtgtccttccacgtgaagagcagcagcagtgactgcaccacagagagcagcaggaccttccctgagcactgtgccccagcccggctggccctgggggaggccctgcagtgccccagccagccccccaagtggaccttctccttcttcctgagccacggctgccccggcatggccaccttccgggaggacaccggggtgcacagccagacccacacccaggccccaccccagcccccagcccccctgcaggactatggaggaacagccatcgtgcagaccagggctgactgcagcgtgctgggcctgcacaccctgctggccctgtgcagccctggctgctaccgcatctggaccaagaagaggagcttcagcagccacatgcccaccatgcagaggctcttcatgacccagttcacccagggcctgaagggcctgcggagccctgccagcattgctgacaaggtgttctgcagcctgccctacagcgtgggccgggtgctgagcatctggagccagcacggccccagcgtgtgcagctttgagatcagcagcctgcacagcccccactgcaagaggcagcccagcctgggcaccaccagcagccacaccatgctgccctacgtgcccctgcccggcatggaggccacctacaacaccagcggcagccagacccggctggagccccccttccctgccctggtgcccaagagctgcctggtggccgagagcgctgtgtccaagctgctgctgagcgccagcgagttccaggtgcggggcctggatgagctggatggagtgaaggccgcctgcccctgcccccagagcagccccccagagcagaaggaggtgaaggaggagggcgtgtag

SEQ ID NO: 41008 - DNA, 6456 bp, Artificial Sequence
  Description of Artificial Sequence: Synthetic coding sequence
atgctgagcagcggcgtggagacccagcctgtgcccctggacagctccatgtctgctgtggtgcaggagctgtacagcgagctgcctgtgtctgtgtcccgggagctgcacgccgaccctgagcccagcgtcatcccagatgtgaagccaggggccagcagcagcctgctgagccagaacagagccctgcccctggagctgcagaggacccacgtggagagctgctgtgaggagacctatgagaccctggaccacggcagcgagcccggccgctgtggcctggtggacagcacagctgggggctctgtggccagcggcatcctggaccgggccaagaggtctgagagcatggagcccaaggtgttccgggaccccggcggccaggccggcatcatccgggagcccagcgagggcgccaaggaggacccccaccagcacagcacagctgctgaggagaagaccagccccagccaggaggacctgctgatgcagagcagcaaggagctgagccacgtggacctgcctgaggacttcctgcggagcaaggagggcaatgtgcagatcacagctgagaccctgctgaagtctgctgaggtgcagggcatgaaggtgaatggcaccaagacagacaacaatgaaggccacaagaatggaaatgtgtccaaggacctgtctgctggctgtggggagttccaggaggtggacaagatcatgaccagtgatgaggtgtctgagaccagcaccctggtgaccccagagcccctgacctttgtggaccctgtgctgacagaggccacccccaaggagaaggaatgtgaggagctgaagagctgcccctggctgagcctgcccggcaacagcgccatcagcaatgtggacaacgggaaggaggagctgtgcaagcccaacctggtgtgtgaggctgatgacaaccaccagcagctgcacggccaccacaatgagcagcccagcagcacccatgacagccccacagccaccagccccctgaaggagaacagcgaggtgtcctgcttcaccagtgacctgagcggccctgagagcaggaccatcagcctggagaactgtggctttgagggcggcggcctgctgaagaggtctgctgagaagacagacagcagctacttctacagaggagatgaccagggcaagaacctggccagccgggaggagaatgaggagcggctgctgatccccaggtctgagcggggcggccccttcctgttcaatgcccgggagcctgagaaggagatcagcggccgctgcagcggggagaaggagcctgtggtgagccccaaggagaacatccacaacaactgcatccaggacagcctgcacactggaaacagcagcagcctgatgcccaacagcttcacagaggccacagaggtgatgctgaacaagaatgacctgaagatcaccgtgcacgtgcagggcaacctgaccaaccctgaggaccacaaggagaccttcaccaacatgagccaccctgggggccacagcgaggagagcagcttcagcagcctgatgcagatcgaggaggccggccagaccacccctgtggagcccaacatcctgagcaagagcttctacaccaaggactgcaacagcctggtgtccatccagaggaacctggagggcaacacccagctgaatgaggccagctgcaatgacttcctgtttgagaggaagagcatcgtgtccctgatgcctgaggaccagatcagccctgtgtctgaggtgctgaagcccaagcagggcacagccctgctgctgcccagccctgagtttgactacagacctgagagcgagaaggtgatccagaccagccatgatgacatccccctgctggatgagcagagcatcgcctgtgagatgaatgagctgagctgcaccaatgagctggtggtgaacaaggtggagagtgaatgtgtgctgaaccagcaggtgtccctgaacagccaggagcacgccaacctgcccacagacagcctgctgcacctgaacaaggagatgcccctggccaccggcagagatgcccaccagagccaccacccccccctggagggccgggcagatgtgattgctgacatccagaccatccccatccagaccaagatcaaggacatcagccccccaggcaaccagacctgtggggccagcagcaactgccccaccctgaacatcaagcctgtgtccctggagaggaagaaggagatggctgacagcggcaccaaggccctgcacagccggctgcggagcaacaagcgggaggccgccggcttcccccaggtggtgtctgtgattgagtgccacagcgtgcagagccaggacatcagcagctgccaccgggtgaggaagaatgtgtcccaggagaacatgtgcagcgccagcgctgccttcaagagcagcaagatcagcctgcaggtggacaacagcctcatcaccaagtatgaaaatgccttccagcaccgggaccactgctgccagggcaccggccacagcgtggagaagagcagctgcaaggtgtcctacaccagccaggagcgggagctggatggcaaggagaccaacggcagcctgcccggggacaagatccggaacaagatggtggccggcctgctgaacagcggcatcagcaacaagaccatccacaccagcagcagcatcaagctgtctgaggagggcctggagggcaaggagcaggatgtgtccaaggagaccgtcttctgcaagtacaacatcagtgaccacgccatccaggagctgaaccagacagtgaacatccctggccctgagaaggtgctggaccagagccccaccgtgatgttcagcagcttcaagaatgtgaagtctgtggagaccctggaccagaaggcagatgaggtgctggactgccagagcaaccagaacagaccagatgagtgcaagtctgagggccagagcgccaaggagatgctgagcagtgaccagcgggagaccgtgacagagccccatggagaggtgaaccacaaccagaaggacctgctggtgagcagcggcagcaacaacagcctgccctgtggcagccccaagaagtgcaacctgaagggggcctttgtgaagatgagcggctgtgatgagagcacagagggcatggtggacatcgtgtacacagactgcagcaacaagctggccgagggcgtgctggatgtgaaggccagcaacctgctggactgtggggcccggcaggagaagctggccttccaggaggacagccgcagcaccctgagccggcgggagctggatgctgcccacacaggcaccaccggccaggacagcgacttccctgtgacagctgccagcacagtggacttcctgaagatcaagaagagctgtgaggagaatgtgtgccgcagcctgaaggactgtgagatggagaagtgcccagacagctgtgcccacgagatggagagcgtggccgaccacgagcccaacaagaggatcctgggccgggtgaacctgagcctgaatgacagccactacggccagcaggacaagggcaccagcctgcgggagacccaggagatgacagagggcagccggctggagcccaacagcgagtttgggaaggagagcaccttcggcatcagcagcaaggagagcatgagctgccatgatgagagctctgtgtccctgcggagcctgaagagcattgagatcatgcccagccaggagaacagcgagaccaacgtgaacagcgaggagacagacctgaagaacctgtgcaagcccaaggatggagagatgctgtgtgaaaatgtgaaggactgcaccgtgctgcctgagatgaaggagatcgtgtcccgggactggagcaacagcagtgaccgggacagcgtgtgcacctgtgtggagaagaatgcctgcaaggcctgccacccccatgagaacagcagtgacagacacctgcccctgactgtgaagacagacatcaaggtgaagggggaggagacagaggagcaccagaggggccgcctgggctacctgactgtgggggagcagagcgaggagctggtgacccgggagactggagatggagaccctgtgagcaacatcagccagacccacttcaagtgccggggcatcctgaaccacgccgagaagcagcagagccctgaggtgctggactacatgctgcagaaggaggagaagtacatccggcagcagaaggcccacaccatcagccagcagtgcatcagcagcagcctgctgctggatgatgcccagaaccagaaccagcccaaggctgacaaggatgagagcaccatgatcaatgagatcaccctggccaagctggccaaggacagcatcgtggcccagacccagaagctggaggaccagaaggaggagcggctgcaccaccccctgaggaaggacacagagagctgcaccagcccctgcctgctgggcgcccccaggaaggcccaggaccccagcagcgctggctgtgaccagatccatggagcctttgccaagaagggcgtgctgcccctgaagaagcagccccacaggacctgcaagaaggtgtcctaccaggagcagatcatcgtgggcaggaagattggcaagatccgcagcagcgccttcctgaagagcagcagcaaccccatccccaccaaggcccaccggctgctgagcctgtgcaccctgagcgcccccacccggctggagcctgagacagcccccaccaagagcctggtgagccacatccccaagcagatgagcaccccctgccaccccctgcggagcctgaacttcaggaagaccaccaaggagagcgccctgctgaacaagctgagcatcctggccagcaagctggccccagccatgaagacccagaagctgcgctaccgccgctgcagcagcgagctgctgcccatggccaagagctacaagaggctgcgctacaagaggctgctggatggcttcagcagcagcacagagcagctgaacccctacctggccgccagcggctgggacaagaggcccaacagcaagcccatggccctgtacagcctggagagcatcaagatgaccttcatcgacctgagcaacaagatgcccagcctgctgtttggcagcgagatcttccctgtgtccttccacgtgaagagcagcagcagtgactgcaccacagagagcagcaggaccttccctgagcactgtgccccagcccggctggccctgggggaggccctgcagtgccccagccagccccccaagtggaccttctccttcttcctgagccacggctgccccggcatggccaccttccgggaggacaccggggtgcacagccagacccacacccaggccccaccccagcccccagcccccctgcaggactatggaggaacagccatcgtgcagaccagggctgactgcagcgtgctgggcctgcacaccctgctggccctgtgcagccctggctgctaccgcatctggaccaagaagaggagcttcagcagccacatgcccaccatgcagaggctcttcatgacccagttcacccagggcctgaagggcctgcggagccctgccagcattgctgacaaggtgttctgcagcctgccctacagcgtgggccgggtgctgagcatctggagccagcacggccccagcgtgtgcagctttgagatcagcagcctgcacagcccccactgcaagaggcagcccagcctgggcaccaccagcagccacaccatgctgccctacgtgcccctgcccggcatggaggccacctacaacaccagcggcagccagacccggctggagccccccttccctgccctggtgcccaagagctgcctggtggccgagagcgctgtgtccaagctgctgctgagcgccagcgagttccaggtgcggggcctggatgagctggatggagtgaaggccgcctgcccctgcccccagagcagccccccagagcagaaggaggccgagcctgagaagaggcccaagaaggtgtcccagatccgcatcaggaagaccatccccaggccagaccccaacctgacccccatgggcctgccccggcccaagaggctgaagaagaaggagttcagcctggaggagatctacaccaacaagaactacaagagccccccagccaaccgctgcctggagaccatctttgaggagcccaaggagagaaatggcaccctcatcagcatcagccagcagaagaggaagagggtgctggagttccaggacttcaccgtgcccaggaagagaagagcccggggcaaggtgaaggtggccggcagcttcacccgggcccagaaggctgctgtgcagagccgggagctggatgccctgctgatccagaagctgatggagctggagaccttctttgccaaggaggaggagcaggagcagagcagcggctgctag

SEQ ID NO: 41009 - DNA, 390 bp, Artificial Sequence
  Description of Artificial Sequence: Synthetic coding sequence
atggctgacagcggagatgctggcagcagcggcccctggtggaagagcctgaccaacagcaggaagaagagcaaggaggccgctgtgggcgtgcccccaccagcccagcctgcccctggagagcccaccccaccagccccacccagcccagactggaccagcagcagccgggagaaccagcaccccaacctgctgggcggggccggggagccccccaagccagacaagctgtatggagacaagagcggcagcagcagaagaaacctgaagatcagccgcagcggccgcttcaaggagaagaggaaggtgcgggccaccctgctgcctgaggccggccgcagccctgaggaggccggcttccctggggacccccatgaggacaagcagtag

SEQ ID NO: 41010 - DNA, 57 bp, Artificial Sequence
  Description of Artificial Sequence: Synthetic coding sequence
atggctgacagcggagatgctggcagcagcggcccctggtggaagagcctgacctag

SEQ ID NO: 41011 - DNA, 312 bp, Artificial Sequence
  Description of Artificial Sequence: Synthetic coding sequence
atgaccacagaaattggctggtggaagctgaccttcctgaggaagaagaagagcacccccaaggtgctgtatgagatcccagacacctacgcccagacagaaggagatgctgagccccccaggccagatgctgggggccccaacagcgacttcaacacccggctggagaagatcgtggacaagagcaccaagggcaagcacgtgaaggtgagcaacagcggccgcttcaaggagaagaagaaggtgcgggccaccctggccgagaaccccaacctgtttgatgaccacgaggagggccgcagcagcaagtag

SEQ ID NO: 41012 - DNA, 846 bp, Artificial Sequence
  Description of Artificial Sequence: Synthetic coding sequence
atggcccagagcggcctgacagccaccagcgccagccaggtgcaggccatcctgctgccccagcctgcctctgtgcgccactacgcctgggtggtggaccagattgacaccctgaccagtgacctgcagctggaggatgagatgacagacagcagcaagacagacaccctgaacagcagcagcagcggcaccacagccagcagcctggagaagatcaaggtgcaggccaatgcccccctcatcaagcccccagcccaccccagcgccatcctgactgtgctgaggaagcccaaccccccacctcctccaccccggctgacccctgtgaagtgtgaggaccccaagagggtggtgcccacagccaaccctgtgaagaccaacggcaccctgctgagaaatggaggcctgcccggcggccccaacaagatccccaatggagacatctgctgcatccccaacagcaacctggacaaggcccctgtgcagctgctgatgcacaggcctgagaaggaccgctgcccccaggccggcccccgggagcgggtgcgcttcaatgagaaggtgcagtaccacggctactgcccagactgtgacacccgctacaacatcaagaaccgggaggtgcacctgcacagcgagcctgtgcaccccccaggcaagatcccccaccagggcccccccctgccccccaccccccacctgccccccttccccctggagaatggaggcatgggcatcagccacagcaacagcttcccccccatccggcctgccaccgtgcccccacccacagcccccaagccccagaagaccatcctgaggaagagcaccaccaccaccgtgtag

SEQ ID NO: 41013 - DNA, 915 bp, Artificial Sequence
  Description of Artificial Sequence: Synthetic coding sequence
atgtctgccaagagcaagggcaaccccagcagcagctgcccagctgagggccccccagctgccagcaagaccaaggtgaaggagcagatcaagatcatcgtggaggacctggagctggtgctgggggacctgaaggatgtggccaaggagctgaaggaggtggtggaccagattgacaccctgaccagtgacctgcagctggaggatgagatgacagacagcagcaagacagacaccctgaacagcagcagcagcggcaccacagccagcagcctggagaagatcaaggtgcaggccaatgcccccctcatcaagcccccagcccaccccagcgccatcctgactgtgctgaggaagcccaaccccccacctcctccaccccggctgacccctgtgaagtgtgaggaccccaagagggtggtgcccacagccaaccctgtgaagaccaacggcaccctgctgagaaatggaggcctgcccggcggccccaacaagatccccaacggggacatctgctgcatccccaacagcaacctggacaaggcccctgtgcagctgctgatgcacaggcctgagaaggaccgctgcccccaggccggcccccgggagcgggtgcgcttcaatgagaaggtgcagtaccacggctactgcccagactgtgacacccgctacaacatcaagaaccgggaggtgcacctgcacagcgagcctgtgcaccccccaggcaagatcccccaccagggcccccccctgccccccaccccccacctgccccccttccccctggagaatggaggcatgggcatcagccacagcaacagcttcccccccatccggcctgccaccgtgcccccacccacagcccccaagccccagaagaccatcctgaggaagagcaccaccaccaccgtgtag

SEQ ID NO: 41014 - DNA, 705 bp, Artificial Sequence
  Description of Artificial Sequence: Synthetic coding sequence
atgacagacagcagcaagacagacaccctgaacagcagcagcagcggcaccacagccagcagcctggagaagatcaaggtgcaggccaatgcccccctcatcaagcccccagcccaccccagcgccatcctgactgtgctgaggaagcccaaccccccacctcctccaccccggctgacccctgtgaagtgtgaggaccccaagagggtggtgcccacagccaaccctgtgaagaccaacggcaccctgctgagaaatggaggcctgcccggcggccccaacaagatccccaacggggacatctgctgcatccccaacagcaacctggacaaggcccctgtgcagctgctgatgcacaggcctgagaaggaccgctgcccccaggccggcccccgggagcgggtgcgcttcaatgagaaggtgcagtaccacggctactgcccagactgtgacacccgctacaacatcaagaaccgggaggtgcacctgcacagcgagcctgtgcaccccccaggcaagatcccccaccagggcccccccctgccccccaccccccacctgccccccttccccctggagaatggaggcatgggcatcagccacagcaacagcttcccccccatccggcctgccaccgtgcccccacccacagcccccaagccccagaagaccatcctgaggaagagcaccaccaccaccgtgtag

SEQ ID NO: 41015 - DNA, 705 bp, Artificial Sequence; identical to SEQ ID NO: 41014
  Description of Artificial Sequence: Synthetic coding sequence

SEQ ID NO: 41016 - DNA, 429 bp, Artificial Sequence
  Description of Artificial Sequence: Synthetic coding sequence
atgacagacagcagcaagacagacaccctgaacagcagcagcagcggcaccacagccagcagcctggagaagatcaaggtgcaggccaatgcccccctcatcaagcccccagcccaccccagcgccatcctgactgtgctgaggaagcccaaccccccacctcctccaccccggctgacccctgtgaagtgtgaggaccccaagagggtggtgcccacagccaaccctgtgaagaccaacggcaccctgctgagaaatggaggcctgcccggcggccccaacaagatccccaacggggacatctgctgcatccccaacagcaacctggacaaggcccctgtgcagctgctgatgcacaggcctgagaaggaccgctgcccccaggccggcccccgggagcgggtgcgcttcaatgagaaggtgcagtag

SEQ ID NO: 41017 - DNA, 1071 bp, Artificial Sequence
  Description of Artificial Sequence: Synthetic coding sequence
atggacacccagggccctgtgtcccagcccttccagcagcctgagaagccaggccgggtgagaagaaggaagacccggcgggagaggaacaaggccctggtgggcagcagaagacccctggcccaccacgacccccctgtggccatccgggacccccctgtggtgcccacagccagcaagctggtggtgatcacccagggccgcctgagccgggagcaccggggcctcttcaaccacgaggtgaagagcctggatgtggcccggctgctgagcagcggcaccctggtgcccggcagccccaccctgcctgccaagcccagccccagccctggccgggcccaggagcccgcccccaggagccgggacaaggagaaccaggtgcctgggggcagcggccctggcccccccagcagccctgagctgagcggcgtgggccagctgctggccgagctgcagtgccagctgagcctgccccaggccttccccaggaggaacctgatccaggatgccagagatgccatcgtgcacaccctgcaggcctgccacggctgtgtgcctgacctggccctggtgctgcggggctgccagccccccctgcccggggccaagccaggagtgtctgagaggaagatgacccccttctggatcaacagcccagaccaggtgcctgagcaggagcggcagaggaagcagcagggcaccaaggagttcaccttccccatgccctacaccagctccatgcccacagcccaccggggcagcctggccccaccccggggcccctggccaccctacttccccagcctgagcagccccagcggcacagcctggggccccccaacagcctttgacctgctgaagagcatctggctggtggccaccccacctccaccccggccctggggcgtgggcctgccccagcccctgccccagcccagcagccccctgctgcccaggacctctgtgctggactggagccccagcccccccagccccctgcccagcctgtcctgggtggtggcccagagcagccctgaggcctggagcttcccccccatgaggctgtactag

SEQ ID NO: 41018 - DNA, 1071 bp, Artificial Sequence; identical to SEQ ID NO: 41017
  Description of Artificial Sequence: Synthetic coding sequence

SEQ ID NO: 41019 - DNA, 666 bp, Artificial Sequence
  Description of Artificial Sequence: Synthetic coding sequence
atggaggagccccggcccagcaagaggctgcgctccatggcccccaaccaggccagcggcggccccccacctgagcccggctgctgcgtggccgaccctgagggctctgtggaggctgatggccctgcccagcctgcccagcctgccaagcccatcgcctacgtgaagcccttccggcggcagcccccagcccggcctgagagccccccacctgctgagcggggcagaagaagaggaggcagccggcggcccggccggggccggggccggcgggccggccccagaggagatgctggccagaggcagggcgctgagggcctgatggccccagatgtgcacatccagctggaccaccacggggagcccggccaccagggcgagcctgagatcacagaaacagctgccttcagcctgtctgaaacaggccccccacctggcaccgtgcaggagggccctggcccagatgtggcccagcctgagctgggcttccaggagcccccagctgcccctggcccccaggccgtggactggcagcctgtgctgaccctgtacccctgcatcggcttccgggccctgggggacagcgctgtgctgcaggtgatccagaccccccagggcacctacgtgcagggcgtgcctgtgttcctgacagacatcgcctactag

SEQ ID NO: 41020 - DNA, 666 bp, Artificial Sequence; identical to SEQ ID NO: 41019
  Description of Artificial Sequence: Synthetic coding sequence

SEQ ID NO: 41021 - DNA, 666 bp, Artificial Sequence; identical to SEQ ID NO: 41019
  Description of Artificial Sequence: Synthetic coding sequence

SEQ ID NO: 41022 - DNA, 666 bp, Artificial Sequence; identical to SEQ ID NO: 41019
  Description of Artificial Sequence: Synthetic coding sequence

SEQ ID NO: 41023 - DNA, 666 bp, Artificial Sequence; identical to SEQ ID NO: 41019
  Description of Artificial Sequence: Synthetic coding sequence

SEQ ID NO: 41024 - DNA, 666 bp, Artificial Sequence; identical to SEQ ID NO: 41019
  Description of Artificial Sequence: Synthetic coding sequence

SEQ ID NO: 41025 - DNA, 666 bp, Artificial Sequence; identical to SEQ ID NO: 41019
  Description of Artificial Sequence: Synthetic coding sequence

SEQ ID NO: 41026 - DNA, 666 bp, Artificial Sequence; identical to SEQ ID NO: 41019
  Description of Artificial Sequence: Synthetic coding sequence

SEQ ID NO: 41027 - DNA, 666 bp, Artificial Sequence; identical to SEQ ID NO: 41019
  Description of Artificial Sequence: Synthetic coding sequence

SEQ ID NO: 41028 - DNA, 1170 bp, Artificial Sequence
  Description of Artificial Sequence: Synthetic coding sequence
atgcacgcctgcagcagcacagccctgcacccccggcccttcatccacggcttctccttcaccaccttcctgcagcagctgttcccccacggcagcagcacagccctgcacccctggcccttcatccacggcagcagccccatggccctgcaccccaggctcttcacccacggccccagcagcacagccctgcacccctgccccttcacccacggcagcagccccatgagcctgcaccccaggctcttcacccacagccccagctccatgcccctgcacccccggccctttgtgcacgccagcagccccacagccctgcggccctgcctcttcacccacggccccagctccatgcccctgcacccccggccctttgtgcacgccagcagccccacagccctgcccccctgcctcttcacccacggccccagctccatgcccctgcacccccggcccttcctgcacgccagcagccccacagccctgcccccctgcctcttcacccacggccccagctccatgcccctgcacccccggccctttgtgcacgccagcagccccacagccctgcggccctgcctcttcacccacggccccagctccatgcccctgcacccccggccctttgtgcacgccagcagccccacagccctgcccccctgcctcttcacccacggccccagctccatgcccctgcacccccggccctttgtgcacgccagcagccccacagccctgcggccctgcctcttcacccacggccccagctccatgcccctgcacccccggcccttcctgcacgccagcagccccacagccctgcggccctgcctcttcacccacggccccagctccatgcccctgcacccccggccctttgtgcacgccagcagccccacagccctgcggccctgcctcttcacccacggccccagctccatgcccctgcacccccggccctttgtgcacgccagcagcagcaccagcctgcacccccggcccttcatccacgccagcagcagcaagagcctgcacctgcggctcttcagccacagcagctgcctggtgggcttcagccagcagggcaatgtgctgctgctgagcgcccgggccaccttcaacacctgcctgctggtgagcaacatgtacttcctgatcatctcctactag

SEQ ID NO: 41029 - DNA, 1170 bp, Artificial Sequence; identical to SEQ ID NO: 41028
  Description of Artificial Sequence: Synthetic coding sequence

SEQ ID NO: 41030 - DNA, 1269 bp, Artificial Sequence
  Description of Artificial Sequence: Synthetic coding sequence
atgcagcaccccaagcccttctgtgccccagctgccccccaggagggcttcagcccccagagcctggagggcgctgaggtgctgggcaaccagcctgcccccacctgtgccgagcccccaccagccatgggcagcctgaacctgtaccaccccccagaccctgagaaggaggtgtttcctgcccccccagctggcttccagatggccccctgtggctgcttctttgacccccgcatctaccgcatcgagtggaccaccccagacctgggccagagcgccctgtacaagctggccgccagcagcggcggccctgctggggtgcccagcgcccctggcagctacctgctggagccccagccctacctgaaggcccctggcctgcccccctacccccactaccagcaggcccctgggggcccccagttcctgctgccctacttccccccagagggccctggccctgaggccctgggctttgtgggagatgctggccctgctgcctttgtggagctgcccctgccccccctggaggagggccctgcccccctgcccccacctccacccaaggagaacaagcccccacctgtgctgatcaccctgcctgctgagcccaccctgcccccagatgcctacagccacctgcagggccacctgggccacttccctggccctgagcccctggccttccctgtgaaggagctgcagggcagcggggcccggcctggggtgcccctgtacccacctggcctgtctgagctgaaggtggccgaggtgaaggagggcgccctgctgggcgctgggaaggccaaggcccccaagacagcccgggccctggccctgcctgacaaggtgctgctggaggatgccatgaagctgtttgactgcctgcccggggccagcgagcctgagggcaccctgtgtgaggtgcccggccctgccctgcctgacagcagcggcggcaacagcgcagatgacatccgcagcctgtgcctgcctgaggagctgctgagctttgactacagcgtgcctgagatcctggacacagtgtccaatgtggactacttcttcaacttcaaggccctggatgaggagcagcccccccaccctggccccccagccaccaacaccccagcccccatcctgagcggcaagaggaaggccagcacagccaagaagggcaagccaggcaggaaggcccggcagcctgctggccctgccagcgccaccccacctggcccccgggaggacctgggcgccaccccccactag

SEQ ID NO: 41031 - DNA, 801 bp, Artificial Sequence
  Description of Artificial Sequence: Synthetic coding sequence
atgggcagccggcccaggagccccagcgccttccctgccccctggtggggccagcagcccggcggccctggccctgccaagaggctgcggctggaggagcctgctggccctgagccccgggtggcccccagcctggaggaccctgctggcaccccagctgtgggcgccctgaccagcatcgtggtgctggccgccggctgtgccctgcgggtgcccctggatgatgtggacctggtgctggagctgccccccaccagcatcctgcgggtgtccctggatggccacaccctcatcctgatccctgaggtgctgctgagctctgtggatgagaggtctggggcccaggatgacagcagcgctggcctggaggtggatgtgttcctgggcgccctgagagaagatgtggtggtggagcaggaggtgttctgtgcctctgtgcctgagattgctgcccaggaggaggcctatgaggaggatgctgaccctgagttccctgagctgcagatggattctgctgctggcagcgctgctggcctgtacagcagcgcccgctccatgttcagcccctaccgggagggccccatccctgagccctgtgccctggcccccaaccccagcagcgagggccacagccctggccccttctttgatcctgagttccggctgctggagcctgtgcccagcagccccctgcagcccctgccccccagcccccgggtgggcagccctggcccccacgcccacccccccctgcccaagaggcctccctgcaaggccaggagaagactcttccaggagtag

SEQ ID NO: 41032 - DNA, 798 bp, Artificial Sequence
  Description of Artificial Sequence: Synthetic coding sequence
atggtgtcccggcccaggagccccagcgccttccctgccccctggtggggccagcagcccggcggccctggccctgccaagaggctgcggctggaggagcctgctggccctgagcccagggctgcccccagcctggaggaccctgctggggaccctgctgtggatgccctgaccagcatcgtggtgctggccgccggctgtgccctgcgggtgcccctggatgatgtggacctggtgctggagcccgcccccaccagcatcctgcgggtgtccctgggcggccacaccctcatcctgatccctgaggtgctgctgagctctgtggatgagaggtctggggcccagcacgacagcagcgctggcctggaggtggatgtgttcctgggcgctgtgagagaagatgtggtggtggagctggagttctgtgcctctgtgcctgagattgctgcccaggaggaggcctatgaagaagatgctgaccctgagttccctgagctgaggatggacagccccaccggcagcgctgctggcctgtaccccagcagccgctccatgttcatcccctaccgggagggccccatccctgagccctgtgccctggcccccaaccccagcagcgagcggcgcagcccccggcccatctttgacctggagttccggctgctggagcctgtgcccagcagccccctgcagcccctgccccccagcccctgtgtgggcagccctggcccccacgcccggagccccctgcctgagcggcccccctgcaaggcccggcggcggctcttccaggcctag

SEQ ID NO: 41033 - DNA, 789 bp, Artificial Sequence
  Description of Artificial Sequence: Synthetic coding sequence
atgggcagccggccctgcagccccagcgcctgcctggccccctggtggggccagcagcccggcggccctggccctgccaagaggagccggctggaggagcctgctggccctgagagcagagctgcccccagccctgaggaccctgctggcaccccagctgtggatgccctgacctccatggtggtgctggatgctggctgtgccctgcgggtgcccctggaggatgtggacctggtgctggagctggcccccatgtctgtgctgcgggtgtccctgggcggccacaccctcatcgtcatccctgaggtgctgctgagctctgtggatgagtgcagcggggcccagggcgactggagcgctggcctggaggtggatgtgttcctgggcgcccatggagaagatgtggtggtggagcaggaggtgtgtgcctctgtgcctgagattgctgctgaggaggaggcctatgaagaagatgctgacagcgagttccctgagctgtggatggacagcgctgctggcagcgctgctggcctgtaccccagcgcccgctccatgttcagcccctaccgggagggccccatccggggcccctgtgccctggcccccaaccccagcagcgagcggcgcagcccccggcccatctttgacctggagttccacctgctggagcctgtgcccagcagccccctgcagcccctgccccccagccccagccctggcccccacgcccggcctgagctgcctgagaggcctccctgcaaggtgagaagaagactcttccaggagtag

SEQ ID NO: 41034 - DNA, 789 bp, Artificial Sequence; identical to SEQ ID NO: 41033
  Description of Artificial Sequence: Synthetic coding sequence

SEQ ID NO: 41035 - DNA, 429 bp, Artificial Sequence
  Description of Artificial Sequence: Synthetic coding sequence
atgaggggcaccagctgtgtgggcggcggcgctgagagccctgggggcgccggcctgtctgagggcccccggggccgctggctgcggctggcccctgtgtgtgcctacttcctgtgtgtgtccctggccgctgtgctgctggccgtgtactacggcctcatctgggtgcccaccaggagccctgctgccccagctggcccccagcccagcgcccccagccccccctgtgccgcccggcctggggtgccccctgtgcctgccccagctgctgccagcctgagctgcctgctgggcgtgcctgggggcccccggccccagctgcagctgcccctgagcagaagaagacgctacagcgaccctgaccggcggcccagccggcagaccccccgggagaccccagaggccgctgagggcagaagacctggatag

SEQ ID NO: 41036 - DNA, 1209 bp, Artificial Sequence
  Description of Artificial Sequence: Synthetic coding sequence
atggccaggacagaccagaagccaccctgccggggcggctgctggggccagcccggccaccccaacacaggaggagctgctgcccaccccacctaccaccccatgggccaccggcccaggacctgcatcctgctgcggggggaccagaccactggaggccaggcccccagccgggagatcagcctgggcccctgggccgccggcacccacttcctggccatcagcaccaccccctggggcaggaagaccccagcctgcatcagcgagctgcccaccagcagcggcacagcccagcccctggccaatgctgtgtgtgaggtgcagacagtgcccggccctggcctgcggccccagggcaccccagccatgagggcccccagccacaagggcaccccacccacccccaacccctggggccctgagcagccccagaacagacacaagcaccccaagaagggcgtgactggaggccccagccccccacctcctgctgccagccgctatggccagaccccaggccgggagccccgggtgcaggcccctggcctgggcccctgtggccgcccagccagcggccgcctgctgagcctgcacctggagaagggagatggcaagggcacccggcagaggatccccctgacagatgctgctgtgggcggggacagaacagacatccccagcgccatcgctgctggccctgcccggaccccagacagacatggcctgcccatccctggcagcacccccacccccatggtgggcagcggccgcctgggcgcccctgtgggccgcagcggcggcggggccagcgcccggagcagccggcccagctgtgccaacgtgctgctgcgggcagatgccagcctgggcaccgtgctgtctgtgctgtggacaggccagctgagccggggctgggccctgctgcccccaggagatgctggccgccacctggagaccagcgtcatctctgctggggtggccgccggcatctggctggtggagcctggagaggccgcccaggaccctgccaccaggagaacagcccccccaagaagaacagccagccctgagcccccagcccctggggcccccctgcctgcctgccccggccgcatccctggagctgcccgcttcggccccaggagctgccccctgggcagccctgctgtgctggccgtgaccaccggctggagccacaggtctgtgtag

SEQ ID NO: 41037 - DNA, 351 bp, Artificial Sequence
  Description of Artificial Sequence: Synthetic coding sequence
atgtccttcagcgagcagcagtgcaagcagccctgtgtgcccccaccctgcctgcccaagacccaggagcagtgccaggccaaggccgaggaggtgtgcctgcccacctgccagcacccctgccaggacaagtgcctggtgcaggcccaggaggtgtgcctgagccagtgccaggagagcagccaggagaagtgcccccagcagggccaggagccctacctgcccccctgccaggaccagtgccccccccagtgtgccgagccctgccaggagctgttccagaccaagtgtgtggaggtgtgcccccagaaggtgcaggagaagtgcagcagccctgggaagggcaagtag

SEQ ID NO: 41038 - DNA, 657 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagaccaaggagttctggagcacctacaccaaggcccagcagggcgagagcaacagaggaagtgactggttccagttctacctgaccttccccctcatcttcggcctcttcatcatcctgctggtgatcttcctgatctggcgctgcttcctgaggaacaagacccggcggcagacagtgacagagggccacatccccttcccccagcacctgaacatcatcaccccacctcctcctccagatgaggtgtttgacagcagcggcctgagccctggcttcctgggctacgtggtgggccgcagtgacagcgtgtccacccggctgagcaactgtgaccccccacccacctatgaggaggccaccggccaggtgaacctgcagaggagtgaaacagagccccacctggaccccccaccagaatatgaagatattgtgaacagcaacagcgccagcgccatccccatggtgcctgtggtgaccaccatcaagtag

SEQ ID NO: 41039 - DNA, 657 bp, Artificial Sequence; identical to SEQ ID NO: 41038
  Description of Artificial Sequence: Synthetic coding sequence

SEQ ID NO: 41040 - DNA, 657 bp, Artificial Sequence; identical to SEQ ID NO: 41038
  Description of Artificial Sequence: Synthetic coding sequence

SEQ ID NO: 41041 - DNA, 657 bp, Artificial Sequence; identical to SEQ ID NO: 41038
  Description of Artificial Sequence: Synthetic coding sequence

SEQ ID NO: 41042 - DNA, 249 bp, Artificial Sequence
  Description of Artificial Sequence: Synthetic coding sequence
atggaccccggccccaagggccactgccactgcggcggccacggccaccccccaggccactgcggccccccacctggccacggccctggcccctgtggccccccaccccaccacggccctggcccctgtggccccccacctggccacggccctggcccctgtggccccccaccccaccacggccctggcccctgtggccccccacctggccacggccctggccaccccccacctggcccccaccactag

SEQ ID NO: 41043 - DNA, 246 bp, Artificial Sequence
  Description of Artificial Sequence: Synthetic coding sequence
atggaccccgggaagggccactgccactgcggcggccacggccaccccccaggccactgcggccccccacctggccacggccctggcccctgtggccccccaccccaccacggccctggcccctgtggccccccacctggccacggccctggcccctgtggccccccaccccaccacggccctggcccctgtggccccccacctggccacggccctggccaccccccacctggcccccaccactag

SEQ ID NO: 41044 - DNA, 537 bp, Artificial Sequence
  Description of Artificial Sequence: Synthetic coding sequence
tgaagaagccaggtgtacatgcaccccagcctgagcccccccagcaccatgatcctgagcggcggcacagccctgaagccaccctacagcgccttccctggcatgcagcccctggagatggtgaagccccagagcggcagcccctaccagcccatgagcggcaaccaggccctggtgtatgagggccagctgagccaggccgccggcctgggcgccagccagatgctggacagccagctgccccagctgaccatgcccctgcccaggtatggcagcggccagcagcccctcatcctgccccagagcatccagctgcccccaggccagagcctgtctgtgggcgccccccggcgcatccccccacctggcagccagccccctgtgctgaacaccagccgggagcccagccagatggagatgaagggcttccactttgctgacagcaagcagaatgtgcccagcggcggccctgtgcccagcccccagacctaccggcagaacaatgagtggatgaggaacccagcctgggagccctag

SEQ ID NO: 41045 - DNA, 6690 bp, Artificial Sequence
  Description of Artificial Sequence: Synthetic coding sequence
atgtctgaccggctgggccagatcaccaagggcaaggatggcaagagcaagtacagcaccctgagcctgtttgacaagtacaagggcaagtctgtggatgccatccgcagcagcgtcatccccaggcatggcctgcagagcctgggcaaggtggccgccgcccggaggatgcctcctccagccaacctgcccagcctgaagtcagaaaataaaggaaatgaccccaacatcgtgattgtgcccaaggatggcaccggctgggccaacaagcaggaccagcaggaccccaagagcagcagcgccacagccagccagcccccagagagcctgccccagcccggcctgcagaagtctgtgagcaacctgcagaagcccacccagagcatcagccaggagaacaccaacagcgtgcctgggggccccaagtcctgggcccagctgaatggcaagcctgtgggccacgagggcggcctgcggggcagcagccggctgctgtccttcagccctgaggagttccccaccctgaaggccgccggcggccaggacaaggccggcaaggagaagggcgtgctggacctgtcctatggccctggccccagcctgcggccccagaatgtgacctcctggagggagggcggcggccgccacatcatcagcgccaccagcctgagcaccagccccacagagctgggcagcaggaacagcagcactggagatggagcccccagcagcgcctgcaccagtgacagcaaggaccccagcctgcggcctgcccagcctgtgaggaaaggagccagccagttcatgggaaatgtgtaccacccccccacctaccatgacatgctgcctgccttcatgtgcagccccaagagcagcgagaaccagggcaccgtggagcggggcagcttccccctgccccagctgcggctggagccccgggtgcccttccggcagttccagatgaatgaccaggacggcaaggagaaccggctgggcctgagccggcccctgcggcccctgcggcagctggtggagcgggccccccggcccaccatcatcaatgctgagaacctgaagggcctggatgacctggatgctgatgctgatgatggctgggccggcctgcacgaggaggtggactacagcgagaagctgaagttcagtgatgatgaggaggaggaggaggtggtgaaggatggccggcccaagtggaacagctgggacccccggcggcagaggcagctgtccatgagcagcgctgacagcgcagatgccaagaggacccgggaggagggcaaggactgggccgaggccgtgggcgccagccgggtggtgaggaaggccccagacccccagcccccacccaggaagctgcacggctgggcccctggccctgactaccagaagagctccatgggctccatgttccggcagcagagcattgaggacaaggaggacaagcccccaccccggcagaagttcatccagagcgagatgtctgaggccgtggagcgggccaggaagagaagagaggaggaggagcggcgggcccgggaggagcggctggccgcctgtgccgccaagctgaagcagctggaccagaagtgcaagcaggccaggaaggccggggaggccaggaagcaggccgagaaggaggtgccctggagccccagcgctgagaaggccagcccccaggagaatggacctgctgtgcacaagggcagccctgagttccctgcccaggagacccccaccaccttccctgaggaggcccccaccgtgtccccagctgtggcccagagcaacagcagcgaggaggaggcccgggaggccggcagccctgcccaggagttcaagtaccagaagagcctgcccccacgcttccagaggcagcagcagcagcagcagcaggagcagctgtacaagatgcagcactggcagcctgtgtaccccccacccagccacccccagaggaccttctacccccaccacccccagatgctgggctttgacccccgctggatgatgatgcccagctacatggacccccgcatcacccccaccaggacccctgtggacttctaccccagcgccctgcaccccagcggcctgatgaagcccatgatgccccaggagagcctgaatggaacaggctgccgctctgaggaccagaactgtgtgccccccctgcaggagaggaaggtgacccccatcgacagcccccctgtgtggagccctgagggctacatggccctgcagagcaagggctaccccctgccccaccccaagagcagtgacaccctggccatggacatgagggtgagaaatgaaagcagcttcagcgccagcctgggccgggccggcggcgtgtctgcccagagggacctgtttgaggagcggggggaggagtacctgagcgcctttgacaagaaggcccaggccgactttgacagctgcatcagcagccagagaattggccaggagctgctcttccccccccaggagaatgtgcaggatgctggggcccctgggggccacacccagaacctgcgctgcagccccctggagccagactttgtgcctgatgagaagaagccagaatgtggctcctgggatgtgagccaccagcctgagacagctgacacagcccacggcgtggagcgggagaccccccgggagggcacagccttcaacatcagctcctgggacaagaatggcagccccaacaagcagcccagcagcgagcctgagtggaccccagagcccaggagcagcagcagccagcaccctgagcagacaggccgcaccaggagaagtggccccatcaagaagcctgtgctgaaggccctgaaggtggaggacaaggagaaggagctggagaagatcaagcaggagctgggggaggagagcacccggctggccaaggagaaggagcagagccccacagctgagaaggatgaagatgaggagaatgatgccagcctggccaacagcagcaccaccaccctggaggacaagggccctggccacgccaccttcggccgggaggccaccaagtttgaggaggaggagaagccagacaaggcctgggaggcccggcccccccgggagagcagtgatgtgccccccatgaagaggaacaactggatcttcattgatgaggagcaggccttcggcgtgcggggccaggcccggggccggggccggggcttccgggagttcaccttccggggccggcctgctggaggaaatggcagcggcctgtgtggcggcggcgtgctgggcgcccggagcatctactgcagcagccagaggagcggccggggccggggcctgcgggagtttgcccggcctgaggactgcccccgggccaagccccggcggcgggtggccagcgagacccacagcgagggctctgaatatgaggagctgcccaagagaagacggcagaggggctctgaaaatggaaatgaaggcagcctgctggagcgggaggagagcaccctgaagaagggggactgccgggacagctggaggagcaacaagggctgcagcgaggaccacagcggcctggatgccaagagccggggcccccgggccttcggccgggccctgcccccccggctgagcaactgtggctacggccgccgcacctttgtgtccaaggagagcccccactggcagagcaagagccctggcagctcctggcaggagtatggccccagcgacacctgtggcagccggcggcccacagaccgggactatgtgcctgacagctaccgccacccagatgccttcggcggccggggctttgaggacagcagagctgaggacaagaggagcttcttccaggatgaacatgtggccgacagtgaaaatgcagaaaatcggcccttcagaagaagaagaccaccccggcaggacaagccaccccgcttccggcggctgcggcaggagcgggagagcctgggcctgtggggccctgaggaggagccccacctgctggccggccagtggccaggccggcccaagctgtgcagcggggacaagtctggaacagtgggccgccgcagccctgagctgagctaccagaacagcagtgaccacgccaatgaggagtgggagacagccagcgagagcagtgacttcagcgagcggcgggagcggcgggagggccctggcagcgagccagacagccaggtggatggcggcctgagcggggccagcctgggggagaagaaggagctggccaagaggagcttcagcagccagaggcctgtggtggaccggcagagcaggaagctggagcccggcggctttggagagaagcctgtgcggcctgggggcggggacaccagccccaggtatgagagccagcagaatggcacccccctgaaggtgaagaggagcccagatgaggccctgcccggcggcctgagcggctgcagcagcggcagcggccacagcccctatgccctggagcgggccgcccacgccagcgctgacctgcctgaggccagcagcaagaaggccgagaaggaggccaagctggccgccccccgggccggggagcagggcgaggccatgaagcagtttgacctgaactacggcagcgccatcatcgagaactgtggcagcagccctggagaggagagcgaggtgggctccatggtgggggagggcttcatcgaggtgctgaccaagaagcagaggcggctgctggaggaggagaggaggaagaaggagcaggccgtgcaggtgcctgtgaagggccggggcctgagcagccgcatccccccaagatttgccaagaagcagaacaacctgtgcctggagcagggagatgtgacagtgcccggcagcagcctgggcacagagatctgggagagcagcagccaggccctgcctgtgcaggccccagccaatgacagctggaggaaggctgtgacagccttcagcagcacagaaacaggcagcgctgagcagggcttcaagagcagccagggcgacagcggcgtggacctgtctgctgagagccgggagagcagcgccaccagcagccagaggagcagcccctacggcaccctgaagccagaggagatgagcggccctggcctggccgagcccaaggctgacagccacaaggagcaggcccccaagcccagcgagcagaaggacagcgagcagggcagcggccagagcaaggagcacaggcctggccccatcggaaatgaaagaagcctgaagaacaggaagggcagcgagggcgctgagcggctgcagggcgctgtggtgccccctgtgaatggagtggagatccacgtggacagcgtgctgcctgtgccccccatcgagtttggagtgagccccaaggacagcgacttcagcctgcccccaggcagcgccagcggccccaccggcagccctgtggtgaagctgcaggatgccctggccagcaatgccggcctgacccagagcatccccatcctgcggcgggaccaccacatccagagggccatcggcctgagccccatgtccttccccacagctgacctgaccctgaagatggagagcgccaggaaggcctgggagaacagccccagcctgcctgagcagagcagccctggaggagctggcagcggcatccagccccccagctctgtgggcgccagcagcggcgtgaactacagcagctttggaggagtgtccatgccacccatgcctgtggcctctgtggcccccagcgcctccatgcctggcagccacctgccccccctgtacctggatggccacgtgtttgccagccagccccggctggtgccccagaccatcccccagcagcagagctaccagcaggccgctgctgcccagcagatccccatcagcctgcacaccagcctgcaggcccaggcccagctgggcctgcggggcggcctgcctgtgtcccagagccaggagatcttcagcagcctgcagcccttccgcagccaggtgtacatgcaccccagcctgagcccccccagcaccatgatcctgagcggcggcacagccctgaagccaccctacagcgccttccctggcatgcagcccctggagatggtgaagccccagagcggcagcccctaccagcccatgagcggcaaccaggccctggtgtatgagggccagctgagccaggccgccggcctgggcgccagccagatgctggacagccagctgccccagctgaccatgcccctgcccaggtatggcagcggccagcagcccctcatcctgccccagagcatccagctgcccccaggccagagcctgtctgtgggcgccccccggcgcatccccccacctggcagccagccccctgtgctgaacaccagccgggagcccagccagatggagatgaagggcttccactttgctgacagcaagcagaatgtgcccagcggcggccctgtgcccagcccccagacctaccggcccagcagcgccagccccagcggcaagcccagcggcagcgctgtgaacatgggctctgtgcagggccactacgtgcagcaggccaagcagagggtggatgagaagcccagcctgggcgctgtgaagctgcaggaggcccccagcgctgccagccagatgaagaggactggagccatcaagcccagggctgtgaaggtggaggagagcaaggcctag

SEQ ID NO: 41046 - DNA, 807 bp, Artificial Sequence
  Description of Artificial Sequence: Synthetic coding sequence
atgccacccatgcctgtggcctctgtggcccccagcgcctccatgcctggcagccacctgccccccctgtacctggatggccacgtgtttgccagccagccccggctggtgccccagaccatcccccagcagcagagctaccagcaggccgccgccgcccagcagatccccatcagcctgcacaccagcctgcaggcccaggcccagctgggcctgcggggcggcctgcctgtgtcccagagccaggagatcttcagcagcctgcagcccttccgcagccaggtgtacatgcaccccagcctgagcccccccagcaccatgatcctgagcggcggcacagccctgaagccaccctacagcgccttccctggcatgcagcccctggagatggtgaagccccagagcggcagcccctaccagcccatgagcggcaaccaggccctggtgtatgagggccagctgagccaggccgccggcctgggcgccagccagatgctggacagccagctgccccagctgaccatgcccctgcccaggtatggcagcggccagcagcccctcatcctgccccagagcatccagctgcccccaggccagagcctgtctgtgggcgccccccggcgcatccccccacctggcagccagccccctgtgctgaacaccagccgggagcccagccagatggagatgaagggcttccactttgctgacagcaagcagaatgtgcccagcggcggccctgtgcccagcccccagacctaccggcagaacaatgagtggatgaggaacccagcctgggagccctag

SEQ ID NO: 41047 - DNA, 4608 bp, Artificial Sequence
  Description of Artificial Sequence: Synthetic coding sequence
atgtctgaccggctgggccagatcaccaagggcaaggatggcaagagcaagtacagcaccctgagcctgtttgacaagtacaagggcaagtctgtggatgccatccgcagcagcgtcatccccaggcatggcctgcagagcctgggcaaggtggccgccgcccggaggatgcctcctccagccaacctgcccagcctgaagtcagaaaataaaggaaatgaccccaacatcgtgattgtgcccaaggatggcaccggctgggccaacaagcaggaccagcaggaccccaagagcagcagcgccacagccagccagcccccagagagcctgccccagcccggcctgcagaagtctgtgagcaacctgcagaagcccacccagagcatcagccaggagaacaccaacagcgtgcctgggggccccaagtcctgggcccagctgaatggcaagcctgtgggccacgagggcggcctgcggggcagcagccggctgctgtccttcagccctgaggagttccccaccctgaaggccgccggcggccaggacaaggccggcaaggagaagggcgtgctggacctgtcctatggccctggccccagcctgcggccccagaatgtgacctcctggagggagggcggcggccgccacatcatcagcgccaccagcctgagcaccagccccacagagctgggcagcaggaacagcagcactggagatggagcccccagcagcgcctgcaccagtgacagcaaggaccccagcctgcggcctgcccagcctgtgaggaaaggagccagccagttcatgggaaatgtgtaccacccccccacctaccatgacatgctgcctgccttcatgtgcagccccaagagcagcgagaaccagggcaccgtggagcggggcagcttccccctgccccagctgcggctggagccccgggtgcccttccggcagttccagatgaatgaccaggacggcaaggagaaccggctgggcctgagccggcccctgcggcccctgcggcagctggtggagcgggccccccggcccaccatcatcaatgctgagaacctgaagggcctggatgacctggatgctgatgctgatgatggctgggccggcctgcacgaggaggtggactacagcgagaagctgaagttcagtgatgatgaggaggaggaggaggtggtgaaggatggccggcccaagtggaacagctgggacccccggcggcagaggcagctgtccatgagcagcgctgacagcgcagatgccaagaggacccgggaggagggcaaggactgggccgaggccgtgggcgccagccgggtggtgaggaaggccccagacccccagcccccacccaggaagctgcacggctgggcccctggccctgactaccagaagagctccatgggctccatgttccggcagcagagcattgaggacaaggaggacaagcccccaccccggcagaagttcatccagagcgagatgtctgaggccgtggagcgggccaggaagagaagagaggaggaggagcggcgggcccgggaggagcggctggccgcctgtgccgccaagctgaagcagctggaccagaagtgcaagcaggccaggaaggccggggaggccaggaagcaggccgagaaggaggtgccctggagccccagcgctgagaaggccagcccccaggagaatggacctgctgtgcacaagggcagccctgagttccctgcccaggagacccccaccaccttccctgaggaggcccccaccgtgtccccagctgtggcccagagcaacagcagcgaggaggaggcccgggaggccggcagccctgcccaggagttcaagtaccagaagagcctgcccccacgcttccagaggcagcagcagcagcagcagcaggagcagctgtacaagatgcagcactggcagcctgtgtaccccccacccagccacccccagaggaccttctacccccaccacccccagatgctgggctttgacccccgctggatgatgatgcccagctacatggacccccgcatcacccccaccaggacccctgtggacttctaccccagcgccctgcaccccagcggcctgatgaagcccatgatgccccaggagagcctgaatggaacaggctgccgctctgaggaccagaactgtgtgccccccctgcaggagaggaaggtgacccccatcgacagcccccctgtgtggagccctgagggctacatggccctgcagagcaagggctaccccctgccccaccccaagagcagtgacaccctggccatggacatgagggtgcgcagcccagatgaggccctgcccggcggcctgagcggctgcagcagcggcagcggccacagcccctatgccctggagcgggccgcccacgccagcgctgacctgcctgaggccagcagcaagaaggccgagaaggaggccaagctggccgccccccgggccggggagcagggcgaggccatgaagcagtttgacctgaactacggcagcgccatcatcgagaactgtggcagcagccctggagaggagagcgaggtgggctccatggtgggggagggcttcatcgaggtgctgaccaagaagcagaggcggctgctggaggaggagaggaggaagaaggagcaggccgtgcaggtgcctgtgaagggccggggcctgagcagccgcatccccccaagatttgccaagaagcagaacaacctgtgcctggagcagggagatgtgacagtgcccggcagcagcctgggcacagagatctgggagagcagcagccaggccctgcctgtgcaggccccagccaatgacagctggaggaaggctgtgacagccttcagcagcacagaaacaggcagcgctgagcagggcttcaagagcagccagggcgacagcggcgtggacctgtctgctgagagccgggagagcagcgccaccagcagccagaggagcagcccctacggcaccctgaagccagaggagatgagcggccctggcctggccgagcccaaggctgacagccacaaggagcaggcccccaagcccagcgagcagaaggacagcgagcagggcagcggccagagcaaggagcacaggcctggccccatcggaaatgaaagaagcctgaagaacaggaagggcagcgagggcgctgagcggctgcagggcgctgtggtgccccctgtgaatggagtggagatccacgtggacagcgtgctgcctgtgccccccatcgagtttggagtgagccccaaggacagcgacttcagcctgcccccaggcagcgccagcggccccaccggcagccctgtggtgaagctgcaggatgccctggccagcaatgccggcctgacccagagcatccccatcctgcggcgggaccaccacatccagagggccatcggcctgagccccatgtccttccccacagctgacctgaccctgaagatggagagcgccaggaaggcctgggagaacagccccagcctgcctgagcagagcagccctggaggagctggcagcggcatccagccccccagctctgtgggcgccagcagcggcgtgaactacagcagctttggaggagtgtccatgccacccatgcctgtggcctctgtggcccccagcgcctccatgcctggcagccacctgccccccctgtacctggatggccacgtgtttgccagccagccccggctggtgccccagaccatcccccagcagcagagctaccagcaggccgctgctgcccagcagatccccatcagcctgcacaccagcctgcaggcccaggcccagctgggcctgcggggcggcctgcctgtgtcccagagccaggagatcttcagcagcctgcagcccttccgcagccaggtgtacatgcaccccagcctgagcccccccagcaccatgatcctgagcggcggcacagccctgaagccaccctacagcgccttccctggcatgcagcccctggagatggtgaagccccagagcggcagcccctaccagcccatgagcggcaaccaggccctggtgtatgagggccagctgagccaggccgccggcctgggcgccagccagatgctggacagccagctgccccagctgaccatgcccctgcccaggtatggcagcggccagcagcccctcatcctgccccagagcatccagctgcccccaggccagagcctgtctgtgggcgccccccggcgcatccccccacctggcagccagccccctgtgctgaacaccagccgggagcccagccagatggagatgaagggcttccactttgctgacagcaagcagaatgtgcccagcggcggccctgtgcccagcccccagacctaccggcccagcagcgccagccccagcggcaagcccagcggcagcgctgtgaacatgggctctgtgcagggccactacgtgcagcaggccaagcagagggtggatgagaagcccagcctgggcgctgtgaagctgcaggaggcccccagcgctgccagccagatgaagaggactggagccatcaagcccagggctgtgaaggtggaggagagcaaggcctag

SEQ ID NO: 41048 - DNA, 2391 bp, Artificial Sequence
  Description of Artificial Sequence: Synthetic coding sequence
atgaagcccatgatgccccaggagagcctgaatggaacaggctgccgctctgaggaccagaactgtgtgccccccctgcaggagaggaaggtgacccccatcgacagcccccctgtgtggagccctgagggctacatggccctgcagagcaagggctaccccctgccccaccccaagagcagtgacaccctggccatggacatgagggtgagaaatgaaagcagcttcagcgccagcctgggccgggccggcggcgtgtctgcccagagggacctgtttgaggagcggggggaggagtacctgagcgcctttgacaagaaggcccaggccgactttgacagctgcatcagcagccagagaattggccaggagctgctcttccccccccaggagaatgtgcaggatgctggggcccctgggggccacacccagaacctgcgctgcagccccctggagccagactttgtgcctgatgagaagaagccagaatgtggctcctgggatgtgagccaccagcctgagacagctgacacagcccacggcgtggagcgggagaccccccgggagggcacagccttcaacatcagctcctgggacaagaatggcagccccaacaagcagcccagcagcgagcctgagtggaccccagagcccaggagcagcagcagccagcaccctgagcagacaggccgcaccaggagaagtggccccatcaagaagcctgtgctgaaggccctgaaggtggaggacaaggagaaggagctggagaagatcaagcaggagctgggggaggagagcacccggctggccaaggagaaggagcagagccccacagctgagaaggatgaagatgaggagaatgatgccagcctggccaacagcagcaccaccaccctggaggacaagggccctggccacgccaccttcggccgggaggccaccaagtttgaggaggaggagaagccagacaaggcctgggaggcccggcccccccgggagagcagtgatgtgccccccatgaagaggaacaactggatcttcattgatgaggagcaggccttcggcgtgcggggccaggcccggggccggggccggggcttccgggagttcaccttccggggccggcctgctggaggaaatggcagcggcctgtgtggcggcggcgtgctgggcgcccggagcatctactgcagcagccagaggagcggccggggccggggcctgcgggagtttgcccggcctgaggactgcccccgggccaagccccggcggcgggtggccagcgagacccacagcgagggctctgaatatgaggagctgcccaagagaagacggcagaggggctctgaaaatggaaatgaaggcagcctgctggagcgggaggagagcaccctgaagaagggggactgccgggacagctggaggagcaacaagggctgcagcgaggaccacagcggcctggatgccaagagccggggcccccgggccttcggccgggccctgcccccccggctgagcaactgtggctacggccgccgcacctttgtgtccaaggagagcccccactggcagagcaagagccctggcagctcctggcaggagtatggccccagcgacacctgtggcagccggcggcccacagaccgggactatgtgcctgacagctaccgccacccagatgccttcggcggccggggctttgaggacagcagagctgaggacaagaggagcttcttccaggatgaacatgtggccgacagtgaaaatgcagaaaatcggcccttcagaagaagaagaccaccccggcaggacaagccaccccgcttccggcggctgcggcaggagcgggagagcctgggcctgtggggccctgaggaggagccccacctgctggccggccagtggccaggccggcccaagctgtgcagcggggacaagtctggaacagtgggccgccgcagccctgagctgagctaccagaacagcagtgaccacgccaatgaggagtgggagacagccagcgagagcagtgacttcagcgagcggcgggagcggcgggagggccctggcagcgagccagacagccaggtggatggcggcctgagcggggccagcctgggggagaagaaggagctggccaagaggagcttcagcagccagaggcctgtggtggaccggcagagcaggaagctggagcccggcggctttggagagaagcctgtgcggcctgggggcggggacaccagccccaggtatgagagccagcagaatggcacccccctgaaggtgaagaggagcccagatgaggccctgcccggcggcctgagcggctgcagcagcggcagcggccacagcccctgccctggggccggcagcccctgccagtgctag

SEQ ID NO: 41049 - DNA, 537 bp, Artificial Sequence
  Description of Artificial Sequence: Synthetic coding sequence
tgtgagggccggcaggccaaggtgaagagctccatgggctccatgttccggcagcagagcattgaggacaaggaggacaagcccccaccccggcagaagttcatccagagcgagatgtctgaggccgtggagcgggccaggaagagaagagaggaggaggagcggcgggcccgggaggagcggctggccgcctgtgccgccaagctgaagcagctggaccagaagtgcaagcaggccaggaaggccggggaggccaggaagcaggccgagaaggaggtgccctggagccccagcgctgagaaggccagcccccaggagaatggacctgctgtgcacaagggcagccctgagttccctgcccaggagacccccaccaccttccctgaggaggcccccaccgtgtccccagctgtggcccagagcaacagcagcgaggaggaggcccgggaggccggcagccctgcccaggagttcaagtaccagaagagcctgcccccacgcttccagaggcagcagcagcagcagcagcaggagtag

SEQ ID NO: 41050 - DNA, 1767 bp, Artificial Sequence
  Description of Artificial Sequence: Synthetic coding sequence
tgaggaagaggatttgaggacagcagagctgaggacaagaggagcttcttccaggatgaacatgtggccgacagtgaaaatgcagaaaatcggcccttcagaagaagaagaccaccccggcaggacaagccaccccgcttccggcggctgcggcaggagcgggagagcctgggcctgtggggccctgaggaggagccccacctgctggccggccagtggccaggccggcccaagctgtgcagcggggacaagtctggaacagtgggccgccgcagccctgagctgagctaccagaacagcagtgaccacgccaatgaggagtgggagacagccagcgagagcagtgacttcagcgagcggcgggagcggcgggagggccctggcagcgagccagacagccaggtggatggcggcctgagcggggccagcctgggggagaagaaggagctggccaagaggagcttcagcagccagaggcctgtggtggaccggcagagcaggaagctggagcccggcggctttggagagaagcctgtgcggcctgggggcggggacaccagccccaggtatgagagccagcagaatggcacccccctgaaggtgaagaggagcccagatgaggccctgcccggcggcctgagcggctgcagcagcggcagcggccacagcccctatgccctggagcgggccgcccacgccagcgctgacctgcctgaggccagcagcaagaaggccgagaaggaggccaagctggccgccccccgggccggggagcagggcgaggccatgaagcagtttgacctgaactacggcagcgccatcatcgagaactgtggcagcagccctggagaggagagcgaggtgggctccatggtgggggagggcttcatcgaggtgctgaccaagaagcagaggcggctgctggaggaggagaggaggaagaaggagcaggccgtgcaggtgcctgtgaagggccggggcctgagcagccgcatccccccaagatttgccaagaagcagaacaacctgtgcctggagcagggagatgtgacagtgcccggcagcagcctgggcacagagatctgggagagcagcagccaggccctgcctgtgcaggccccagccaatgacagctggaggaaggctgtgacagccttcagcagcacagaaacaggcagcgctgagggcttcaagagcagccagggcgacagcggcgtggacctgtctgctgagagccgggagagcagcgccaccagcagccagaggagcagcccctacggcaccctgaagccagaggagatgagcggccctggcctggccgagcccaaggctgacagccacaaggagcaggcccccaagcccagcgagcagaaggacagcgagcagggcagcggccagagcaaggagcaccggcccggccccatcggaaatgaaagaagcctgaagaacagaaaaggaagtgaaggagctgagcggctgcagggcgctgtggtgccccctgtgaatggagtggagatccacgtggacagcgtgctgcctgtgccccccattgaatttggagtgagccccaaggacagcgacttcagcctgcccccaggcagcgccagcggccccaccggcagccctgtggtgaagctgcaggatgccctggccagcaatgccggcctgacccagagcatccccatcctgcggcgggaccaccacatccagagggccatcggcctgagccccatgtccttccccacagctgacctgaccctgaagtag

SEQ ID NO: 41051 - DNA, 528 bp, Artificial Sequence
  Description of Artificial Sequence: Synthetic coding sequence
gagaggaaggtgacccccatcgacagcccccctgtgtggagccctgagggctacatggccctgcagagcaagggctaccccctgccccaccccaagagcagtgacaccctggccatggacatgagggtgagaaatgaaagcagcttcagcgccagcctgggccgggccggcggcgtgtctgcccagagggacctgtttgaggagcggggggaggagtacctgagcgcctttgacaagaaggcccaggccgactttgacagctgcatcagcagccagagaattggccaggagctgctcttccccccccaggagaatgtgcaggatgctggggcccctgggggccacacccagaacctgcgctgcagccccctggagccagactttgtgcctgatgagaagaagccagaatgtggctcctgggatgtgagccaccagcctgagacagctgacacagcccatggagtggagcgggagaccccccgggagggcacagccttcaacatcagctcctgggacaagaatggatag

SEQ ID NO: 41052 - DNA, 4608 bp, Artificial Sequence; identical to SEQ ID NO: 41047
  Description of Artificial Sequence: Synthetic coding sequence

SEQ ID NO: 41053 - DNA, 981 bp, Artificial Sequence
  Description of Artificial Sequence: Synthetic coding sequence
atgtctgaccggctgggccagatcaccaagggcaaggatggcaagagcaagtacagcaccctgagcctgtttgacaagtacaagggcaagtctgtggatgccatccgcagcagcgtcatccccaggcatggcctgcagagcctgggcaaggtggccgccgcccggaggatgcctcctccagccaacctgcccagcctgaagtcagaaaataaaggaaatgaccccaacatcgtgattgtgcccaaggatggcaccggctgggccaacaagcaggaccagcaggaccccaagagcagcagcgccacagccagccagcccccagagagcctgccccagcccggcctgcagaagtctgtgagcaacctgcagaagcccacccagagcatcagccaggagaacaccaacagcgtgcctgggggccccaagtcctgggcccagctgaatggcaagcctgtgggccacgagggcggcctgcggggcagcagccggctgctgtccttcagccctgaggagttccccaccctgaaggccgccggcggccaggacaaggccggcaaggagaagggcgtgctggacctgtcctatggccctggccccagcctgcggccccagaatgtgacctcctggagggagggcggcggccgccacatcatcagcgccaccagcctgagcaccagccccacagagctgggcagcaggaacagcagcactggagatggagcccccagcagcgcctgcaccagtgacagcaaggaccccagcctgcggcctgcccagcctgtgaggaaaggagccagccagttcatgggaaatgtgtaccacccccccacctaccatgacatgctgcctgccttcatgtgcagccccaagagcagcgagaaccagggcaccgtggagcggggcagcttccccctgccccagctgcggctggagccccgggtgcccttccggcagttccagatgaatgaccaggatggatag

SEQ ID NO: 41054 - DNA, 8454 bp, Artificial Sequence
  Description of Artificial Sequence: Synthetic coding sequence
atgtctgagaagagcggccagagcaccaaggccaaggatggcaagaagtatgccaccctgagcctcttcaacacctacaagggcaagagcctggagacccagaagaccacagcccggcacggcctgcagagcctgggcaaggtgggcatcagcaggaggatgcctcctccagccaacctgcccagcctgaaggccgagaacaagggaaatgaccccaacgtgaacatcgtgcccaaggatggcaccggctgggccagcaagcaggagcagcacgaggaggagaagaccccagaggtgcccccagcccagcccaagccaggagtggccgcccctcctgaggtggccccagcccccaagtcctgggccagcaacaagcagggcggccagggagatggcatccaggtgaacagccagttccagcaggagttccccagcctgcaggccgccggggaccaggagaagaaggagaaggagaccaatgatgacaactacggccctggccccagcctgcggccccccaacgtggcctgctggagagatggcggcaaggctgctggcagccccagcagcagtgaccaggatgagaagctgcccggccaggatgagagcacagctggcaccagcgagcagaatgacatcctgaaggtggtggagaagagaattgcctgtggccccccccaggccaagctgaatggccagcaggccgccctggccagccagtaccgggccatgatgccaccctacatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggaggaggagcccgtcttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccgcccagccatggacatcccccccatccaccctggcatgatcccccccaagcccctgatgaggcgggaccagatggagggcagccccaacagcagcgagagctttgagcacatcgcccggagcgcccgggaccacgccatcagcctgtctgagcccaggatgctgtggggcagtgacccctacccccatgctgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggaggtgaatgacaggcctgtgagaagaagtggccccatcaagaagcctgtgctgcgggacatgaaggaggagcgggagcagaggaaggagaaggagggggagaaggccgagaaggtgacagagaaggtggtggtgaagccagagaagacagagaagaaggacctgcccccacctcctcctccaccccagcccccagcccccatccagccccagagcgtgcccccacccatccagcctgaggccgagaagttccccagcacagaaacagccaccctggcccagaagcccagccaggacacagagaagcccctggagcctgtgtccacagtgcaggtggagcctgctgtgaagacagtgaaccagcagaccatggccgcccctgtggtgaaggaggagaagcagcctgagaaggtgatcagcaaggacctggtgattgaaagacccaggccagacagcaggcctgctgtgaagaaggagagcaccctgccccccaggacctactggaaggaggcccgggagcgggactggttcccagaccagggctaccggggccggggccgcggggagtactacagccggggccgcagctaccggggcagctatggaggccggggccggggcggccggggccacacccgggactacccccagtacagagacaacaagcccagggctgagcacatccccagcggccccctgcggcagcgggaggagagcgagaccaggtctgagagcagtgactttgaggtggtgcccaagagaagacggcagaggggcagcgagacagacacagattctgagatccacgagagcgccagtgacaaggacagcctgagcaagggcaagctgcccaagcgggaggagaggcctgagaacaagaagcctgtgaagccccacagcagcttcaagccagacaaccacgtgagaattgacaaccggctgctggagaagccctacgtgagagatgatgacaaggccaagccaggcttcctgcccaagggggagcccacccggcggggccggggcggcaccttcagaagaggaggccgggaccccggcggccggcccagccggcccagcaccctgcggcggcctgcctacagagacaaccagtggaacccccggcagagcgaggtgcccaagccagaagatggagagccccccaggagacatgagcagttcatccccatcgctgctgacaagaggcctcccaagtttgagaggaagtttgatcctgcccgggagcggccccggcggcagaggcccacccggcccccccggcaggacaagccaccccgcttccggcggctgcgggagcgggaggccgccagcaagagcaatgaggtggtggccgtgcccaccaacggcaccgtgaacaacgtggcccaggagcctgtgaacaccctgggggacatcagcggcaacaagaccccagacctgagcaaccagaacagcagtgaccaggccaatgaggagtgggagacagccagcgagagcagtgacttcaatgaaagaagagaaagagatgagaagaagaatgctgacctgaatgcccagacagtggtgaaggtgggagaaaatgtgctgccccccaagcgggagatcgccaagaggagcttcagcagccagaggcctgtggaccggcagaacagaagaggcaacaacggcccccccaagtctggaagaaacttcagcggccccagaaatgaaagaagaagtggcccccccagcaagagcggcaagaggggcccctttgatgaccagcctgctggcaccaccggggtggacctgatcaatggcagcagcgcccaccaccaggagggcgtgcccaacggcaccggccagaagaacagcaaggacagcacaggcaagaagcgggaggaccccaagccaggccccaagaagcccaaggagaaggtggatgccctgagccagtttgacctgaacaactatgcctctgtggtgatcattgatgaccaccctgaggtgacagtgattgaggacccccagagcaacctgaatgatgatggcttcacagaggtggtgtccaagaagcagcagaagaggctgcaggatgaggagaggaggaagaaggaggagcaggtgatccaggtgtggaacaagaagaatgccaatgagaagggccgcagccagaccagcaagctgccccccaggtttgccaagaagcaggccaccggcatccagcaggcccagagcagcgcctctgtgccccccctggccagcgcccccctgccccccagcaccagcgcctctgtgcctgccagcaccagcgcccccctgcctgccaccctgacccctgtgcctgccagcaccagcgcccctgtgcctgccagcaccctggcccctgtgctggccagcaccagcgcccctgtgcctgccagccccctggcccctgtgtctgccagcgcctctgtgtctgcctctgtgcctgccagcaccagcgctgctgccatcaccagcagcagcgccccagccagcgccccagcccccacccccatcctggcctctgtgtccaccccagcctctgtgaccatcctggccagcgccagcatccccatcctggccagcgccctggccagcaccagcgcccccaccccagccccagctgccagcagccctgctgcccctgtgatcacagcccccaccatcccagccagcgcccccacagcctctgtgcccctggccccagccagcgccagcgccccagccccagcccccacccctgtgtctgcccccaacccagcccccccagccccagcccagacccaggcccagacccacaagcctgtgcagaaccccctgcagaccaccagccagagcagcaagcagcccccacccagcatccggctgcccagcgcccagaccccaaatggaacagattatgtggccagcggcaagagcatccagaccccccagagccacggcaccctgacagctgagctgtgggacaacaaggtggcccccccagctgtgctgaatgacatcagcaagaagctgggccccatcagccccccccagcccccatctgtgtctgcctggaacaagcccctgaccagctttggcagcgcccccagcagcgagggcgccaagaatggccaggagagcggcctggagattggaacagacaccatccagtttggagccccagccagcaatggaaatgaaaatgaggtggtgcctgtgctgtctgagaagtctgctgacaagatccctgagcccaaggagcagaggcagaagcagcccagggctggccccatcaaggcccagaagctgcctgacctgagccctgtggagaacaaggagcacaagccaggccccatcggcaaggagaggagcctgaagaacaggaaggtgaaggatgcccagcaggtggagcctgagggccaggagaagcccagccctgccaccgtgcgcagcacagatcctgtgaccaccaaggagaccaaggctgtgtctgagatgagcacagagatcggcaccatgatctctgtgagcagcgcagaatatggcaccaatgccaaggagagcgtgacagactacaccacccccagcagcagcctgcccaacacagtggccaccaacaacaccaagatggaggacaccctggtgaacaacgtgcccctgcccaacaccctgcccctgcccaagcgggagaccatccagcagagcagcagcctgacctctgtgccccccaccaccttcagcctgaccttcaagatggagagcgccaggaaggcctgggagaacagccccaacgtgcgggagaagggcagccctgtgaccagcacagccccacccatcgccactggagtgagcagcagcgccagcggccccagcacagccaactacaacagcttcagcagcgcctccatgccccagatccctgtggcctctgtgacccccacagccagcctgagcggggccggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctcatcgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagcagatccccatccccatctatgcccccctgcagggccagcaccaggcccagctgagcctgggcgccggccctgctgtgtcccaggcccaggagctgttcagcagcagcctgcagccctaccgcagccagcctgccttcatgcagagcagcctgagccagcccagcgtggtgctgagcggcacagccatccacaacttccccaccgtgcagcaccaggagctggccaaggcccagagcggcctggccttccagcagaccagcaacacccagcccatccccatcctgtatgagcaccagctgggccaggccagcggcctgggcggcagccagctgattgacacccacctgctgcaggcccgggccaacctgacccaggccagcaacctgtacagcggccaggtgcagcagcccggccagaccaacttctacaacacagcccagagccccagcgccctgcagcaggtgacagtgcccctgcctgccagccagctgagcctgcccaactttggcagcacaggccagcccctcatcgccctgccccagaccctgcagccccccctgcagcacaccaccccccaggcccaggcccagagcctgagcaggcctgcccaggtgtcccagcccttccggggcctcatcccagctggcacccagcacagcatgattgccaccaccgggaagatgtctgagatggagctgaaggcctttggaagtggcatcgacatcaagccaggcaccccacccatcgccggccgcagcaccacccccaccagcagccccttccgggccaccagcaccagccccaacagccagagcagcaagatgaacagcatcgtgtaccagaagcagttccagagcgccccagccaccgtgaggatgacccagcccttccccacccagtttgccccccaggccaagcagagagctgaggtgctgcagagcacccagcgcttcttcagcgagcagcagcagagcaagcagattggaggcggcaaggcccagaaggtggacagcgacagcagcaagcccccagagaccctgacagatcctcctggggtgtgccaggagaaggtggaggagaagcccccaccagcccccagcatcgccaccaagcctgtgaggacaggccccatcaagccccaggccatcaagacagaggagaccaagagctag

SEQ ID NO: 41055 - DNA, 8697 bp, Artificial Sequence
  Description of Artificial Sequence: Synthetic coding sequence
atgtctgagaagagcggccagagcaccaaggccaaggatggcaagaagtatgccaccctgagcctcttcaacacctacaagggcaagagcctggagacccagaagaccaccgtggccgcccggcacggcctgcagagcctgggcaaggtgggcatcagcaggaggatgcctcctccagccaacctgcccagcctgaaggccgagaacaagggaaatgaccccaacgtgaacatcgtgcccaaggatggcaccggctgggccagcaagcaggagcagcacgaggaggagaagaccccagaggtgcccccagcccagcccaagccaggagtggccgcccctcctgaggtggccccagcccccaagtcctgggccagcaacaagcagggcggccagggagatggcatccaggtgaacagccagttccagcaggagttccccagcctgcaggccgccggggaccaggagaagaaggagaaggagaccaatgatgacaactacggccctggccccagcctgcggccccccaacgtggcctgctggagagatggcggcaaggctgctggcagccccagcagcagtgaccaggatgagaagctgcccggccaggatgagagcacagctggcaccagcgagcagaatgacatcctgaaggtggtggagaagagaattgcctgtggccccccccaggccaagctgaatggccagcaggccgccctggccagccagtaccgggccatgatgccaccctacatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggaggaggagcccgtcttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccgcccagccatggacatcccccccatccaccctggcatgatcccccccaagcccctgatgaggcgggaccagatggagggcagccccaacagcagcgagagctttgagcacatcgcccggagcgcccgggaccacgccatcagcctgtctgagcccaggatgctgtggggcagtgacccctacccccatgctgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggaggtgaatgacaggcctgtgagaagaagtggccccatcaagaagcctgtgctgcgggacatgaaggaggagcgggagcagaggaaggagaaggagggggagaaggccgagaaggtgacagagaaggtggtggtgaagccagagaagacagagaagaaggacctgcccccacctcctcctccaccccagcccccagcccccatccagccccagagcgtgcccccacccatccagcctgaggccgagaagttccccagcacagaaacagccaccctggcccagaagcccagccaggacacagagaagcccctggagcctgtgtccacagtgcaggtggagcctgctgtgaagacagtgaaccagcagaccatggccgcccctgtggtgaaggaggagaagcagcctgagaaggtgatcagcaaggacctggtgattgaaagacccaggccagacagcaggcctgctgtgaagaaggagagcaccctgccccccaggacctactggaaggaggcccgggagcgggactggttcccagaccagggctaccggggccggggccgcggggagtactacagccggggccgcagctaccggggcagctatggaggccggggccggggcggccggggccacacccgggactacccccagtacagagacaacaagcccagggctgagcacatccccagcggccccctgcggcagcgggaggagagcgagaccaggtctgagagcagtgactttgaggtggtgcccaagagaagacggcagaggggcagcgagacagacacagattctgagatccacgagagcgccagtgacaaggacagcctgagcaagggcaagctgcccaagcgggaggagaggcctgagaacaagaagcctgtgaagccccacagcagcttcaagccagacaaccacgtgagaattgacaaccggctgctggagaagccctacgtgagagatgatgacaaggccaagccaggcttcctgcccaagggggagcccacccggcggggccggggcggcaccttcagaagaggaggccgggaccccggcggccggcccagccggcccagcaccctgcggcggcctgcctacagagacaaccagtggaacccccggcagagcgaggtgcccaagccagaagatggagagccccccaggagacatgagcagttcatccccatcgctgctgacaagaggcctcccaagtttgagaggaagtttgatcctgcccgggagcggccccggcggcagaggcccacccggcccccccggcaggacaagccaccccgcttccggcggctgcgggagcgggaggccgccagcaagagcaatgaggtggtggccgtgcccaccaacggcaccgtgaacaacgtggcccaggagcctgtgaacaccctgggggacatcagcggcaacaagaccccagacctgagcaaccagaacagcagtgaccaggccaatgaggagtgggagacagccagcgagagcagtgacttcaatgaaagaagagaaagagatgagaagaagaatgctgacctgaatgcccagacagtggtgaaggtgggagaaaatgtgctgccccccaagcgggagatcgccaagaggagcttcagcagccagaggcctgtggaccggcagaacagaagaggcaacaacggcccccccaagtctggaagaaacttcagcggccccagaaatgaaagaagaagtggcccccccagcaagagcggcaagaggggcccctttgatgaccagcctgctggcaccaccggggtggacctgatcaatggcagcagcgcccaccaccaggagggcgtgcccaacggcaccggccagaagaacagcaaggacagcacaggcaagaagcgggaggaccccaagccaggccccaagaagcccaaggagaaggtggatgccctgagccagtttgacctgaacaactatgcctctgtggtgatcattgatgaccaccctgaggtgacagtgattgaggacccccagagcaacctgaatgatgatggcttcacagaggtggtgtccaagaagcagcagaagaggctgcaggatgaggagaggaggaagaaggaggagcaggtgatccaggtgtggaacaagaagaatgccaatgagaagggccgcagccagaccagcaagctgccccccaggtttgccaagaagcaggccaccggcatccagcaggcccagagcagcgcctctgtgccccccctggccagcgcccccctgccccccagcaccagcgcctctgtgcctgccagcaccagcgcccccctgcctgccaccctgacccctgtgcctgccagcaccagcgcccctgtgcctgccagcaccctggcccctgtgctggccagcaccagcgcccctgtgcctgccagccccctggcccctgtgtctgccagcgcctctgtgtctgcctctgtgcctgccagcaccagcgctgctgccatcaccagcagcagcgccccagccagcgccccagcccccacccccatcctggcctctgtgtccaccccagcctctgtgaccatcctggccagcgccagcatccccatcctggccagcgccctggccagcaccagcgcccccaccccagccccagctgccagcagccctgctgcccctgtgatcacagcccccaccatcccagccagcgcccccacagcctctgtgcccctggccccagccagcgccagcgccccagccccagcccccacccctgtgtctgcccccaacccagcccccccagccccagcccagacccaggcccagacccacaagcctgtgcagaaccccctgcagaccaccagccagagcagcaagcagcccccacccagcatccggctgcccagcgcccagaccccaaatggaacagattatgtggccagcggcaagagcatccagaccccccagagccacggcaccctgacagctgagctgtgggacaacaaggtggcccccccagctgtgctgaatgacatcagcaagaagctgggccccatcagccccccccagcccccatctgtgtctgcctggaacaagcccctgaccagctttggcagcgcccccagcagcgagggcgccaagaatggccaggagagcggcctggagattggaacagacaccatccagtttggagccccagccagcaatggaaatgaaaatgaggtggtgcctgtgctgtctgagaagtctgctgacaagatccctgagcccaaggagcagaggcagaagcagcccagggctggccccatcaaggcccagaagctgcctgacctgagccctgtggagaacaaggagcacaagccaggccccatcggcaaggagaggagcctgaagaacaggaaggtgaaggatgcccagcaggtggagcctgagggccaggagaagcccagccctgccaccgtgcgcagcacagatcctgtgaccaccaaggagaccaaggctgtgtctgagatgagcacagagatcggcaccatgatctctgtgagcagcgcagaatatggcaccaatgccaaggagagcgtgacagactacaccacccccagcagcagcctgcccaacacagtggccaccaacaacaccaagatggaggacaccctggtgaacaacgtgcccctgcccaacaccctgcccctgcccaagcgggagaccatccagcagagcagcagcctgacctctgtgccccccaccaccttcagcctgaccttcaagatggagagcgccaggaaggcctgggagaacagccccaacgtgcgggagaagggcagccctgtgaccagcacagccccacccatcgccactggagtgagcagcagcgccagcggccccagcacagccaactacaacagcttcagcagcgcctccatgccccagatccctgtggcctctgtgacccccacagccagcctgagcggggccggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctcatcgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagcagatccccatccccatctatgcccccctgcagggccagcaccaggcccagctgagcctgggcgccggccctgctgtgtcccaggcccaggagctgttcagcagcagcctgcagccctaccgcagccagcctgccttcatgcagagcagcctgagccagcccagcgtggtgctgagcggcacagccatccacaacttccccaccgtgcagcaccaggagctggccaaggcccagagcggcctggccttccagcagaccagcaacacccagcccatccccatcctgtatgagcaccagctgggccaggccagcggcctgggcggcagccagctgattgacacccacctgctgcaggcccgggccaacctgacccaggccagcaacctgtacagcggccaggtgcagcagcccggccagaccaacttctacaacacagcccagagccccagcgccctgcagcaggtgacagtgcccctgcctgccagccagctgagcctgcccaactttggcagcacaggccagcccctcatcgccctgccccagaccctgcagccccccctgcagcacaccaccccccaggcccaggcccagagcctgagcaggcctgcccaggtgtcccagcccttccggggcctcatcccagctggcacccagcacagcatgattgccaccaccgggaagatgtctgagatggagctgaaggcctttggaagtggcatcgacatcaagccaggcaccccacccatcgccggccgcagcaccacccccaccagcagccccttccgggccaccagcaccagccccaacagccagagcagcaagatgaacagcatcgtgtaccagaagcagttccagagcgccccagccaccgtgaggatgacccagcccttccccacccagtttgccccccagatcctgagccagcccaacctggtgccccccctggtgcgggccccccacaccaacaccttccctgcccctgtgcagaggcctcccatggccctggccagccagatgcccccacccctgaccaccggcctgatgagccacgcccggctgccccacgtggcccggggcccctgtggcagcctgagcggcgtgcggggcaaccaggcccaggccgccctgaaggccgagcaggacatgaaggccaagcagagagctgaggtgctgcagagcacccagcgcttcttcagcgagcagcagcagagcaagcagatcggcggcggcaaggcccagaaggtggacagcgacagcagcaagcccccagagaccctgacagaccccccaggagtgtgccaggagaaggtggaggagaagcccccaccagcccccagcatcgccaccaagcctgtgaggacaggccccatcaagccccaggccatcaagacagaggagaccaagagctag

SEQ ID NO: 41056 - DNA, 7962 bp, Artificial Sequence
  Description of Artificial Sequence: Synthetic coding sequence
gtgcccaaccagatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggccgaggaggagcctgtgttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccggcctgccatggacatcccccccatccaccctggcatgatcccccccaagcccctgatgagaagagaccagatggagggcagccccaacagcagcgagagctttgagcacatcgcccggagcgcccgggaccacgccatcagcctgtctgagcccaggatgctgtggggcagtgacccctacccccacgccgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggaggtgaatgacaggcctgtgcggcgcagcggccccatcaagaagcctgtgctgcgggacatgaaggaggagcgggagcagaggaaggagaaggagggggagaaggccgagaaggtgacagagaaggtggtggtgaagccagagaagacagagaagaaggacctgcccccacctcctcctccaccccagcccccagcccccatccagccccagagcgtgcccccacccatccagcctgaggccgagaagttccccagcacagaaacagccaccctggcccagaagcccagccaggacacagagaagcccctggagcctgtgtccacagtgcaggtggagcctgctgtgaagacagtgaaccagcagaccatggccgcccctgtggtgaaggaggagaagcagcctgagaaggtgatcagcaaggacctggtgattgagcggcccaggccagacagcaggcctgctgtgaagaaggagagcaccctgccccccaggacctactggaaggaggcccgggagcgggactggttcccagaccagggctaccggggccggggccgcggggagtactacagccggggccgcagctaccggggcagctatggaggccggggccggggcggccggggccacacccgggactacccccagtacagagacaacaagcccagggctgagcacatccccagcggccccctgcggcagcgggaggagagcgagaccaggtctgagagcagtgactttgaggtggtgcccaagagaagacggcagaggggcagcgagacagacacagacagcgagatccatgaaagtgccagtgacaaggacagcctgagcaagggcaagctgcccaagcgggaggagaggcctgagaacaagaagcctgtgaagccccacagcagcttcaagccagacaaccacgtgagaattgacaaccggctgctggagaagccctacgtgagagatgatgacaaggccaagccaggcttcctgcccaagggggagcccacccggcggggccggggcggcaccttccggcggggcggccgggaccccggcggccggcccagccggcccagcaccctgcggcggcctgcctacagagacaaccagtggaacccccggcagagcgaggtgcccaagccagaagatggagagcccccaagaagacatgagcagttcatccccatcgctgctgacaagaggcctcccaagtttgagaggaagtttgatcctgcccgggagcggccccggcggcagaggcccaccaggcctccccggcaggacaagcccccacgcttccggcggctgcgggagcgggaggccgccagcaagagcaatgaggtggtggccgtgcccaccaatggaacagtgaacaacgtggcccaggagcctgtgaacaccctgggggacatcagcggcaacaagaccccagacctgagcaaccagaacagcagtgaccaggccaatgaggagtgggagacagccagcgagagcagtgacttcaatgaaagaagagaaagagatgagaagaagaatgctgacctgaatgcccagacagtggtgaaggtgggggagaatgtgctgccccccaagcgggagatcgccaagaggagcttcagcagccagaggcctgtggaccggcagaacagaagaggcaacaatggaccacccaagagcggcaggaacttcagcggccccagaaatgaaagaagaagtggcccccccagcaagagcggcaagaggggcccctttgatgaccagcctgctggcaccactggagtggacctgatcaatggcagcagcgcccaccaccaggagggcgtgcccaatggaacaggccagaagaacagcaaggacagcacaggcaagaagcgggaggaccccaagccaggccccaagaagcccaaggagaaggtggatgccctgagccagtttgacctgaacaactatgcctctgtggtgatcattgatgaccaccctgaggtgacagtgattgaggacccccagagcaacctgaatgatgatggcttcacagaggtggtgtccaagaagcagcagaagaggctgcaggatgaggagaggaggaagaaggaggagcaggtgatccaggtgtggaacaagaagaatgccaatgagaagggccgcagccagaccagcaagctgcccccaagatttgccaagaagcaggccaccggcatccagcaggcccagagcagcgcctctgtgccccccctggccagcgcccccctgccccccagcaccagcgcctctgtgcctgccagcaccagcgcccccctgcctgccaccctgacccctgtgcctgccagcaccagcgcccctgtgcctgccagcaccctggcccctgtgctggccagcaccagcgcccctgtgcctgccagccccctggcccctgtgtctgccagcgcctctgtgtctgcctctgtgcctgccagcaccagcgctgctgccatcaccagcagcagcgccccagccagcgccccagcccccacccccatcctggcctctgtgtccaccccagcctctgtgaccatcctggccagcgccagcatccccatcctggccagcgccctggccagcaccagcgcccccaccccagccccagctgccagcagccctgctgcccctgtgatcacagcccccaccatcccagccagcgcccccacagcctctgtgcccctggccccagccagcgccagcgccccagccccagcccccacccctgtgtctgcccccaacccagcccccccagccccagcccagacccaggcccagacccacaagcctgtgcagaaccccctgcagaccaccagccagagcagcaagcagcccccacccagcatccggctgcccagcgcccagacccccaacggcacagattatgtggccagcggcaagagcatccagaccccccagagccacggcaccctgacagctgagctgtgggacaacaaggtggcccctcctgctgtgctgaatgacatcagcaagaagctgggccccatcagccccccccagccccccagcgtgtctgcctggaacaagcccctgaccagctttggaagtgcccccagcagcgagggcgccaagaatggccaggagagcggcctggagatcggcacagacaccatccagtttggagccccagccagcaatggaaatgaaaatgaggtggtgcctgtgctgtctgagaagtctgctgacaagatccctgagcccaaggagcagaggcagaagcagccccgggccggccccatcaaggcccagaagctgcctgacctgagccctgtggagaacaaggagcacaagccaggccccatcggcaaggagaggagcctgaagaacaggaaggtgaaggatgcccagcaggtggagcctgagggccaggagaagcccagccctgccaccgtgcgcagcacagatcctgtgaccaccaaggagaccaaggctgtgtctgagatgagcacagaaattggcaccatgatctctgtgtcctctgcagaatatggcaccaatgccaaggagagcgtgacagactacaccacccccagcagcagcctgcccaacacagtggccaccaacaacaccaagatggaggacaccctggtgaacaacgtgcccctgcccaacaccctgcccctgcccaagcgggagaccatccagcagagcagcagcctgacctctgtgccccccaccaccttcagcctgaccttcaagatggagagcgccaggaaggcctgggagaacagccccaacgtgcgggagaagggcagccctgtgaccagcacagccccacccatcgccaccggggtgagcagcagcgccagcggccccagcacagccaactacaacagcttcagcagcgcctccatgccccagatccctgtggcctctgtgacccccacagccagcctgtctggagctggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctgattgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagcagatccccatccccatctatgcccccctgcagggccagcaccaggcccagctgagcctgggcgccggccctgctgtgtcccaggcccaggagctgttcagcagcagcctgcagccctaccgcagccagcctgccttcatgcagagcagcctgagccagcccagcgtggtgctgtctggaacagccatccacaacttccccaccgtgcagcaccaggagctggccaaggcccagagcggcctggccttccagcagaccagcaacacccagcccatccccatcctgtatgagcaccagctgggccaggccagcggcctgggcggcagccagctgattgacacccacctgctgcaggcccgggccaacctgacccaggccagcaacctgtacagcggccaggtgcagcagcccggccagaccaacttctacaacacagcccagagccccagcgccctgcagcaggtgacagtgcccctgcctgccagccagctgagcctgcccaactttggcagcacaggccagcccctgattgccctgccccagaccctgcagccccccctgcagcacaccaccccccaggcccaggcccagagcctgagcaggcctgcccaggtgtcccagcccttccggggcctcatcccagctggcacccagcacagcatgattgccaccaccgggaagatgtctgagatggagctgaaggccttcggcagcggcatcgacatcaagccaggcaccccacccatcgccggccgcagcaccacccccaccagcagccccttccgggccaccagcaccagccccaacagccagagcagcaagatgaacagcatcgtgtaccagaagcagttccagagcgccccagccaccgtgaggatgacccagcccttccccacccagtttgccccccagatcctgagccagcccaacctggtgccccccctggtgcgggccccccacaccaacaccttccctgcccctgtgcagaggcctcccatggccctggccagccagatgcccccacccctgaccaccggcctgatgagccacgcccggctgccccacgtggcccggggcccctgtggcagcctgtctggagtgcggggcaaccaggcccaggccgccctgaaggccgagcaggacatgaaggccaagcagagagctgaggtgctgcagagcacccagcgcttcttcagcgagcagcagcagagcaagcagattggaggcggcaaggcccagaaggtggacagcgacagcagcaagcccccagagaccctgacagatcctcctggggtgtgccaggagaaggtggaggagaagcccccaccagcccccagcatcgccaccaagcctgtgaggacaggccccatcaagccccaggccatcaagacagaggagaccaagagctag

SEQ ID NO: 41057 - DNA, 813 bp, Artificial Sequence
  Description of Artificial Sequence: Synthetic coding sequence
atgagcacagaaattggcaccatgatctctgtgtcctctgcagaatatggcaccaatgccaaggagagcgtgacagactacaccacccccagcagcagcctgcccaacacagtggccaccaacaacaccaagatggaggacaccctggtgaacaacgtgcccctgcccaacaccctgcccctgcccaagcgggagaccatccagcagagcagcagcctgacctctgtgccccccaccaccttcagcctgaccttcaagatggagagcgccaggaaggcctgggagaacagccccaacgtgcgggagaagggcagccctgtgaccagcacagccccacccatcgccaccggggtgagcagcagcgccagcggccccagcacagccaactacaacagcttcagcagcgcctccatgccccagatccctgtggcctctgtgacccccacagccagcctgtctggagctggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctgattgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagctgctgaccagcaccatctag

SEQ ID NO: 41058 - DNA, 8259 bp, Artificial Sequence
  Description of Artificial Sequence: Synthetic coding sequence
atgtctgagaagagcggccagagcaccaaggccaaggatggcaagaagtatgccaccctgagcctcttcaacacctacaagggcaagagcctggagacccagaagaccacagcccggcacggcctgcagagcctgggcaaggtgggcatcagcaggaggatgcctcctccagccaacctgcccagcctgaaggccgagaacaagggaaatgaccccaacgtgaacatcgtgcccaaggatggcaccggctgggccagcaagcaggagcagcacgaggaggagaagaccccagaggtgcccccagcccagcccaagccaggagtggccgcccctcctgaggtggccccagcccccaagtcctgggccagcaacaagcagggcggccagggagatggcatccaggtgaacagccagttccagcaggagttccccagcctgcaggccgccggggaccaggagaagaaggagaaggagaccaatgatgacaactacggccctggccccagcctgcggccccccaacgtggcctgctggagagatggcggcaaggctgctggcagccccagcagcagtgaccaggatgagaagctgcccggccaggatgagagcacagctggcaccagcgagcagaatgacatcctgaaggtggtggagaagagaattgcctgtggccccccccaggccaagctgaatggccagcaggccgccctggccagccagtaccgggccatgatgccaccctacatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggaggaggagcccgtcttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccgcccagccatggacatcccccccatccaccctggcatgatcccccccaagcccctgatgaggcgggaccagatggagggcagccccaacagcagcgagagctttgagcacatcgcccggagcgcccgggaccacgccatcagcctgtctgagcccaggatgctgtggggcagtgacccctacccccatgctgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggaggtgaatgacaggcctgtgagaagaagtggccccatcaagaagcctgtgctgcgggacatgaaggaggagcgggagcagaggaaggagaaggagggggagaaggccgagaaggtgacagagaaggtggtggtgaagccagagaagacagagaagaaggacctgcccccacctcctcctccaccccagcccccagcccccatccagccccagagcgtgcccccacccatccagcctgaggccgagaagttccccagcacagaaacagccaccctggcccagaagcccagccaggacacagagaagcccctggagcctgtgtccacagtgcaggtggagcctgctgtgaagacagtgaaccagcagaccatggccgcccctgtggtgaaggaggagaagcagcctgagaaggtgatcagcaaggacctggtgattgaaagacccaggccagacagcaggcctgctgtgaagaaggagagcaccctgccccccaggacctactggaaggaggcccgggagcgggactggttcccagaccagggctaccggggccggggccgcggggagtactacagccggggccgcagctaccggggcagctatggaggccggggccggggcggccggggccacacccgggactacccccagtacagagacaacaagcccagggctgagcacatccccagcggccccctgcggcagcgggaggagagcgagaccaggtctgagagcagtgactttgaggtggtgcccaagagaagacggcagaggggcagcgagacagacacagattctgagatccacgagagcgccagtgacaaggacagcctgagcaagggcaagctgcccaagcgggaggagaggcctgagaacaagaagcctgtgaagccccacagcagcttcaagccagacaaccacgtgagaattgacaaccggctgctggagaagccctacgtgagagatgatgacaaggccaagccaggcttcctgcccaagggggagcccacccggcggggccggggcggcaccttcagaagaggaggccgggaccccggcggccggcccagccggcccagcaccctgcggcggcctgcctacagagacaaccagtggaacccccggcagagcgaggtgcccaagccagaagatggagagccccccaggagacatgagcagttcatccccatcgctgctgacaagaggcctcccaagtttgagaggaagtttgatcctgcccgggagcggccccggcggcagaggcccacccggcccccccggcaggacaagccaccccgcttccggcggctgcgggagcgggaggccgccagcaagagcaatgaggtggtggccgtgcccaccaacggcaccgtgaacaacgtggcccaggagcctgtgaacaccctgggggacatcagcggcaacaagaccccagacctgagcaaccagaacagcagtgaccaggccaatgaggagtgggagacagccagcgagagcagtgacttcaatgaaagaagagaaagagatgagaagaagaatgctgacctgaatgcccagacagtggtgaaggtgggagaaaatgtgctgccccccaagcgggagatcgccaagaggagcttcagcagccagaggcctgtggaccggcagaacagaagaggcaacaacggcccccccaagtctggaagaaacttcagcggccccagaaatgaaagaagaagtggcccccccagcaagagcggcaagaggggcccctttgatgaccagcctgctggcaccaccggggtggacctgatcaatggcagcagcgcccaccaccaggagggcgtgcccaacggcaccggccagaagaacagcaaggacagcacaggcaagaagcgggaggaccccaagccaggccccaagaagcccaaggagaaggtggatgccctgagccagtttgacctgaacaactatgcctctgtggtgatcattgatgaccaccctgaggtgacagtgattgaggacccccagagcaacctgaatgatgatggcttcacagaggtggtgtccaagaagcagcagaagaggctgcaggatgaggagaggaggaagaaggaggagcaggtgatccaggtgtggaacaagaagaatgccaatgagaagggccgcagccagaccagcaagctgccccccaggtttgccaagaagcaggccaccggcatccagcaggcccagagcagcgcctctgtgccccccctggccagcgcccccctgccccccagcaccagcgcctctgtgcctgccagcaccagcgcccccctgcctgccaccctgacccctgtgcctgccagcaccagcgcccctgtgcctgccagcaccctggcccctgtgctggccagcaccagcgcccctgtgcctgccagccccctggcccctgtgtctgccagcgcctctgtgtctgcctctgtgcctgccagcaccagcgctgctgccatcaccagcagcagcgccccagccagcgccccagcccccacccccatcctggcctctgtgtccaccccagcctctgtgaccatcctggccagcgccagcatccccatcctggccagcgccctggccagcaccagcgcccccaccccagccccagctgccagcagccctgctgcccctgtgatcacagcccccaccatcccagccagcgcccccacagcctctgtgcccctggccccagccagcgccagcgccccagccccagcccccacccctgtgtctgcccccaacccagcccccccagccccagcccagacccaggcccagacccacaagcctgtgcagaaccccctgcagaccaccagccagagcagcaagcagcccccacccagcatccggctgcccagcgcccagaccccaaatggaacagattatgtggccagcggcaagagcatccagaccccccagagccacggcaccctgacagctgagctgtgggacaacaaggtggcccccccagctgtgctgaatgacatcagcaagaagctgggccccatcagccccccccagcccccatctgtgtctgcctggaacaagcccctgaccagctttggcagcgcccccagcagcgagggcgccaagaatggccaggagagcggcctggagattggaacagacaccatccagtttggagccccagccagcaatggaaatgaaaatgaggtggtgcctgtgctgtctgagaagtctgctgacaagatccctgagcccaaggagcagaggcagaagcagcccagggctggccccatcaaggcccagaagctgcctgacctgagccctgtggagaacaaggagcacaagccaggccccatcggcaaggagaggagcctgaagaacaggaaggtgaaggatgcccagcaggtggagcctgagggccaggagaagcccagccctgccaccgtgcgcagcacagatcctgtgaccaccaaggagaccaaggctgtgtctgagatgagcacagagatcggcaccatgatctctgtgagcagcgcagaatatggcaccaatgccaagatggagagcgccaggaaggcctgggagaacagccccaacgtgcgggagaagggcagccctgtgaccagcacagccccacccatcgccaccggggtgagcagcagcgccagcggccccagcacagccaactacaacagcttcagcagcgcctccatgccccagatccctgtggcctctgtgacccccacagccagcctgtctggagctggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctgattgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagcagatccccatccccatctatgcccccctgcagggccagcaccaggcccagctgagcctgggcgccggccctgctgtgtcccaggcccaggagctgttcagcagcagcctgcagccctaccgcagccagcctgccttcatgcagagcagcctgagccagcccagcgtggtgctgtctggaacagccatccacaacttccccaccgtgcagcaccaggagctggccaaggcccagagcggcctggccttccagcagaccagcaacacccagcccatccccatcctgtatgagcaccagctgggccaggccagcggcctgggcggcagccagctgattgacacccacctgctgcaggcccgggccaacctgacccaggccagcaacctgtacagcggccaggtgcagcagcccggccagaccaacttctacaacacagcccagagccccagcgccctgcagcaggtgacagtgcccctgcctgccagccagctgagcctgcccaactttggcagcacaggccagcccctgattgccctgccccagaccctgcagccccccctgcagcacaccaccccccaggcccaggcccagagcctgagcaggcctgcccaggtgtcccagcccttccggggcctcatcccagctggcacccagcacagcatgattgccaccaccgggaagatgtctgagatggagctgaaggccttcggcagcggcatcgacatcaagccaggcaccccacccatcgccggccgcagcaccacccccaccagcagccccttccgggccaccagcaccagccccaacagccagagcagcaagatgaacagcatcgtgtaccagaagcagttccagagcgccccagccaccgtgaggatgacccagcccttccccacccagtttgccccccaggccaagcagagagctgaggtgctgcagagcacccagcgcttcttcagcgagcagcagcagagcaagcagatcggcggcggcaaggcccagaaggtggacagcgacagcagcaagcccccagagaccctgacagaccccccaggagtgtgccaggagaaggtggaggagaagcccccaccagcccccagcatcgccaccaagcctgtgaggacaggccccatcaagccccaggccatcaagacagaggagaccaagagctag

SEQ ID NO: 41059 - DNA, 8553 bp, Artificial Sequence
  Description of Artificial Sequence: Synthetic coding sequence
atgtctgagaagagcggccagagcaccaaggccaaggatggcaagaagtatgccaccctgagcctcttcaacacctacaagggcaagagcctggagacccagaagaccacagcccggcacggcctgcagagcctgggcaaggtgggcatcagcaggaggatgcctcctccagccaacctgcccagcctgaaggccgagaacaagggaaatgaccccaacgtgaacatcgtgcccaaggatggcaccggctgggccagcaagcaggagcagcacgaggaggagaagaccccagaggtgcccccagcccagcccaagccaggagtggccgcccctcctgaggtggccccagcccccaagtcctgggccagcaacaagcagggcggccagggagatggcatccaggtgaacagccagttccagcaggagttccccagcctgcaggccgccggggaccaggagaagaaggagaaggagaccaatgatgacaactacggccctggccccagcctgcggccccccaacgtggcctgctggagagatggcggcaaggctgctggcagccccagcagcagtgaccaggatgagaagctgcccggccaggatgagagcacagctggcaccagcgagcagaatgacatcctgaaggtggtggagaagagaattgcctgtggccccccccaggccaagctgaatggccagcaggccgccctggccagccagtaccgggccatgatgccaccctacatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggccgaggaggagcctgtgttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccggcctgccatggacatcccccccatccaccctggcatgatcccccccaagcccctgatgagaagagaccagatggagggcagccccaacagcagcgagagctttgagcacatcgcccggagcgcccgggaccacgccatcagcctgtctgagcccaggatgctgtggggcagtgacccctacccccacgccgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggaggtgaatgacaggcctgtgcggcgcagcggccccatcaagaagcctgtgctgcgggacatgaaggaggagcgggagcagaggaaggagaaggagggggagaaggccgagaaggtgacagagaaggtggtggtgaagccagagaagacagagaagaaggacctgcccccacctcctcctccaccccagcccccagcccccatccagccccagagcgtgcccccacccatccagcctgaggccgagaagttccccagcacagaaacagccaccctggcccagaagcccagccaggacacagagaagcccctggagcctgtgtccacagtgcaggtggagcctgctgtgaagacagtgaaccagcagaccatggccgcccctgtggtgaaggaggagaagcagcctgagaaggtgatcagcaaggacctggtgattgagcggcccaggccagacagcaggcctgctgtgaagaaggagagcaccctgccccccaggacctactggaaggaggcccgggagcgggactggttcccagaccagggctaccggggccggggccgcggggagtactacagccggggccgcagctaccggggcagctatggaggccggggccggggcggccggggccacacccgggactacccccagtacagagacaacaagcccagggctgagcacatccccagcggccccctgcggcagcgggaggagagcgagaccaggtctgagagcagtgactttgaggtggtgcccaagagaagacggcagaggggcagcgagacagacacagacagcgagatccatgaaagtgccagtgacaaggacagcctgagcaagggcaagctgcccaagcgggaggagaggcctgagaacaagaagcctgtgaagccccacagcagcttcaagccagacaaccacgtgagaattgacaaccggctgctggagaagccctacgtgagagatgatgacaaggccaagccaggcttcctgcccaagggggagcccacccggcggggccggggcggcaccttccggcggggcggccgggaccccggcggccggcccagccggcccagcaccctgcggcggcctgcctacagagacaaccagtggaacccccggcagagcgaggtgcccaagccagaagatggagagcccccaagaagacatgagcagttcatccccatcgctgctgacaagaggcctcccaagtttgagaggaagtttgatcctgcccgggagcggccccggcggcagaggcccaccaggcctccccggcaggacaagcccccacgcttccggcggctgcgggagcgggaggccgccagcaagagcaatgaggtggtggccgtgcccaccaatggaacagtgaacaacgtggcccaggagcctgtgaacaccctgggggacatcagcggcaacaagaccccagacctgagcaaccagaacagcagtgaccaggccaatgaggagtgggagacagccagcgagagcagtgacttcaatgaaagaagagaaagagatgagaagaagaatgctgacctgaatgcccagacagtggtgaaggtgggggagaatgtgctgccccccaagcgggagatcgccaagaggagcttcagcagccagaggcctgtggaccggcagaacagaagaggcaacaatggaccacccaagagcggcaggaacttcagcggccccagaaatgaaagaagaagtggcccccccagcaagagcggcaagaggggcccctttgatgaccagcctgctggcaccactggagtggacctgatcaatggcagcagcgcccaccaccaggagggcgtgcccaatggaacaggccagaagaacagcaaggacagcacaggcaagaagcgggaggaccccaagccaggccccaagaagcccaaggagaaggtggatgccctgagccagtttgacctgaacaactatgcctctgtggtgatcattgatgaccaccctgaggtgacagtgattgaggacccccagagcaacctgaatgatgatggcttcacagaggtggtgtccaagaagcagcagaagaggctgcaggatgaggagaggaggaagaaggaggagcaggtgatccaggtgtggaacaagaagaatgccaatgagaagggccgcagccagaccagcaagctgcccccaagatttgccaagaagcaggccaccggcatccagcaggcccagagcagcgcctctgtgccccccctggccagcgcccccctgccccccagcaccctggcccctgtgtctgccagcgcctctgtgtctgcctctgtgcctgccagcaccagcgctgctgccatcaccagcagcagcgccccagccagcgccccagcccccacccccatcctggcctctgtgtccaccccagcctctgtgaccatcctggccagcgccagcatccccatcctggccagcgccctggccagcaccagcgcccccaccccagccccagctgccagcagccctgctgcccctgtgatcacagcccccaccatcccagccagcgcccccacagcctctgtgcccctggccccagccagcgccagcgccccagccccagcccccacccctgtgtctgcccccaacccagcccccccagccccagcccagacccaggcccagacccacaagcctgtgcagaaccccctgcagaccaccagccagagcagcaagcagcccccacccagcatccggctgcccagcgcccagaccccaaatggaacagattatgtggccagcggcaagagcatccagaccccccagagccacggcaccctgacagctgagctgtgggacaacaaggtggcccccccagctgtgctgaatgacatcagcaagaagctgggccccatcagccccccccagcccccatctgtgtctgcctggaacaagcccctgaccagctttggcagcgcccccagcagcgagggcgccaagaatggccaggagagcggcctggagattggaacagacaccatccagtttggagccccagccagcaatggaaatgaaaatgaggtggtgcctgtgctgtctgagaagtctgctgacaagatccctgagcccaaggagcagaggcagaagcagcccagggctggccccatcaaggcccagaagctgcctgacctgagccctgtggagaacaaggagcacaagccaggccccatcggcaaggagaggagcctgaagaacaggaaggtgaaggatgcccagcaggtggagcctgagggccaggagaagcccagccctgccaccgtgcgcagcacagatcctgtgaccaccaaggagaccaaggctgtgtctgagatgagcacagagatcggcaccatgatctctgtgagcagcgcagaatatggcaccaatgccaaggagagcgtgacagactacaccacccccagcagcagcctgcccaacacagtggccaccaacaacaccaagatggaggacaccctggtgaacaacgtgcccctgcccaacaccctgcccctgcccaagcgggagaccatccagcagagcagcagcctgacctctgtgccccccaccaccttcagcctgaccttcaagatggagagcgccaggaaggcctgggagaacagccccaacgtgcgggagaagggcagccctgtgaccagcacagccccacccatcgccactggagtgagcagcagcgccagcggccccagcacagccaactacaacagcttcagcagcgcctccatgccccagatccctgtggcctctgtgacccccacagccagcctgagcggggccggcacctacaccaccagcagcctgagcaccaagagcaccaccaccagtgacccccccaacatctgcaaggtgaagccccagcagctgcagaccagcagcctgcccagcgccagccacttcagccagctgagctgcatgcccagcctcatcgcccagcagcagcagaacccccaggtgtatgtgtcccagagcgctgctgcccagatcccagccttctacatggacaccagccacctgttcaacacccagcacgcccggctggccccacccagcctggcccagcagcagggcttccagcccggcctgagccagcccacctctgtgcagcagatccccatccccatctatgcccccctgcagggccagcaccaggcccagctgagcctgggcgccggccctgctgtgtcccaggcccaggagctgttcagcagcagcctgcagccctaccgcagccagcctgccttcatgcagagcagcctgagccagcccagcgtggtgctgagcggcacagccatccacaacttccccaccgtgcagcaccaggagctggccaaggcccagagcggcctggccttccagcagaccagcaacacccagcccatccccatcctgtatgagcaccagctgggccaggccagcggcctgggcggcagccagctgattgacacccacctgctgcaggcccgggccaacctgacccaggccagcaacctgtacagcggccaggtgcagcagcccggccagaccaacttctacaacacagcccagagccccagcgccctgcagcaggtgacagtgcccctgcctgccagccagctgagcctgcccaactttggcagcacaggccagcccctcatcgccctgccccagaccctgcagccccccctgcagcacaccaccccccaggcccaggcccagagcctgagcaggcctgcccaggtgtcccagcccttccggggcctcatcccagctggcacccagcacagcatgattgccaccaccgggaagatgtctgagatggagctgaaggcctttggaagtggcatcgacatcaagccaggcaccccacccatcgccggccgcagcaccacccccaccagcagccccttccgggccaccagcaccagccccaacagccagagcagcaagatgaacagcatcgtgtaccagaagcagttccagagcgccccagccaccgtgaggatgacccagcccttccccacccagtttgccccccagatcctgagccagcccaacctggtgccccccctggtgcgggccccccacaccaacaccttccctgcccctgtgcagaggcctcccatggccctggccagccagatgcccccacccctgaccaccggcctgatgagccacgcccggctgccccacgtggcccggggcccctgtggcagcctgagcggcgtgcggggcaaccaggcccaggccgccctgaaggccgagcaggacatgaaggccaagcagagagctgaggtgctgcagagcacccagcgcttcttcagcgagcagcagcagagcaagcagatcggcggcggcaaggcccagaaggtggacagcgacagcagcaagcccccagagaccctgacagaccccccaggagtgtgccaggagaaggtggaggagaagcccccaccagcccccagcatcgccaccaagcctgtgaggacaggccccatcaagccccaggccatcaagacagaggagaccaagagctag

SEQ ID NO: 41060 - DNA, 2292 bp, Artificial Sequence
  Description of Artificial Sequence: Synthetic coding sequence
atcctgccccccacccagatgttccagcagtaccccaggatgacctacccacccctgcacggccccatgaggttcccccccagcctgtctgagaccaacaagggcctgcggggccggggccccccacccagctgggccagcgagcctgagcggcccagcatcctgagcgccagcgagctgaaggagctggacaagtttgacaacctggatgctgaggctgatgagggctgggccggggcccagatggaggtggactacacagagcagctgaacttcagtgatgatgatgagcagggcagcaacagccccaaggagaacaacagcgaggaccagggcagcaaggcctctgaaaataatgaaaacaagaaggagacagatgaggtgagcaacaccaagagcagcagccagatcccagcccagcccagcgtggccaaggtgccctacggcaagggccccagcttcaaccaggagcggggcaccagcagccacctgcccccaccacccaagctgctggcccagcagcaccccccaccagaccggcaggccgtgcccggccggcccggccccttccccagcaagcagcaggtggctgatgaagatgagatctggaagcagaggcggcggcagcagagcgagatctctgctgctgtggagcgggccaggaagagaagagaggaggaggagaggaggatggaggagcagaggaaggccgcctgtgccgagaagctgaagaggctggatgagaagctgggcatcctggagaagcagcccagccctgaggagatccgggagcgggagcgggagaaggagcgggagcgggagaaggagctggagaaggagcaggagcaggagcgggagaaggagcgggagaaggaccgggagcggcagcaggagaaggagaaggagctggagaaggagcaggagaagcagcgggagatggagaaggagaggaagcaggagaaggagaaggagctggagcggcagaaggagaaggagaaggagctgcagaagatgaaggagcaggagaaggaatgtgagctggagaaggagcgggagaagctggaggagaagattgagccccgggagcccaacctggagcccatggtggagaagcaggagagcgagaacagctgcaacaaggccgaggaggagcctgtgttcacccggcaggacagcaacagaagtgagaaggaggccacccctgtggtgcatgaaacagagcctgagagcggcagccagcccaggcctgctgtgctgagcggctacttcaagcagttccagaagagcctgcccccacgcttccagaggcagcaggagcagatgaagcagcagcagtggcagcagcagcagcagcagggcgtgctgccccagacagtgcccagccagcccagcagcagcacagtgcccccaccaccccaccggcccctgtaccagcccatgcagccccacccccagcacctggcctccatgggctttgacccccgctggctgatgatgcagagctacatggaccccaggatgatgagcggccggcctgccatggacatcccccccatccaccctggcatgatcccccccaagcccctgatgagaagagaccagatggagggcagccccaacagcagcgagagctttgagcacatcgcccggagcgcccgggaccacgccatcagcctgtctgagcccaggatgctgtggggcagtgacccctacccccacgccgagccccagcaggccaccacccccaaggccacagaggagccagaagatgtgcgctctgaggccgccctggaccaggagcagatcacagctgcctacagcgtggagcacaaccagctggaggcccaccccaaggctgacttcatccgggagagcagcgaggcccaggtgcagaagttcctgagccgctctgtggaggatgtgcggccccaccacacagatgccaacaaccagagcgcctgctttgaggccccagaccagaagaccctgagcgccccccaggaggagcgcatctctgctgtggagagccagcccagcaggaagaggtctgtgagccacggcagcaaccacacccagaagccagatgagcagaggtctgagcccagcgctggcatccccaaggtgaccagccgctgcatcgacagcaaggagcccatcgagaggcctgaggagaagcccaagaaggagggcttcatccgcagcagcgagggccccaagccagagaaggtgtacaagagcaagtctgagacccgctggggcccccggcccagcagcaacagaagagaggagtag

SEQ ID NO: 41061 - DNA, 930 bp, Artificial Sequence
  Description of Artificial Sequence: Synthetic coding sequence
atgctgctgatcctgctgtctgtggccctgctggccctgagcagcgcccagagcctgaatgaagatgtgtcccaggaggagagccccagcgtcatcagcggcaagccagagggcagaagaccccagggcggcaaccagccccagaggaccccacctcctcctgggaagccagagggccggcccccccagggcggcaaccagagccagggccccccacccaggcctgggaagccagagggccccccaccccagggcggcaaccagagccagggccccccacccaggcctgggaagccagagggccagcccccccagggcggcaaccagagccagggccccccacccaggcctgggaagccagagggccccccaccccagggcggcaaccagagccagggccccccacccaggcctgggaagccagagggccccccaccccagggcggcaaccagagccagggccccccacccaggcctgggaagccagagggccccccaccccagggcggcaaccagagccagggccccccaccccaccctgggaagccagagggccccccaccccagggcggcaaccagagccagggccccccacccaggcctgggaagccagagggccccccaccccagggcggcaaccagagccagggccccccacccaggcctgggaagccagagggcccccccagccagggcggcaacaagccccagggccccccaccccaccctgggaagccccagggccccccaccccaggagggcaacaagccccagaggcctcctcctcctggccggccccagggccccccacctcctgggggcaacccccagcagcccctgcccccacctgctgggaagccccagggccccccacctccaccccagggcggccggccccaccggcccccccagggccagcccccccagtag

SEQ ID NO: 41062 - DNA, 930 bp, Artificial Sequence
  Description of Artificial Sequence: Synthetic coding sequence
atgctgctgatcctgctgtctgtggccctgctggccctgagcagcgcccagagcctgaatgaagatgtgtcccaggaggagagccccagcgtcatcagcggcaagccagagggcagaagaccccagggcggcaaccagccccagaggaccccacctcctcctgggaagccagagggccggcccccccagggcggcaaccagagccagggccccccacccaggcctgggaagccagagggccccccaccccagggcggcaaccagagccagggccccccacccaggcctgggaagccagagggccagcccccccagggcggcaaccagagccagggccccccacccaggcctgggaagccagagggccccccaccccagggcggcaaccagagccagggccccccacccaggcctgggaagccagagggccccccaccccagggcggcaaccagagccagggccccccaccccaccctgggaagccagagggccccccaccccagggcggcaaccagagccagggccccccacccaggcctgggaagccagagggccccccaccccagggcggcaaccagagccagggccccccacccaggcctgggaagccagagggccccccaccccagggcggcaaccagagccagggccccccacccaggcctgggaagccagagggcccccccagccagggcggcaacaagccccagggccccccaccccaccctgggaagccccagggccccccaccccaggagggcaacaagccccagaggcctcctcctcctggccggccccagggccccccacctcctgggggcaacccccagcagcccctgcccccacctgctgggaagccccagggccccccacctccaccccagggcggccggccccaccggcccccccagggccagcccccccagtag

SEQ ID NO: 41063 - DNA, 501 bp, Artificial Sequence
  Description of Artificial Sequence: Synthetic coding sequence
atgctgctgatcctgctgtctgtggccctgctggccttcagcagcgcccaggacctggatgaagatgtgtcccaggaggatgtgcccctggtgatcagtgatggaggagacagcgagcagttcattgatgaggagcggcagggcccccccctgggcggccagcagagccagcccagcgctggagatggcaaccagaatgatggcccccagcagggccccccccagcagggcggccagcagcagcagggccccccaccaccccagggcaagccccagggccccccccagcagggcggccaccccccaccaccccagggccggccccagggccccccccagcagggcggccacccccggcccccccggggccggccccagggccccccccagcagggcggccaccagcagggccccccacctcctcctcctgggaagccccagggccccccaccccagggcggccggccccagggccccccccagggccagagcccccagtag

SEQ ID NO: 41064 - DNA, 501 bp, Artificial Sequence; identical to SEQ ID NO: 41063
  Description of Artificial Sequence: Synthetic coding sequence

SEQ ID NO: 41065 - DNA, 501 bp, Artificial Sequence; identical to SEQ ID NO: 41063
  Description of Artificial Sequence: Synthetic coding sequence

SEQ ID NO: 41066 - DNA, 501 bp, Artificial Sequence; identical to SEQ ID NO: 41063
  Description of Artificial Sequence: Synthetic coding sequence

SEQ ID NO: 41067 - DNA, 486 bp, Artificial Sequence
  Description of Artificial Sequence: Synthetic coding sequence
atgttcagcctgcccctgaactgcagcccagaccacatccggcggggcagctgctggggccggccccaggacctgaagattgctgccccagcctggaacagcaagtgccaccctggggccggggccgccatggcccgctgcaagaatgctgatggagtggagctgtacaatgaaattgagttctacgccaaggtgaacagcaaggacagccaggacaagaggagcagccgcagcatcacctgctttgtgaggaagtggaaggagaaggtggcctggccccggctgaccaaggaggacatcaagcctgtgtggctgtctgtggactttgacaactggagggactgggagggagatgaggagatggagctggcccacgtggagcactacgccgagctgctgaagaaggtgtccaccaagaggcctcctccagccatggatgacctggatgatgacagcgacagcgcagatgatgccaccagcaactag

SEQ ID NO: 41068 - DNA, 387 bp, Artificial Sequence
  Description of Artificial Sequence: Synthetic coding sequence
tgacagcacgcccggaccctgtggtatgaccggcccagctgcaagaatgctgatggagtggagctgtacaatgaaattgagttctacgccaaggtgaacagcaaggacagccaggacaagaggagcagccgcagcatcacctgctttgtgaggaagtggaaggagaaggtggcctggccccggctgaccaaggaggacatcaagcctgtgtggctgtctgtggactttgacaactggagggactgggagggagatgaggagatggagctggcccacgtggagcactatgcagagctgctgaagaaggtgtccaccaagaggcctcctccagccatggatgacctggatgatgacagcgacagcgcagatgatgccaccagcaactag

SEQ ID NO: 41069 - DNA, 297 bp, Artificial Sequence
  Description of Artificial Sequence: Synthetic coding sequence
atgaggaagatgaacaccctgctgctggtgtccctgtccttcctgtacctgaaggaggtgatgggcctgaagtgcaacacctgcatctacacagagggctggaagtgcatggccggccggggcacctgcatcgccaaggaaaatgagctgtgcagcaccacagcctacttccggggggacaagcacatgtacagcacccacatgtgcaagtacaagtgccgggaggaggagagcagcaagaggggcctgctgcgggtgaccctgtgctgtgacaggaacttctgcaatgtgttctag

SEQ ID NO: 41070 - DNA, 345 bp, Artificial Sequence
  Description of Artificial Sequence: Synthetic coding sequence
atggccggcctggccctgcagcccggcacagccctgctgtgctacagctgcaaggcccaggtgtccaatgaagactgcctgcaggtggagaactgcacccagctgggggagcagtgctggacagcccgcatccgggctgtgggcctgctgaccgtcatcagcaagggctgcagcctgaactgtgtggatgacagccaggactactacgtgggcaagaagaacatcacctgctgtgacacagacctgtgcaatgccagcggggcccacgccctgcagcctgctgctgccatcctggccctgctgcctgccctgggcctgctgctgtggggccctggccagctgtag

SEQ ID NO: 41071 - DNA, 312 bp, Artificial Sequence
  Description of Artificial Sequence: Synthetic coding sequence
atgggcagccgctgtgccaagctgaacacaggccagagccctggccacagccctggccacagcacaggccacggccggggccacgagagctccatgaagaagctgatggcctgtgtgtcccaggacaacttcagcctgagcagcgctggggaggaggaggaggaggaggaggaggagggggaggaggaggagaaggaggagctgcctgtgcagggcaagctgctgctgctggagcctgagcggcaggaggagggccacaaggacaatgctgaggcccagcagagccctgagcccaagaggacccccagctag

SEQ ID NO: 41072 - DNA, 744 bp, Artificial Sequence
  Description of Artificial Sequence: Synthetic coding sequence
atgaacctgctgctgatcctgacctttgtggccgctgctgtggccgccccctttgatgatgatgacaagatcgtgggcggctacatctgtgaggagaacagcgtgccctaccaggtgtccctgaacagcggctaccacttctgtggcggcagcctcatcagcgagcagtgggtggtgtctgctggccactgctacaagagccgcatccaggtgcggctgggggagcacaacatcgaggtgctggagggcaatgagcagttcatcaatgctgccaagatcatccgccaccccaagtacaacagcaggaccctggacaatgacatcctgctgatcaagctgagcagccctgctgtgatcaacagccgggtgtctgccatcagcctgcccacagcccccccagctgctggaacagagagcctcatcagcggctggggcaacaccctgagcagcggggctgactacccagatgagctgcagtgcctggatgcccctgtgctgagccaggccgagtgtgaggccagctacccaggcaagatcaccaacaacatgttctgtgtgggcttcctggagggcggcaaggacagctgccagggcgacagcggcggccctgtggtgtccaatggagagctgcagggcatcgtgtcctggggctacggctgtgcccagaagaacagacctggggtgtacaccaaggtgtacaactacgtggactggatcaaggacaccatcgccgccaacagctag

SEQ ID NO: 41073 - DNA, 525 bp, Artificial Sequence
  Description of Artificial Sequence: Synthetic coding sequence
atggcctgtggccctggggacctgcagagcctgaccagccccctgagcagcgcccggctggactaccagcccagcattgagggcccctggctgcgggcctgtggccagaccaacgtgtcctgccgggtggtgaagggcaagctggtggaggtgggcaagtggccctggcaggtgtccatcctcttcctgggcacctacatctgcagcggcagcctcatccaccaccagtgggtgctgacagctgcccactgcctgcagcgcttcaaggacctgagcctgtacagcgtgatggtgggcgtgcaccagaggcctgagaacagcacccagctgcccctgaccaggatggtgatccacaaggacttcagcaacctgatgagccaggacatcgccctgctgaagctgcgggacagcatctcctggagcccctttgtgcagcctgtgtgcctgcccaacatcaagttcaagcccagcatcggctccatgtgctgggtgattggctggggcaccaccgggaagaagggctag

SEQ ID NO: 41074 - DNA, 726 bp, Artificial Sequence
  Description of Artificial Sequence: Synthetic coding sequence
atgaagttcatcctgctgtgggccctgctgaacctgactgtggccctggccttcaacccagactacacagtgagcagcaccccaccctacctggtgtacctgaagagtgactacctgccctgtgccggcgtgctgatccaccccctgtgggtgatcacagctgcccactgcaacctgcccaagctgcgggtcatcctgggcgtgaccatcccagctgacagcaatgagaagcacctgcaggtgattggctatgagaagatgatccaccacccccacttctctgtgaccagcattgaccatgacatcatgctgatcaagctgaagacagaagctgagctgaatgactatgtgaagctggccaacctgccctaccagaccatcagcgagaacaccatgtgcagcgtgtccacctggagctacaacgtgtgtgacatctacaaggagccagacagcctgcagacagtgaacatcagcgtcatcagcaagccccagtgcagagatgcctacaagacctacaacatcacagagaacatgctgtgtgtgggcatcgtgcctggaagacggcagccctgcaaggaggtgtctgctgccccagccatctgcaatggcatgctgcagggcatcctgagctttgctgatggctgtgtgctgcgggcagatgtgggcatctatgccaagatcttctactacatcccctggattgaaaatgtcatccagaacaactag

SEQ ID NO: 41075 - DNA, 783 bp, Artificial Sequence
  Description of Artificial Sequence: Synthetic coding sequence
atgaccaggcactggccctgggaggtgtccctgaggatggagaatgaacatgtgtgtggcggggccctgattgaccccagctgggtggtgacagctgcccactgcatccagggcaccaaggagtacagcgtggtgctgggcaccagcaagctgcagcccatgaacttcagccgggccctgtgggtgcctgtgcgggacatcatcatgcaccccaagtactggggccgggccttcatcatgggagatgtggccctggtgcacctgcagacccctgtgaccttctctgaatatgtgcagcccatctgcctgcctgagcccaacttcaacctgaaggtgggcacccagtgctgggtgacaggctggagccaggtgaagcagcgcttcagcgccaacagcatgctgaccccagagctgcaggaggccgaggtgttcatcatggacaacaagagatgtgacagacactacaagaagagcttcttcccccctgtggtgcccctggtgctgggggacatgatctgtgccaccaactatggagagaacctgtgctatggagacagcggcggccccctggcctgtgaggtggagggccgctggatcctggccggcgtgctgtcctgggagaaggcctgtgtgaaggcccagaaccctggggtgtacacccgcatcaccaagtacaccaagtggatcaagaagcagatgagcaatggagccttcagcggcccctgtgccagcgcctgcctgctcttcctgtgctggctgctgcagccccagatgggcagctag

SEQ ID NO: 41076 - DNA, 687 bp, Artificial Sequence
  Description of Artificial Sequence: Synthetic coding sequence
atgaccaggcactggccctgggaggtgtccctgaggatggagaatgaacatgtgtgtggcggggccctgattgaccccagctgggtggtgacagctgcccactgcatccagggcaccaaggagtacagcgtggtgctgggcaccagcaagctgcagcccatgaacttcagccgggccctgtgggtgcctgtgcgggacatcatcatgcaccccaagtactggggccgggccttcatcatgggagatgtggccctggtgcacctgcagacccctgtgaccttcagcagcacagccaacagcatgctgaccccagagctgcaggaggccgaggtgttcatcatggacaacaagagatgtgacagacactacaagaagagcttcttcccccctgtggtgcccctggtgctgggggacatgatctgtgccaccaactatggagagaacctgtgctatggagacagcggcggccccctggcctgtgaggtggagggccgctggatcctggccggcgtgctgtcctgggagaaggcctgtgtgaaggcccagaaccctggggtgtacacccgcatcaccaagtacaccaagtggatcaagaagcagatgagcaatggagccttcagcggcccctgtgccagcgcctgcctgctcttcctgtgctggctgctgcagccccagatgggcagctag

SEQ ID NO: 41077 - DNA, 1179 bp, Artificial Sequence
  Description of Artificial Sequence: Synthetic coding sequence
atggccgcccccctgcgcatccagagcgactgggcccaggccctgaggaaggatgaaggagaggcctggctgagctgccaccccccaggcaagcccagcctgtatggcagcctgacctgccagggcatcggcctggatggcatccctgaggtgacagccagcgagggcttcaccgtgaatgagatcaacaagaagagcatccacatcagctgccccaaggaaaatgccagcagcaagttcctggccccctacaccaccttcagccgcatccacaccaagagcatcacctgcctggacatcagcagccggggcggcctgggcgtgagcagcagcacagatggcaccatgaagatctggcaggccagcaatggagagctgcggcgggtgctggagggccacgtgtttgatgtgaactgctgccgcttcttccccagcggcctggtggtgctgagcggcggcatggatgcccagctgaagatctggagcgcagaagatgccagctgtgtggtgaccttcaagggccacaagggcggcatcctggacacagccatcgtggaccggggcagaaatgtggtgtctgccagcagagatggaacagcccggctgtgggactgtggccgcagcgcctgcctgggcgtgctggccgactgtggcagcagcatcaacggggtggccgtgggcgctgctgacaacagcatcaacctgggcagccctgagcagatgcccagcgagcgggaggtgggcacagaggccaagatgctgctgctggcccgggaggacaagaagctgcagtgcctgggcctgcagagccggcagctggtgttcctgttcatcggcagtgatgccttcaactgctgcaccttcctgagcggcttcctgctgctggccggcacccaggacggcaacatctaccagctggatgtgcgcagcccccgggcccctgtgcaggtgatccacaggtctggggcccctgtgctgagcctgctgtctgtgagagatggcttcatcgccagccagggagatggcagctgcttcatcgtgcagcaggacctggactatgtgacagagctgaccggggctgactgtgaccctgtgtacaaggtggccacctgggagaagcagatctacacctgctgcagagatggcctggtgcggcgctaccagctgagtgacctgtag

SEQ ID NO: 41078 - DNA, 1128 bp, Artificial Sequence
  Description of Artificial Sequence: Synthetic coding sequence
atgctggtgccctgcttcctgtacagcctgcagaacaggaagcccagcctgtatggcagcctgacctgccagggcatcggcctggatggcatccctgaggtgacagccagcgagggcttcaccgtgaatgagatcaacaagaagagcatccacatcagctgccccaaggaaaatgccagcagcaagttcctggccccctacaccaccttcagccgcatccacaccaagagcatcacctgcctggacatcagcagcagaggaggcctgggcgtgagcagcagcacagatggcaccatgaagatctggcaggccagcaatggagagctgcggcgggtgctggagggccacgtgtttgatgtgaactgctgccgcttcttccccagcggcctggtggtgctgagcggcggcatggatgcccagctgaagatctggagcgcagaagatgccagctgtgtggtgaccttcaagggccacaagggcggcatcctggacacagccatcgtggaccggggcagaaatgtggtgtctgccagcagagatggaacagcccggctgtgggactgtggccgcagcgcctgcctgggcgtgctggccgactgtggcagcagcatcaatggagtggccgtgggcgctgctgacaacagcatcaacctgggcagccctgagcagatgcccagcgagcgggaggtgggcacagaggccaagatgctgctgctggcccgggaggacaagaagctgcagtgcctgggcctgcagagccggcagctggtgttcctgttcatcggcagtgatgccttcaactgctgcaccttcctgagcggcttcctgctgctggccggcacccaggacggcaacatctaccagctggatgtgcgcagcccccgggcccctgtgcaggtgatccacaggtctggggcccctgtgctgagcctgctgtctgtgagagatggcttcatcgccagccagggagatggcagctgcttcatcgtgcagcaggacctggactatgtgacagagctgactggagctgactgtgaccctgtgtacaaggtggccacctgggagaagcagatctacacctgctgcagagatggcctggtgcggcgctaccagctgagtgacctgtag

SEQ ID NO: 41079 - DNA, 714 bp, Artificial Sequence
  Description of Artificial Sequence: Synthetic coding sequence
atgctggtgccctgcttcctgtacagcctgcagaacaggaagcccagcctgtatggcagcctgacctgccagggcatcggcctggatggcatccctgaggtgacagccagcgagggcttcaccgtgaatgagatcaacaagaagagcatccacatcagctgccccaaggaaaatgccagcagcaagttcctggccccctacaccaccttcagccgcatccacaccaagagcatcacctgcctggacatcagcagcagaggaggcctgggcgtgagcagcagcacagatggcaccatgaagatctggcaggccagcaatggagagctgcggcgggtgctggagggccacgtgtttgatgtgaactgctgccgcttcttccccagcggcctggtggtgctgagcggcggcatggatgcccagctgaagatctggagcgcagaagatgccagctgtgtggtgaccttcaagggccacaagggcggcatcctggacacagccatcgtggaccggggcagaaatgtggtgtctgccagcagagatggaacagcccggctgtgggactgtggccgcagcgcctgcctgggcgtgctggccgactgtggcagcagcatcaatggagtggccgtgggcgctgctgacaacagcatcaacctgggcagccctgagcagatgcccagcgagcgggaggtgggcacagaggccaagatgctgtag

SEQ ID NO: 41080 - DNA, 1128 bp, Artificial Sequence; identical to SEQ ID NO: 41078
  Description of Artificial Sequence: Synthetic coding sequence

SEQ ID NO: 41081 - DNA, 744 bp, Artificial Sequence
  Description of Artificial Sequence: Synthetic coding sequence
atgctggtgccctgcttcctgtacagcctgcagaacaggaagcccagcctgtatggcagcctgacctgccagggcatcggcctggatggcatccctgaggtgacagccagcgagggcttcaccgtgaatgagatcaacaagaagagcatccacatcagctgccccaaggaaaatgccagcagcaagttcctggccccctacaccaccttcagccgcatccacaccaagagcatcacctgcctggacatcagcagcagaggaggcctgggcgtgagcagcagcacagatggcaccatgaagatctggcaggccagcaatggagagctgcggcgggtgctggagggccacgtgtttgatgtgaactgctgccgcttcttccccagcggcctggtggtgctgagcggcggcatggatgcccagctgaagatctggagcgcagaagatgccagctgtgtggtgaccttcaagggccacaagggcggcatcctggacacagccatcgtggaccggggcagaaatgtggtgtctgccagcagagatggaacagcccggctgtgggactgtggccgcagcgcctgcctgggcgtgctggccgactgtggcagcagcatcaatggagtggccgtgggcgctgctgacaacagcatcaacctgggcagccctgagcagatgcccagcgagcgggaggtgggcacagaggccaagatgctgctgctggcccgggaggacaagaagctgcagtag

SEQ ID NO: 41082 - DNA, 1128 bp, Artificial Sequence; identical to SEQ ID NO: 41078
  Description of Artificial Sequence: Synthetic coding sequence

SEQ ID NO: 41083 - DNA, 1566 bp, Artificial Sequence
  Description of Artificial Sequence: Synthetic coding sequence
atgaagcaggagggcagcgccaggagaagaggagctgacaaggccaagcccccaccagaagatgtggagatgaaggaggaggccgccaccggcggcggcagcactggagaggctgatggcaagacagctgctgctgctgctgagcacagccagcgggagctggacacagtgaccctggaggacatcaaggagcacgtgaagcagctggagaaggctgtgtctgggaaggagcccaggtttgtgctgcgggccctgaggatgctgcccagcaccagccggcggctgaaccactacgtgctgtacaaggctgtgcagggcttcttcaccagcaacaatgccacccgggacttcctgctgcccttcctggaggagcccatggacacagaggccgacctgcagttccggcccaggacaggcaaggccgccagcacccccctgctgcctgaggtggaggcctacctgcagctgctggtggtgatcttcatgatgaacagcaagcgctacaaggaggcccagaagatcagtgatgacctgatgcagaagatcagcacccagaacagaagagccctggacctggtggccgccaagtgctactactaccacgcccgggtgtatgagttcctggacaagctggatgtggtgcgctccttcctgcacgcccggctgaggacagccaccctgcggcatgatgctgatggccaggccaccctgctgaacctgctgctgaggaactacctgcactacagcctgtatgaccaggccgagaagctggtgtccaagtctgtgtttcctgagcaggccaacaacaatgagtgggcccgctacctgtactacacaggccgcatcaaggccatccagctggagtacagcgaggcccggaggaccatgaccaatgccctgaggaaggccccccagcacacagctgtgggcttcaagcagacagtgcacaagctgctgattgtggtggagctgctgctgggggagatcccagaccggctgcagttccggcagcccagcctgaagaggagcctgatgccctacttcctgctgacccaggccgtgaggacaggcaacctggccaagttcaaccaggtgctggaccagtttggagagaagttccaggctgatggcacctacaccctcatcatccggctgcggcacaacgtcatcaagacaggagtgaggatgatcagcctgagctacagccgcatcagcctggccgacatcgcccagaagctgcagctggacagcccagaagatgctgagttcatcgtggccaaggccatcagagatggagtcatcgaggccagcatcaaccacgagaagggctacgtgcagagcaaggagatgattgacatctacagcacccgggagccccagctggccttccaccagaggatctccttctgcctggacatccacaacatgtctgtgaaggccatgaggttcccccccaagagctacaacaaggacctggagagcgctgaggagcggcgggagcgggagcagcaggacctggagtttgccaaggagatggccgaggatgatgatgacagcttcccctag

SEQ ID NO: 41084 - DNA, 348 bp, Artificial Sequence
  Description of Artificial Sequence: Synthetic coding sequence
ctgaccagccccaggagctgctcctggatcgcccccaagatgcagagcagcctgctggcccaggccatcagagatggagtcatcgaggccagcatcaaccacgagaagggctacgtgcagagcaaggagatgattgacatctacagcacccgggagccccagctggccttccaccagaggatctccttctgcctggacatccacaacatgtctgtgaaggccatgaggttcccccccaagagctacaacaaggacctggagagcgctgaggagcggcgggagcgggagcagcaggacctggagtttgccaaggagatggccgaggatgatgatgacagcttcccctag

SEQ ID NO: 41085 - DNA, 1071 bp, Artificial Sequence
  Description of Artificial Sequence: Synthetic coding sequence
atggacacagaagctgacctgcagttccggcccaggacaggcaaggccgccagcacccccctgctgcctgaggtggaggcctacctgcagctgctggtggtgatcttcatgatgaacagcaagcgctacaaggaggcccagaagatcagtgatgacctgatgcagaagatcagcacccagaacagaagagccctggacctggtggccgccaagtgctactactaccacgcccgggtgtatgagttcctggacaagctggatgtggtgcgctccttcctgcacgcccggctgaggacagccaccctgcggcatgatgctgatggccaggccaccctgctgaacctgctgctgaggaactacctgcactacagcctgtatgaccaggccgagaagctggtgtccaagagcgtcttccctgagcaggccaacaacaatgagtgggcccgctacctgtactacacaggccgcatcaaggccatccagctggagtacagcgaggcccggaggaccatgaccaatgccctgaggaaggccccccagcacacagctgtgggcttcaagcagacagtgcacaagctgctgattgtggtggagctgctgctgggggagatcccagaccggctgcagttccggcagcccagcctgaagaggagcctgatgccctacttcctgctgacccaggccgtgaggactggaaacctggccaagttcaaccaggtgctggaccagtttggagagaagttccaggctgatggcacctacaccctcatcatccggctgcggcacaacgtcatcaagacaggagtgaggatgatcagcctgagctacagccgcatcagcctggccgacatcgcccagaagctgcagctggacagcccagaagatgctgagttcatcgtggccaaggccatcagagatggagtgattgaggccagcatcaaccacgagaagggctacgtgcagagcaaggagatgattgacatctacagcacccgggagccccagctggccttccaccagaggatctccttctgcctggacatccacaacatgtctgtgaagggctggtag

SEQ ID NO: 41086 - DNA, 369 bp, Artificial Sequence
  Description of Artificial Sequence: Synthetic coding sequence
atggaggacacccccctggtgatcagcaagcagaagacagaggtggtgtgtggggtgcccacccaggtggtgtgcacagccttcagcagccacatcctggtggtggtgacccagtttgggaagatgggcaccctggtgtccctggagcccagctctgtggccagtgatgtgtccaagcctgtgctgaccaccaaggtgctgctgggccaggatgagcccctcatccacgtgtttgccaagaacctggtggcctttgtgtcccaggaggccggcaacagagctgtgctgctggccgtggccgtgaaggacaagtccatggagggcctgaaggccctgcgggaggtgatccgggtgtgccaggtgtggtag

SEQ ID NO: 41087 - DNA, 369 bp, Artificial Sequence; identical to SEQ ID NO: 41086
  Description of Artificial Sequence: Synthetic coding sequence

SEQ ID NO: 41088 - DNA, 369 bp, Artificial Sequence; identical to SEQ ID NO: 41086
  Description of Artificial Sequence: Synthetic coding sequence

SEQ ID NO: 41089 - DNA, 489 bp, Artificial Sequence
  Description of Artificial Sequence: Synthetic coding sequence
atggagggcctggtggtggccgctggaggagatgtgtccctgcacaacttcagcgcccggctgtgggagcagctggtgcacttccacgtgatgaggctgacagacagcctcttcctgtgggtgggcgccaccccccacctgaggaacctggccgtggccatgtgcagccgctatgacagcatccctgtgtccaccagcctgctgggggacaccagtgacaccaccagcacaggcctggcccagaggctgggcctgggcggcaagacaggcctggcctgtgaatgtggggtggagtggggcctgagcaaaggacatgaagctgagtgcagcaccctgcccaccccccagcacaccagctgtggccctgccaggaagaccaacaagcaggtgtttgtgtcctacaacctgcagaacacagacagcaactttgccctgctggtggagaaccgcatcaaggaggagatggaggccttccctgagaagttctag

SEQ ID NO: 41090 - DNA, 372 bp, Artificial Sequence
  Description of Artificial Sequence: Synthetic coding sequence
atggagggcctggtggtggccgctggaggagatgtgtccctgcacaacttcagcgcccggctgtgggagcagctggtgcacttccacgtgatgaggctgacagacagcctcttcctgtgggtgggcgccaccccccacctgaggaacctggccgtggccatgtgcagccgctatgacagcatccctgtgtccaccagcctgctgggggacaccagtgacaccaccagcacaggcctggcccagaggctggccaggaagaccaacaagcaggtgtttgtgtcctacaacctgcagaacacagacagcaactttgccctgctggtggagaaccgcatcaaggaggagatggaggccttccctgagaagttctag

SEQ ID NO: 41091 - DNA, 315 bp, Artificial Sequence
  Description of Artificial Sequence: Synthetic coding sequence
atggagggcctggtggtggccgctggaggagatgtgtccctgcacaacttcagcgcccggctgtgggagcagctggtgcacttccacgtgatgaggctgacagacagcctcttcctgtgggtgggcgccaccccccacctgaggaacctggccgtggccatgtgcagccgctatgacagcatccctgtgtccaccagcctgctgggggacaccagtgacaccaccagcacaggcctggcccagaggctgggcatgtacccccagctggccctgcacggccagcctggaggagcccacagcctgatggagccctag

SEQ ID NO: 41092 - DNA, 639 bp, Artificial Sequence
  Description of Artificial Sequence: Synthetic coding sequence
atggccagccgctatgaccgggccatcaccgtcttctccccagatggccacctgttccaggtggagtatgcccaggaggccgtgaagaagggcagcacagctgtgggcatccggggcctgacagcagatgcccgggtggtgatcaacagagcccgggtggagtgccagagccacaagctgactgtggaggaccctgtgacagtggagtacatcacccgcttcatcgccaccctgaagcagaagtacacccagagcaatggccggcggcccttcggcatcagcgccctgattgtgggctttgatgatgatggcatcagccggctgtaccagacagaccccagcggcacctaccacgcctggaaggccaatgccatcggccgcagcgccaagacagtgcgggagttcctggagaagaactacacagaagatgccatcgccagtgacagcgaggccatcaagctggccatcaaggccctgctggaggtggtgcagagcggcggcaagaacatcgagctggccatcatcagaagaaaccagcccctgaagatgttttctgccaaggaggtggagctgtatgtgacagaaattgagaaggagaaggaggaggccgagaagaagaagagcaagaagtctgtgtag

SEQ ID NO: 41093 - DNA, 753 bp, Artificial Sequence
  Description of Artificial Sequence: Synthetic coding sequence
atggccagccgctatgaccgggccatcaccgtcttctccccagatggccacctgttccaggtggagtatgcccaggaggccgtgaagaagggcagcacagctgtgggcatccggggcaccaacatcgtggtgctgggcgtggagaagaagtctgtggccaagctgcaggatgagaggacagtgaggaagatctgtgccctggatgaccacgtgtgcatggcctttgctggcctgacagcagatgcccgggtggtgatcaacagagcccgggtggagtgccagagccacaagctgactgtggaggaccctgtgacagtggagtacatcacccgcttcatcgccaccctgaagcagaagtacacccagagcaatggccggcggcccttcggcatcagcgccctgattgtgggctttgatgatgatggcatcagccggctgtaccagacagaccccagcggcacctaccacgcctggaaggccaatgccatcggccgcagcgccaagacagtgcgggagttcctggagaagaactacacagaagatgccatcgccagtgacagcgaggccatcaagctggccatcaaggccctgctggaggtggtgcagagcggcggcaagaacatcgagctggccatcatcagaagaaaccagcccctgaagatgttttctgccaaggaggtggagctgtatgtgacagaaattgagaaggagaaggaggaggccgagaagaagaagagcaagaagtctgtgtag

SEQ ID NO: 41094 - DNA, 639 bp, Artificial Sequence
  Description of Artificial Sequence: Synthetic coding sequence
atggccagccgctatgaccgggccatcaccgtcttctccccagatggccacctgttccaggtggagtatgcccaggaggccgtgaagaagggcagcacagctgtgatcttcatcggcctgacagcagatgcccgggtggtgatcaacagagcccgggtggagtgccagagccacaagctgactgtggaggaccctgtgacagtggagtacatcacccgcttcatcgccaccctgaagcagaagtacacccagagcaatggccggcggcccttcggcatcagcgccctgattgtgggctttgatgatgatggcatcagccggctgtaccagacagaccccagcggcacctaccacgcctggaaggccaatgccatcggccgcagcgccaagacagtgcgggagttcctggagaagaactacacagaagatgccatcgccagtgacagcgaggccatcaagctggccatcaaggccctgctggaggtggtgcagagcggcggcaagaacatcgagctggccatcatcagaagaaaccagcccctgaagatgttttctgccaaggaggtggagctgtatgtgacagaaattgagaaggagaaggaggaggccgagaagaagaagagcaagaagtctgtgtag

SEQ ID NO: 41095 - DNA, 636 bp, Artificial Sequence
  Description of Artificial Sequence: Synthetic coding sequence
atggatgtgtgcacctttgagaaggtgggcatccggggcaccaacatcgtggtgctgggcgtggagaagaagtctgtggccaagctgcaggatgagaggacagtgaggaagatctgtgccctggatgaccacgtgtgcatggcctttgctggcctgacagcagatgcccgggtggtgatcaacagagcccgggtggagtgccagagccacaagctgactgtggaggaccctgtgacagtggagtacatcacccgcttcatcgccaccctgaagcagaagtacacccagagcaatggccggcggcccttcggcatcagcgccctgattgtgggctttgatgatgatggcatcagccggctgtaccagacagaccccagcggcacctaccacgcctggaaggccaatgccatcggccgcagcgccaagacagtgcgggagttcctggagaagaactacacagaagatgccatcgccagtgacagcgaggccatcaagctggccatcaaggccctgctggaggtggtgcagagcggcggcaagaacatcgagctggccatcatcagaagaaaccagcccctgaagatgttttctgccaaggaggtggagctgtatgtgacagaaattgagaaggagtag

SEQ ID NO: 41096 - DNA, 1632 bp, Artificial Sequence
  Description of Artificial Sequence: Synthetic coding sequence
atgaactgcctggagggccctgggaagacctgtggccccctggccagcgaggaggagctggtgtctgcctgccagctggagaaggaggaggagaatgaaggagaggaggaggaggaggaggaggatgaggaggacctggaccctgacctggaccctgacctggaggaggaggagaatgacctgggggaccctgctgtgctgggcgctgtgcacaacacccagagggccctgctgagcagccctggggtgaaggcccctggcatgctgggcatgagcctggccagcctgcacttcctgtggcagaccctggactacctgagccccatccccttctggcccaccttccccagcaccagcagccctgcccagcacttcggcccccggctgcccagcccagaccccaccctcttctgcagcctgctgacctcctggcccccacgcttcagccacctgacccagctgcaccccaggcaccagaggatcctgcagcagcagcagcacagccagacccccagccccccagccaagaagccctggagccagcagcctgacccctatgccaacctgatgaccaggaaggagaaggactgggtgatcaaggtgcagatggtgcagctgcagagcgccaagccccggctggatgactactactaccaggagtactaccagaagctggagaagaagcaggctgatgaggagctgctgggcagaagaaacagagtggagagcctgaagctggtgaccccctacatccccaaggccgaggcctatgaatctgtggtgagaattgagggcagcctgggccaggtggccgtgtccacctgcttcagcccccggcgggccattgatgctgtgccccacggcacccaggagcaggacatcgaggccgccagcagccagaggctgcgggtgctgtaccgcatcgagaagatgttcctgcagctgctggagattgaggagggctggaagtaccggcccccaccaccctgcttcagcgagcagcagagcaaccaggtggagaagctgttccagaccctgaagacccaggagcagaacaacctggaggaggccgcagatggcttcctgcaggtgctgtctgtgaggaagggcaaggccctggtggcccggctgctgcccttcctgccccaggaccaggccgtgaccatcctgctggccatcacccaccacctgcccctgctggtgagaagagatgtggccgaccaggccctgcagatgctgttcaagcccctgggcaagtgcatcagccacctgaccctgcacgagctgctgcagggcctgcagggcctgaccctgctgcccccaggcagcagcgagaggcctgtgacagtggtgctgcagaaccagtttggcatcagcctgctgtatgccctgctgagccatggagagcagctggtgtccctgcacagcagcctggaggagcccaacagcgaccacacagcctggacagacatggtggtgctgattgcctgggagatcgcccagatgcccacagccagcctggccgagcccctggccttccccagcaacctgctgcccctcttctgccaccacgtggacaagcagctggtgcagcagctggaggccaggatggagtttgcctggatctactag

SEQ ID NO: 41097 - DNA, 1632 bp, Artificial Sequence; identical to SEQ ID NO: 41096
  Description of Artificial Sequence: Synthetic coding sequence

SEQ ID NO: 41098 - DNA, 6708 bp, Artificial Sequence
  Description of Artificial Sequence: Synthetic coding sequence
atgcccctcttcttcagcgccctgctggtgctgctgctggtggccctgagcgccctcttcctgggccgctggctggtggtgcggctggccaccaagtggtgccagaggaagctgcaggccgagctgaagattggcagcttccgcttcttctggatccagaatgtgtccctgaagttccagcagcaccagcagacagtggagattgacaacctgtggatcagcagcaagctgctgagccatgacctgccccactacgtggccctgtgcttcggggaggtgcgcatcagaacagacctgcagaaggtgtctgacctgagcgcccccttcagccagagcgctggggtggaccagaaggagctgtccttcagccccagcctgctgaagatcttctgccagctgttcagcatccacgtggatgccatcaacatcatggtgctgaaggtggacaccagcgagagcctgtggcacatccagatcagccgcagccgcttcctgctggacagtgatggcaagaggctcatctgtgaggtgtccctgtgcaagatcaacagcaaggtgctgaagagcggccagctggaggacacctgcctggtggagctgagcctggccctggacctgtgcctgaaggtgggcatcagcagccgccacctgacagccatcaccgtggatgtgtggaccctgcatgctgagctgcacgagggcctcttccagagccagctgctgtgccagggccccagcctggccagcaagcctgtgccctgcagcgaggtgacagagaacctggtggagcccaccctgcccggcctcttcctgctgcagcagctgcctgaccaggtgaaggtgaagatggagaacacctctgtggtgctgtccatgaacagccagaagaggcacctgacctggaccctgaagctgctgcagttcctgtaccacagagatgaggaccagctgcccctgcgctccttcaccgccaacagcgacatggcccagatgagcacagagctgctgctggaggatggcctgctgctgagccagagccggcagagaattgtgtgcctgaacagcctgaaggcctctgtgcaggtgaccaccatcgacctgagcgccagcctggtgctgaacacctgcatcatccactaccgccaccaggagttcagccactggctgcacctgctggccctggagacccagggcagcagcagccctgtgctgaagcagaggaagaagaggaccttcccccagatcctggcccccatcatcttcagcaccagcatcagcaatgtgaacatcagcatccagctgggggacaccccaccatttgccctgggcttcaacagcatcagcctggactaccagcacctgcggccccagagcatccaccagaggggcgtgctgactgtggaccacctgtgctggagggtgggcagtgacagccacatccagagggccccccacccccccaacatgcacgtgtggggcgaggccctggtgctggacagcttcaccctgcagggcagctacaaccagcccctgggcctgagcagcacccagagcgacaccctcttcctggactgcaccatccggggcctgcaggtggaggccagtgacacctgtgcccagtgcctgagccgcatcctgagcctgatgggcccccagagcggcaagtctgctgtgagccgccacagcagctttggagagagcgtgtccctgctgtggaaggtggacctgaaggtggaggacatgaacctcttcaccctgagcgccctggtgggcgccagcgaggtgcggctggacaccctgaccatcctgggcagcgctgagaccagcacagtgggcatccagggcctggtgctggccctggtgaagtctgtgacagagaagatgcagccctgctgcaaggccccagacatccccacccctgtgctgagcctgtccatgctgagcatcacctaccacagcagcatccgcagcctggaggtgcagtgtggggccggcctgaccctgctgtggagccccccagaccacatgtacctgtaccagcacgtgctggccaccctgcagtgccgggacctgctgcgggccaccgtcttccctgagaccgtgcccagcctggccctggagaccagcggcaccaccagcgagctggagggccgggcccctgagcccctgccccccaagaggctgctgaacctgaccctggaggtgtccacagccaagctgacagcctttgtggccgaggacaagttcatcaccctggccgctgagagcgtgtccctgagccgccacggcggcagcctgcaggcctactgcccagagctggccgccggctttgatggcaacagcatcttcaacttcaaggaggtggaggtgcagctgctgcctgagctggaggagatgatcctgcacaggaaccccttccctgccctgcagaccctgaggaacagagtgtggctgctgagctttggatctgtgtctgtggagttcccctaccagtatgacttcagcaggaccctggatgaagctgtgggcgtgcagaagtggctgaagggcctgcaccagggcacccgggcctgggccagccccagccctgtgcccctgcccccagacctgctgctgaaggtggagcacttctcctgggtgttcctggatgatgtgtttgaggtgaagctgcatgacaactatgagctgatgaaggatgagagcaaggagagcgccaagaggctgcagctgctggatgccaaggtggccgccctgaggaagcagcacggggagctgctgcctgccaggaagattgaggagctgtatgccagcctggagaggaagaacatcgagatctacatccagaggagccggcggctgtatggcaacacccccatgaggcgggccctgctgacctggagcctggccggcctggagctggtggccctggctgatgccagcttccacggccctgagcacgtggtggagcaggtgcaggagctggaccccggcagccccttccccccagagggcctggacctggtgatccagtggtgcaggatgctgaagtgcaatgtgaagagcttcctggtgcgcatccgggactacccccgctacctgtttgagatccgggactggaggctgatgggccgcctggtgggcacagagcagagcggccagccctgcagcagaagacggcagatcctgcacctgggcctgccctggggcaatgtggccgtggagaggaacatgccacccctgaagttctaccatgacttccacagcgagatcttccagtacacagtggtgtggggcccctgctgggaccctgcctggaccctcatcggccagtgtgtggacctgctgaccaagcccagcgctgaccccagcccccccctgccctggtgggacaagagccggctgctcttccatggagactggcacatggacatcgagcaggccaacctgcaccagctggccacagaggacccctacaacaccacagagaacatgcactgggagtggagccacctgtccttccactggaagccaggccagtttgtgttcaagggggacctggacatcaacgtgaggacagccagcaaatatgatgactgctgcttcctgcacctgcctgacctgtgcatgaccctggacctgcagtggctgtgccacggcaacccccatgaccaccacagcgtgaccctgcgggcccctgagttcctgcctgaggtgcccctgggccagctgcatgacagctaccgggccttccgctctgagaacctgaacctgagcatcaagatggacctgaccaggcacagcggcaccatcagccagccccgcatcctgctgtacagcagcaccctgcgctggatgcagaacttctgggccacctggacctctgtgacccggcccatctgccggggcaagctgttcaacaacctgaagcccagcaagaagaagctgggccagcactacaagcagctgagctacacagccctcttcccccagctgcaggtgcactactgggccagctttgcccagcagaggggcatccagatcgagtgcagccagggccacgtgttcacccggggcacccagaggctcatcccccaggccggcaccgtgatgagaagactcatcagtgactggagcgtgacccagatggtgtctgacctgagccaggtgacagtgcacctgatggccagccccacagaggagaatgctgaccactgcctggaccccctggtgaccaagacccacctgctgagcctgagcagcctgacctaccagaggcacagcaacagaacagctgaggaggagctgagcgccagagatggagaccccaccttccacacccaccagctgcacctggtggacctgcgcatctcctggaccaccaccaacagagacatcgccttcggcctgtatgatggctacaagaaggctgctgtgctgaagaggaacctgagcacagaggccctgaagggcctgaagattgacccccagatgcctgccaagaagcccaagaggggcgtgcccaccagcgccagcgccccaccccgggtgaacacccccagcttcagcggccagcctgacaagggcagcagcggcggggcctacatgctgcagaagctgattgaggagacagacagatttgtggtgttcacagaggaggagagcggcatgtctgaccagctgtgtggcattgctgcctgccagacagatgacatctacaacagaaactgcctgattgagctggtgaactgccagatggtgctgcggggagctgagacagagggctgtgtgattgtgtctgctgccaaggcccagctgctgcagtgccagcaccacccagcctggtatggagacaccctgaagcagaagacctcctggacctgcctgctggatggcatgcagtactttgccaccacagagagcagccccacagagcaggacggccggcagctgtggctggaggtgaagaacatcgaggagcaccggcagaggagcctggacagcgtgcaggagctgatggagagcggccaggccgtgggcggcatggtgaccaccaccacagactggaaccagcctgctgaggcccagcaggcccagcaggtgcagaggatcatcagccgctgcaactgcaggatgtactacatctcctacagccatgacatcgaccctgagctggccacccagatcaagcccccagaggtgctggagaaccaggagaaggaggacctgctgaagaagcaggagggcgctgtggacaccttcaccctcatccaccacgagctggagatcagcaccaacccagcccagtatgccatgatcctggacatcgtgaacaacctgctgctgcacgtggagcccaagaggaaggagcacagcgagaagaagcagagggtgcgcttccagctggagatcagcagcaaccctgaggagcagaggagcagcatcctgcacctgcaggaggccgtgcggcagcacgtggcccagatccggcagctggagaagcagatgtacagcatcatgaagagcctgcaggatgacagcaagaatgaaaacctgctggacctgaaccagaagctgcagctgcagctgaaccaggagaaggccaacctgcagctggagagcgaggagctgaacatcctgatccgctgcttcaaggacttccagctgcagagggccaacaagatggagctgaggaagcagcaggaggatgtgtctgtggtgagaagaacagagttctactttgcccaggcccgctggaggctgacagaagaagatggccagctgggcattgctgagctggagctgcagcgcttcctgtacagcaaggtgaacaagagtgatgacacagctgagcacctgctggagctgggctggttcaccatgaacaacctgctgcccaatgctgtgtacaaggtggtgctgcggccccagagcagctgccagagcggccggcagctggccctgcggctcttcagcaaggtgcggccccctgtgggcggcatctctgtgaaggagcactttgaggtgaatgtggtgcccctgaccatccagctgacccaccagttcttccacaggatgatgggcttcttcttccctggccgctctgtggaggatgatgaggtgggagatgaggaggacaagagcaagctggtgaccaccggcatccctgtggtgaagccccggcagctgattgccacagatgatgctgtgcccctgggccctggaaaaggagtggcccagggcctgaccaggagcagtggagtgcggcgctccttcaggaagagccctgagcaccctgtggatgacatcgacaagatgaaggagagagctgccatgaacaacagcttcatctacatcaagatcccccaggtgcccctgtgtgtgtcctacaagggggagaagaacagcgtggactggggagacctgaacctggtgctgccctgcctggagtaccacaacaacacctggacctggctggactttgccatggctgtgaagagggacagcaggaaggccctggtggcccaggtgatcaaggagaagctgcggctgaagagcgccactggaagtgaggtgcggggcaagctggagaccaagagtgacctgaacatgcagcagcaggaggaggaggagaaggcccggctgctgattggcctgtctgtgggggacaagaaccctgggaagaagagcatctttggaagaaggaagtag

SEQ ID NO: 41099 - DNA, 417 bp, Artificial Sequence
  Description of Artificial Sequence: Synthetic coding sequence
atggaggcctgggagagcagccagcccctgctgcgctgtgagatcccctgccccctgcccggcacagacagagatggctctgtgtccctgcctggagaggccgccagctgtgacctggacaccctggagcctgagcacggcaacagaagagtgtctggcaaccccatctctgtgtgctgggcctacaaggtgaccaaggtgaagtgctggagcgtgcgggagcggggcggccgccacatcggcggccccaggaacaccctgaagcacccagcccaccacggcatgggcaagaacctggccaccagcctgcccacagctgccagcctgggcctgggcaagggccagctgctggtgtccatccgcttcatggacaccaccaagaagaggggccagagcgagaccttcaacatctgctag

SEQ ID NO: 41100 - DNA, 1203 bp, Artificial Sequence
  Description of Artificial Sequence: Synthetic coding sequence
atgggcgtgctgatgagcaagaggcagacagtggagcaggtgcagaaggtgtccctggccgtgtctgccttcaaggatggcctgcgggaccggcccagcatcagaagaactggagagctgcccggcagccggcggggcaccgtggagggctctgtgcaggaggtgcaggaggagaaggaggccgaggccggcacctctgtggtgcaggaggagagcagcgctggccgggccgcctgggagcggctgagagatggccggggcgtggagcctgaggagtttgacaggaccagccgcttcaccccaccagccttcatccggcccaccaggaagctggatgatgacaagcccccagagatctgcctggagccccgggagcctgtggtgaatgatgagatgtgtgatgtgtgtgaggtgtggacagctgagagcctcttcccctgccgggtgtgcaccagggtcttccatgatggctgcctgcggaggatgggctacatccagggcgacagcgctgctgaggtgacagagatggcccacacagaaacaggctggagctgccactactgtgacaacatcaacctgctgctgacagaggaggagatgtacagcctgacagagaccttccagcgctgcaaggtgatcccagactgcagcctgaccctggaggacttcctgcgctaccgccaccaggccgccaagagaggagaccgggaccgggccctgtctgaggagcaggaggagcaggccgcccggcagtttgctgccctggaccctgagcaccggggccacatcgagtggccagacttcctgagccatgagagcctgctgctgctgcagcagctgcggccccagaacagcctgctgcggctgctgactgtgaaggagcgggagcgggcccgggccgccttcctggcccggggcagcggcagcacagtgtctgaggctgaatgtagaagagcccagcacagctggttctgcaagcgcttccctgaggcccccagctgcagcgtgtccatcagccacgtgggccccatcgctgacagcagccctgccagcagcagcagcaagagccaggacaagaccctgctgcccacagagcaggagagcagatttgtggactggcccaccttcctgcaggagaatgtgctgtacatcctggccgcccggcccaacagcgctgccatccacctgaagcccccaggatag

SEQ ID NO: 41101 - DNA, 1230 bp, Artificial Sequence
  Description of Artificial Sequence: Synthetic coding sequence
atgggcagccaggccgctgctgagtggaggaactgggcctcctgggaggtgagcagcagcctgagcggctgcagcatgggctgcttcaaggatgaccgcatcgtgttctggacctggatgttcagcacctacttcatggagaagtgggccccccggcaggatgacatgctgttctacgtgcggaggaagctggcctacagcggcagcgagagcggggctgatggcaggaaggctgctgagcctgaggtggaggtggaggtgtacagaagagacagcaagaagctgcccggcctgggggaccctgacatcgactgggaggagagcgtgtgcctgaacctgatcctgcagaagctggactacatggtgacctgtgctgtgtgcaccagggcagatggaggagacatccacatccacaagaagaagagccagcaggtgtttgccagccccagcaagcaccccatggacagcaaaggagaggagagcaagatctcctaccccaacatcttcttcatgattgacagctttgaggaggtgttcagtgacatgacagtgggggagggggagatggtgtgtgtggagctggtggccagtgacaagaccaacaccttccagggcgtcatcttccagggcagcatccgctatgaggccctgaagaaggtgtatgacaacagagtgtctgtggccgccaggatggcccagaagatgagctttggcttctacaagtacagcaacatggagtttgtgaggatgaagggcccccagggcaagggccatgctgagatggctgtgtcccgggtgtccactggagacaccagcccctgtggcacagaggaggacagcagccctgccagccccatgcatgagcgggtgaccagcttcagcaccccacccaccccagagaggaacaacagacctgccttcttcagccccagcctgaagaggaaggtgcccaggaacagaattgctgagatgaagaagagccacagcgccaatgattctgaggagttcttcagagaagatgatggaggagctgacctgcacaatgccaccaacctgcggagccgcagcctgagcggcaccggccgcagcctggtgggctcctggctgaagctgaacagagcagatggcaacttcctgctgtatgcccacctgacctacgtgaccctgcccctgcaccgcatcctgacagacatcctggaggtgcggcagaagcccatcctgatgacctag

SEQ ID NO: 41102 - DNA, 333 bp, Artificial Sequence
  Description of Artificial Sequence: Synthetic coding sequence
ggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatcatgtag

SEQ ID NO: 41103 - DNA, 3753 bp, Artificial Sequence
  Description of Artificial Sequence: Synthetic coding sequence
atggccgccatggcccctgggggcagcggcagcggcggcggcgtgaaccccttcctgagtgacagtgatgaagatgatgatgaggtggccgccacagaggagaggagagctgtgctgcggctgggcgccggcagcggcctggaccccggcagcgctggcagcctgagcccccaggaccctgtggccctgggcagcagcgcccggcccggcctgcccggggaggccagcgctgctgctgtggccctgggcggcactggagagaccccagcccggctgagcattgatgccatcgccgcccagctgctgcgggaccagtacctgctgacagccctggagctgcacacagagctgctggagagcggccgggagctgccccggctgcgggactacttcagcaaccctggcaactttgagcggcagagcggcaccccacctggcatgggcgcccctggggtgcctggagctgctggggtgggcggggccggcggccgggagcccagcacagccagcggcggcggccagctgaacagagctggcagcatcagcaccctggacagcctggactttgcccgctacagtgatgatggcaaccgggagacagatgagaaggtggccgtgctggagtttgagctgaggaaggccaaggagaccatccaggccctgcgggccaacctgaccaaggctgctgagcacgaggtgcccctgcaggagaggaagaactacaagagcagccctgagatccaggagcccatcaagcccctggagaagagggccctgaacttcctggtgaatgagttcctgctgaagaacaactacaagctgaccagcatcaccttcagtgatgaaaatgatgaccaggactttgagctgtgggatgatgtgggcctgaacatccccaagcccccagacctgctgcagctgtacagagactttggaaaccaccaggtgacaggcaaggacctggtggatgtggccagcggcgtggaggaggatgagctggaggccctgacccccatcatcagcaacctgccccccaccctggagaccccccagcctgctgagaacagcatgctggtgcagaagctggaggacaagatcagcctgctgaacagcgagaagtggagcctgatggagcagatccggcggctgaagtctgagatggacttcctgaagaatgagcactttgccatcccagctgtgtgtgacagcgtgcagccccccctggaccagctgccccacaaggacagtgaagattctggccagcacccagatgtgaacagcagtgacaagggcaagaacacagacatccacctgagcatcagtgatgaggccgacagcaccatccccaaggagaacagccccaacagcttcccccggcgggagcgggagggcatgccacccagcagcctgagcagcaagaagacagtgcactttgacaagcccaacaggaagctgagccctgccttccaccaggccctgctgtccttctgcaggatgtctgctgacagccggctgggctatgaggtgtccagaattgctgacagcgagaagtctgtgatgctgatgctgggccgctgcctgccccacatcgtgcccaacgtgctgctggccaagcgggaggagctgatccccctcatcctgtgcacagcctgcctgcaccctgagcccaaggagcgggaccagctgctgcacatcctcttcaacctgatcaagaggccagatgatgagcagaggcagatgatcctgaccggctgtgtggcctttgcccggcacgtgggccccaccagggtggaggccgagctgctgccccagtgctgggagcagatcaaccacaagtacccagagcggcggctgctggtggccgagagctgtggggccctggccccctacctgcccaaggagatccgcagcagcctggtgctgtccatgctgcagcagatgctgatggaggacaaggctgacctggtgcgggaggccgtcatcaagagcctgggcatcatcatgggctacattgatgatcctgacaagtaccaccagggctttgagctgctgctgagcgccctgggggaccccagcgagcgggtggtgtctgccacccaccaggtgttcctgcctgcctatgctgcctggaccacagagctgggcaacctgcagagccacctgatcctgaccctgctgaacaagattgagaagctgctgcgggagggggagcacggcctggatgagcacaagctgcacatgtacctgagcgccctgcagagcctcatccccagcctgtttgccctggtgctgcagaatgcccccttcagcagcaaggccaagctgcacggggaggtgccccagatcgaggtgacccgcttcccccggcccatgagccccctgcaggatgtgtccaccatcatcggcagccgggagcagctggccgtgctgctgcagctgtatgactaccagctggagcaggagggcaccaccggctgggagagcctgctgtgggtggtgaaccagctgctgccccagctgattgaaattgtgggcaagatcaacgtgaccagcacagcctgtgtgcatgagttcagccgcttcttctggaggctgtgcaggaccttcggcaagatcttcaccaacaccaaggtgaagccccagttccaggagatcctgcggctgtctgaagaaaatattgacagcagcgctggaaatggagtgctgaccaaggccaccgtgcccatctatgccaccggggtgctgacctgctacatccagatcaaggagtacctgcacatccacaatgagatctcctgggagtgggaccccagcctgaacaccaagtgtgtgtcctacacccactacacccacagcctgaaggaggaggacaggaagctgctggtgggcttcctggaggatgtgatgaccctgctgagcctgagccacgcccccctggacagcctgaaggccagctttgtggagctgggcgccaacccagcctaccacgagctgctgctgactgtgctgtggtatggagtggtgcacaccagcgccctggtgcgctgcacagctgccaggatgtttgagctgctggtgaagggcgtgaatgagaccctggtggcccagagggtggtgcctgccctgatcaccctgagcagtgaccctgagatctctgtgagaattgccaccatcccagccttcggcaccatcatggagaccgtcatccagcgggagctgctggagcgggtgaagatgcagctggccagcttcctggaggacccccagtaccaggaccagcacagcctgcacacagagatcatcaagaccttcggccgggtgggccccaatgctgagccccgcttcagagatgaatttgtgatcccccacctgcacaagctggccctggtgaacaacctgcagatcgtggacagcaagaggctggacatcgccacccacctgtttgaggcctacagcgccctgagctgctgcttcatcagcgaggacctgatggtgaaccacttcctgcccggcctgcgctgcctgaggacagacatggagcacctgagccctgagcacgaggtgatcctgagctccatgatcaaggaatgtgagcagaaggtggagaacaagacagtgcaggagccccagggctccatgagcattgctgccagcctggtgtctgaggacaccaagaccaagttcctgaacaagatgggccagctgaccaccagcggggccatgctggccaacgtgttccagaggaagaagtag

SEQ ID NO: 41104 - DNA, 6054 bp, Artificial Sequence
  Description of Artificial Sequence: Synthetic coding sequence
atgaccagcaggaccaagaggcggcagaaggtgaagatcagcatcagcaagatcaaccacagcagctacaggaaggagcaccggcccttctgggagcaccagcccccaccccaccagaactgggccgtgggcggccgctgtggggccggggcccggcccggcctgagccagaggcggggccgggaggtgcggcgggaggcccagggcggggccagcagccggcggctgcgggcccggctgtacttcagcgagagcaccagcctgcccctggaccggcggggcagccctggccccctgggccctgccccccacggcctgcggcgggccgccccccggggccctgcccggaggacccccaggagcacagccctgaccagcagaagaagagcccagaggcccaggcatggagaccggctgcggctgcggtctgaggcccggcccagggctgctggggactggccctgtgcccggggcggcgctgtgcggcccggccggccccacaggcctccccgggtggagagcgcccggggggcccacgccggccgggccgccacagaccagctggagagggtcttcctgcggctgggccacgccgagacagatgagcagctgcagaacatcatcagcaagttcctgccccctgtgctgctgaagctgagcagcacccaggagggcgtgaggaagaaggtgatggagctgctggtgcacctgaacaagaggatcaagagccggcccaagatccagctgcctgtggagaccctgctggtgcagtaccaggaccctgctgctgtgtcctttgtgaccaacttcaccatcatctacgtgaagatgggctacccccggctgcctgtggagaagcagtgtgagctggcccccaccctgctgacagccatggagggcaagccccagccccagcaggacagcctgatgcacctgctgatccccaccctcttccacatgaagtaccctgtggagagcagcaagagcgccagccccttcaacctggccgagaagcccaagacagtgcagctgctgctggacttcatgctggatgtgctgctgatgccctacggctacgtgctgaatgaaagccagagccggcagaacagcagcagcgcccagggcagcagcagcaacagcggcggcggcagcggcatcccccagcccccacctggcatgtccttctatgctgccaagagggtcatcggggacaacccctggaccccagagcagctggagcagtgcaagctgggcatcgtgaagttcattgaagctgagcaggtgcctgagctggaggccgtgctgcacctggtgattgccagcagtgacaccaggcacagcgtggccacagctgctgacctggagctgaagagcaagcagagcctgattgactggaacaacccagccatcatcaacaagatgtacaaggtgtacctgggggacatccccctgaagaccaaggagggcgctgtgctgaagccagagctgaagagggaccctgtgtccaccagggtgaagctgaagatcgtgccccacctgctgcggagccggcaggccgctgagaccttccctgccaacatccaggtggtgtatgatggcctgtttggcaccaacaccaacagcaagctgcggaccctgagcctgcagtttgtgcaccacatctgcatcacctgcccagagatcaagatcaagcccctgggccccatgctgctgaatggcctgaccaagctgatcaatgagtacaaggaggaccccaagctgctgtccatggcctacagcgctgtgggcaagctgagcagcaggatgccccacctgttcaccaaggacatcgccctggtgcagcagctgtttgaggccctgtgcaaggaggagcctgagacccggctggccatccaggaggccctgtccatgatggtgggcgcctacagcaccctggagggcgcccagaggaccctgatggaggccctggtggccagctacctgatcaagccagaggtgcaggtgcggcaggtggccgtgaagtttgccagcaccgtcttccccagcgaccacatccccagccgctacctgctgctgctggccgccggggacccccgggaggaggtgcatggagaggcccagagggtgctgcgctgcctgcccggcaggaacaggaaggagagcaccagcgagcagatgcccagcttccctgagatggtgtactacatccaggagaaggccagccacaggatgaagacccctgtgaagtacatgacaggcaccaccgtgctgcccttcaacccagctgccttcggggagatcgtgctgtacctgaggatgtgcctggcccacagcgctggggtggtgcccaccagccagagcctggccgacatgcaggaccacgccccagccatcggccgctacatccgcaccctgatgagcagcggccagatggcccccagcagcagcaacaagtctggagagaccaaccctgtgcagatctacatcggcctgctgcagcagctgctggccggcgtgggcggcctgcctgtgatgtactgcctgctggaggccgtgtctgtgtacccagagaagctggccaccaagtttgtggacaagacagagtggatcaagagcctgatgaacaacagcaaggaggagatgagggagctggccgccctcttctacagcgtggtggtgtccacagtgtctggaaatgagctgaagtccatgattgagcagctgatcaagaccaccaaggacaaccacagccctgagatccagcacggcagcctgctggccctgggcttcaccgtgggccgctacctggccaagaagaagatgaggatgtctgagcagcaggacctggagagaaatgctgacaccctgcctgaccaggaggagctgatccagagcgccacagagaccatcggcagcttcctggacagcaccagccccctgctggccatcgccgcctgcacagccctgggggagatcggcagaaatggccccctgcccatccccagcgagggcagcggcttcaccaagctgcacctggtggagagcctgctgagccgcatccccagcagcaaggagaccaacaagatgaaggagcgggccatccagaccctgggctacttccctgtgggagatggagacttcccccaccagaagctgctgctgcagggcctgatggacagcgtggaggccaagcagatcgagctgcagttcaccatcggggaggccatcaccagcgctgccatcggcaccagctctgtggccgccagagatgcctggcagatgacagaggaggagtacaccccacctgctggggccaaggtgaatgatgtggtgccctgggtgctggatgtgatcctgaacaagcacatcatcagccccaacccccacgtgcggcaggccgcctgcatctggctgctgagcctggtgaggaagctgagcacccacaaggaggtgaagagccacctgaaggagatccagagcgcctttgtgtctgtgctgtctgaaaatgatgagctgagccaggatgtggccagcaagggcctgggcctggtgtatgagctgggcaatgagcaggaccagcaggagctggtgtccaccctggtggagaccctgatgaccgggaagagggtgaagcatgaggtgtctggagagaccgtggtgttccagggcggggccctgggcaagaccccagatggccagggcctgagcacctacaaggagctgtgcagcctggccagtgacctgagccagcctgacctggtgtacaagttcatgaacctggccaaccaccacgccatgtggaacagcaggaaaggagctgccttcggcttcaacgtcatcgccacccgggccggggagcagctggcccccttcctgccccagctggtgccccggctgtaccgctaccagtttgaccccaacctgggcatccggcaggccatgaccagcatctggaatgccctggtgacagacaagtccatggtggacaagtacctgaaggagatcctgcaggacctggtgaagaacctgaccagcaacatgtggagggtgcgggagagcagctgcctggccctgaatgacctgctgcggggccggcccctggatgacatcatcgacaagctgcctgagatctgggagaccctcttccgggtgcaggatgacatcaaggagagcgtgaggaaggctgctgagctggccctgaagaccctgagcaaggtgtgtgtgaagatgtgtgaccctgccaagggagctgctggccagaggaccatcgccgccctgctgccctgcctgctggacaagggcatgatgagcacagtgacagaggtgcgggccctgagcatcaacaccctggtgaagatcagcaagtctgctggggccatgctgaagccccacgcccccaagctgatcccagccctgctggagagcctgtctgtgctggagccccaggtgctgaactacctgagcctgcgggccacagagcaggagaaggccgccatggattctgcccggctgtctgctgccaagagcagccccatgatggagaccatcaacatgtgcctgcagtacctggatgtgtctgtgctgggggagctggtgccccggctgtgtgagctgatccgctctggagtgggcctgggcaccaagggcggctgtgcctctgtgattgtgtccctgaccacccagtgcccccaggacctgaccccctacagcggcaagctgatgtctgccctgctgagcggcctgacagacaggaacagcgtcatccagaagagctgtgcctttgccatgggccacctggtgaggaccagccgggacagcagcacagagaagctgctgcagaagctgaatggctggtacatggagaaggaggagcccatctacaagaccagctgtgccctgaccatccacgccatcggccgctacagcccagatgtgctgaagaaccacgccaaggaggtgctgcccctggccttcctgggcatgcatgaaattgctgatgaggagaagtctgagaaggaggagtgcaacctgtggacagaggtgtggcaggagaatgtgcccggcagctttggaggcatccggctgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgacagccctgctgcagggcctggccggccgcacctgggccggcaaggaggagctgctgaaggccatcgcctgtgtggtgacagcctgcagcgctgagctggagaagtctgtgcccaaccagcccagcaccaatgagatcctgcaggccgtgctgaaggaatgttccaaagaaaatgtgaagtacaagatcgtggccatcagctgtgccgctgacatcctgaaggccaccaaggaggaccgcttccaggagttcagcaacatcgtcatccccctcatcaagaagaacagcctggagagcagcggcgtgaggaccaccaagaatgaggaggagaatgagaaggagaaggagctgcagctggagtacctgctgggcgcctttgagagcctgggcaaggcctggcccagaaatgctgagacccagcgctgctaccggcaggagctgtgcaagctgatgtgtgagcggctgaagctgagcacctggaaggtgcagctgggcgtgctgcagagcatgaatgccttcttccagggcctgatgctgctggaggaggagcacgccgaccctgaggccctggccgagatcctgctggagacctgcaagagcatcacctacagcctggagaacaagacctacagctctgtgaggacagaggccctgtctgtgattgagctgctgctgaagaagctggaggagagcaagcagtgggagtgcctgaccagcgagtgccgggtgctgctgattgagagcctggccaccatggagccagacagcaggcctgagctgcaggagaaggccgccctgctgaagaagaccctggagaacctggagtag

SEQ ID NO: 41105 - DNA, 4857 bp, Artificial Sequence
  Description of Artificial Sequence: Synthetic coding sequence
atggatggccagaccctgaggaaggccgagaggtcctggagctgcagccgggagaagaaggagggctacgccaaggacatggtgacagactttgatgagaagcatgatgagtacctgatcctgctgcagcagaggaaccgcatcctgaagcacctgaagagcaaggaccctgtgcagctgcggctggagcacctggagcagggcttctctgtgtatgtgaatggagccaacagcgagctgaagagcagccccaggaaggccatccacagcgacttcagccgcagcgccagccacacagagggcacccatgactatggaagaaggaccctcttccgggaggccgaggaggccctgcggcgcagcagcaggacagcccccagcaaggtgcagaggcggggctggcaccagaagtctgtgcagatcagaacagaagctggcccccggctgcacatcgagccccctgtggactacagtgatgactttgagctgtgtggagatgtgaccctgcaggccaacaacaccagcgaggaccggccccaggagctgcggcgcagcctggagctgtctgtgaacctgcagaggaagcagaaggactgcagcagtgatgaatatgacagcattgaggaggacatcctgtctgagcctgagcctgaggaccctgccctggtgggccaccccaggcatgacaggcctcccagcagcggggactggacccagaaggatgtgcatggagagcaggagacagagggccgcagcagccctggccctgacaccctggtggtgctggagttcaacccagccagcaagagccacaagcgggagaggaacctgagcgccaagaggaaggacaatgctgaggtgtttgtgcccaccaagccagagcccaacctgaccccccaggccccagctgtgtttcctgaccaggagaggatgtgcagcaggcctggcagccggcgggagcggcccctgagcgccaccaggaagaccctgtgtgaggccgagtacccagaggaggatgccagcgctgtgctgcaggccatccaggtggagaatgctgccctgcagagggccctgctgagcaggaaggccgagcagcctgccagccccctgcaggatgctgagggccccccagccaagccctggaccagcctgctggaggagaaggaggagaccctggagctgctgcccatcaccacagccaccaccacccaggagcctgctggagctgctgggggcgcccgggccatcaaccaggccatggacagaattggcctgctgggcagccggcagcagcagaagctgctgaaggtgctgcaggccgtggagagtgacagcgcccacctgggccgggtggtgagccccaccaaggagcaggtgtctgacacagaggacaagcagaggatgagagcagatgagatcaaggatgccatctacgtgaccatggagatcctgagcaactggggcaacagctggtgggtgggcctgacagaggtggagttctttgacctgaatgacaccaagctgtatgtgagcccccatgatgtggacatccggaacacagccaccccaggagagctgggccgcctggtgaacagaaacctggccggcaagaaggacagcagcccctggacctgccccttccacccccccctgcagctgttctttgtgatccggaacacccggcagctgggggacttccacctggccaagatcaaggtgaggaactactggacagcagatggagacctggacattggagccaagaatgtgaagctgtatgtgaacagaaacctgatcttcaacgggaagctggacaagggggaccgggaggccccagctgaccacagcatcctggtggaccagaagaatgagaagtctgagcagctggaggaggccatgaatgcccacagcgaggagagcaagggcacccatgagatggccggggccagcggggacaaggagctgggcctgggctgcagccccccagctgagaccctggctgatgccaagctgagcagccagggcaatgtgtctgggaagaggaagaacagcaccaactgcaggaaggacagcctgagccagctggaggagtacctgcggctgtctgctgtgcccacctccatgggagacatgcccagcgccccagccaccagcccccctgtgaagtgcccccctgtgcatgaggagcccagcctcatccagcagctggagaacctgatgggcaggaagatctgtgagcccccaggcaagacccccagctggctgcagcccagccccaccgggaaggacaggaagcagggcggcaggaagcccaagcccctgtggctgagccctgagaagcccctggcctggaagggccgcctgcccagtgatgatgtgattggagagggccctggagaaacagaggcccgggacaagggcctgcggcatgagcccggctggggcaccagccgctctgtgaacaccaaggagcggccccagagggccaccaccaaggtgcacagtgatgacagcgacatcttcaaccagccccccaaccgggagaggcctgccagcggccggcggggcagcaggaaggatgctggcagcagcagccatggagatgaccagcctgccagccgggaggacacctggagcagcaggacccccagccgcagccgctggaggtctgagcaggagcacaccctgcacgagagctggagcagcctgagcgcctttgacaggagccaccggggccgcatcagcaacacagagctgcccggggacatcctggatgagctgctgcagcagaagagcagccgccacagcgacctgccccccagcaagaagggggagcagcccggcctgagccggggccaggacggctacagcggggagacagatgctggaggagacttcaagatccctgtgctgccctacggccagaggctggtgattgacatcaagagcacctggggagacagacactacgtgggcctgaatggcatcgagatcttcagcagcaagggggagcctgtgcagatcagcaacatcaaggctgaccccccagacatcaacatcctgcctgcctacggcaaggacccccgggtggtgaccaacctgattgatggagtgaacagaacccaggatgacatgcacgtgtggctggcccccttcacccggggccgcagccacagcatcaccatcgacttcacccacccctgccacgtggccctgatccgcatctggaactacaacaagagccgcatccacagcttccggggcgtgaaggacatcaccatgctgctggacacccagtgcatctttgaaggagagatcgccaaggccagcggcaccctggccggggcccctgagcactttggagacaccatcctcttcaccacagatgatgacatcctggaggccatcttctacagtgatgagatgtttgacctggatgtgggcagcctggacagcctgcaggatgaggaggccatgaggcggcccagcacagcagatggagaaggagatgagcggcccttcacccaggccggcctgggcgcagatgagcgcatccctgagctggagctgcccagcagcagccctgtgccccaggtgaccaccccagagcccggcatctaccacggcatctgcctgcagctgaacttcaccgcctcctggggagacctgcactacctgggcctgaccggcctggaggtggtgggcaaggagggccaggccctgcccatccacctgcaccagatcagcgccagcccccgggacctgaatgagctgcctgagtacagtgatgacagccgggccctggacaagctgattgatggcaccaacatcaccatggaggatgagcacatgtggctgatccccttcagccctggcctggaccacgtggtgaccatccggctggacagagctgagagcattgctggcctgcgcttctggaactacaacaagagccctgaggacacctacagaggagccaagatcgtgcacgtgtccctggatggcctgtgtgtgagccccccagagggcttcctgatcaggaagggccctggcaactgccactttgattttgcccaggagatcctgtttgtggactacctgcgggcccagctgctgccccagcctgcccggcggctggacatgaggagcctggagtgtgcctccatggactatgaggcccccctgatgccctgtggcttcatcttccagttccagctgctgacctcctggggagacccctactacatcggcctgaccggcctggagctgtatgatgagcggggggagaagatccccctgtctgagaacaacattgctgccttcccagacagcgtgaacagcctggagggcgtgggcggagatgtgaggaccccagacaagctgattgaccaggtgaatgacaccagtgatggccgccacatgtggctggcccccatcctgcccggcctggtgaacagagtgtatgtgatctttgacctgcccaccaccgtgtccatgatcaagctgtggaactatgccaagaccccccaccggggcgtgaaggagtttggcctgctggtggatgacctgctggtgtacaacggcatcctggccatggtgagccacctggtgggcggcatcctgcccacctgtgagcccaccgtgccctaccacaccatcctcttcacagaagatcgggacatccgccaccaggagaagcacaccaccatcagcaaccaggccgaggaccaggatgtgcagatgatgaatgaaaaccagatcatcaccaatgccaagaggaagcagagcgtggtggaccctgccctgcggcccaagacctgcatcagcgagaaggagaccaggagaagacgctgctag

SEQ ID NO: 41106 - DNA, 3354 bp, Artificial Sequence
  Description of Artificial Sequence: Synthetic coding sequence
atgctggccggccggcccggcaccaggtctgctgtgggggagctgggcacagagagcagtgacaacctggaccgggcccccctgggcccccgggagagcggcggccaccacaggcctggcagctacctggacatgaagatccacctggagaagaacctggaggaggagcggcagatcctgctgcagcagcagaagatctgcaggaacagagccaggaagtactttgtggagagcaacagaaggaagaaggcctttgaggagaagaggaaggagcaggaggagaaggagcaccagatccgggagcagatcctgcagcagaggaagcagaagtttgaggaggtgacagagaagttccagagggcccacgtgcccctgagccagaggaggaaggctgtgtccaggaagcctgtgccccccctggaggaggccctgaagcagatccaggagagcaacctgaagtctgaggtgaacctgcccttcagccggcggcccaccatcaactggagggccattgattctgccctgcccagcgccctgagcaagaatgaccacaagcaccagaagcagctgctgagcaagatcaactgtgagaaggagatgaatgaaaacatgagggccaccctggccaccagcaagaatgtgttccagctgaagctggaggagacccagaagctgctggaggaccagcacctgagcaacctgcagaagtttggagatgaggtgaaccagatcaccaacagcgagaccctgagcagcattgacagcctggaggccacagaacatgaggagatctacctgaccctgaacaaggagcacagcaccagcatccagaggaacaccatcagcctgaagccagccaacatgcagagcaccaacctgagctgctttgatgaggacaagctggccttcagcaagacccagcacatcaacaactggctgaccaacctggatgccagcaacacccagaatgtgacagccttcagtgacatcctgagcaagagcaatgtgctgcccagctgggagtacttcaacagcaaggagcagaaccccagccccctgaatggcaccgtggagcgggccaccaacacagccaacaacagcgtgccctttgtgagcagcccccccatgtttgtgctggacaagaagtgtgagaagaccagcgagaccagcaccatgaggaccacagacagcaccagcggggccttcaagcgggagcggcccctggtgacagagagccccaccttcaagttcagcaagagccagagcaccagtgacagcctgacccaggaggtggccaccttcccagaccaggagaagtacagcgagctgaaccaggagaatggcaccaccagcatccccaccagctgtgtgcctgtggccacccccctggtgctgcccagcaacatccagagcgcccggcccagcgccaagaacagcatccacatcaaggagattgatgctgtgcagtgcagcgacaagctggatgagctgaaggatggcaaggaggaggagatcaagtacttcaactgcaacaaggaggagctgcccctcttcagtgacagcttccaggatgcctacatcccccacaacccagacagcaaggatgagaagcagaagctggccgagaccagcagcctgagcaatgtgaccagcaactatgactttgtgggccagcacaagaagatgaagtacaacatccatgaaagaaatggagtgcgcttcctgaagagcatcctgaagaaggagagcaaatatgaacatggctacctgaaggccctgatcatcaaccagagcttcaagtttggaaaccagaaggctgctgccatccgggacagcattgagctgaccaaggagaagggagctgagatccccaagaccatcaagaagctgcgctggtttgatgagaccagcaacatcgagaacaatgctgagaacagccacagcctgaagaacaagacaggcaccacccagcagcacagccagcagttccacatccagagcggggccggcagcaacatcatctctgtgtccacctgtgctgtgaacagcgctgacaccaagaagagcagagaagattccatcagtgaaaatgtgaccaccctgggcggcagcggggctgaccacatgcccctgaactgcttcatccccagcggctacaactttgccaagcacgcctggccagccagcaagaaggaggagagcaagatccctgtgcatgatgacagcaagaccaagcagggcaagccccagaggggccgggccaagatcatcaggaagccaggcagcgccaaggtgcagagcggcttcatctgcaccaacagaaaaggagctgtgatccagccccagagcgccagcaaggtgaacatcttcacccaggcccagggcaagctgatcatcccctgccccccaccccagagcaccagcaacatccgcagcggcaagaacatccaggtgtcccagtgccagcctgtgaccccagagaacccccagaacatcatcacccacaacagcttcaacagcaagcacgtgctgcccacagagcacagcctgaaccagtggaaccaggagagcagcagccccctgagcaatgcctgcagcgacctggtgaccgtcatccccagcctgcccagctactgcagcagcgagtgccagacctttgccaagatcaaccacagcaatggcacccaggccgtggcccggcaggatgccaccctgtactgcacccagaggagccctgtgtgtgaggagagctaccccagcgtgaccctgaggacagctgaggaggagagcgtgcccctgtggaagaggggccccaacgtgctgcaccagaacaagagggccaccggcagcacagtgatgaggaggaagagaattgctgagaccaagagaagaaacatcctggagcagaagaggcagaaccctggctctgtgggccagaagtacagcgagcagatcaacaactttggccagagcgtgctgctgagcagcagcgagcccaagcagaccacccggggcaccagctacatcgaggaggtgtctgacagcaccagcgagttcctgatggccgagaacctggtgaaggcctctgtgcctgaagatgagatcctgactgtgctgaacagcaagcagatccagaagagcaacctgcccctgaacaagacccagcagttcaacatctgcaccctgtctgctgaggagcagaagatcctggagagcctgaatgacctgtctgagcggctgcactacatccaggagagcatctgcaagaaccccagcatcaagaacaccctgcagatcatccccctgctggagaagcgggaggacaggaccagcagctgccgggacaagaggtag

SEQ ID NO: 41107 - DNA, 2571 bp, Artificial Sequence
  Description of Artificial Sequence: Synthetic coding sequence
atgggcaccacagccagcacagcccagcagacagtgtctgctggcaccccatttgagggcctgcagggcagcggcaccatggacagccgccacagcgtgtccatccacagcttccagagcaccagcctgcacaacagcaaggccaagagcatcatccccaacaaggtggcccctgtggtgatcacctacaactgcaaggaggagttccagatccatgatgagctgctgaaggcccactacaccctgggccgcctgagtgacaacaccccagagcactacctggtgcagggccgctacttcctggtgagagatgtgacagagaagatggatgtgctgggcaccgtgggcagctgtggggcccccaacttccggcaggtgcagggcggcctgactgtgtttggcatgggccagcccagcctgagcggcttccggcgggtgctgcagaagctgcagaaggatggccacagagaatgtgtgatcttctgtgtgcgggaggagcctgtgctcttcctgcgggcagatgaagattttgtgtcctacaccccccgggacaagcagaacctgcacgagaacctgcagggcctgggccctggggtgcgggtggagagcctggagctggccatcaggaaggagatccatgactttgcccagctgtctgagaacacctaccacgtgtaccacaacacagaggacctgtggggcgagccccatgctgtggccatccacggggaggatgacctgcacgtgacagaggaggtgtacaagaggcccctcttcctgcagcccacctaccgctaccaccggctgcccctgcctgagcagggcagccccctggaggcccagctggatgcctttgtgtctgtgctgcgggagacccccagcctgctgcagctgagagatgcccacggccccccaccagccctggtgttcagctgccagatgggcgtgggccgcaccaacctgggcatggtgctgggcaccctcatcctgctgcacaggagcggcaccaccagccagcctgaggccgcccccacccaggccaagcccctgcccatggagcagttccaggtgatccagagcttcctgaggatggtgccccagggccgcaggatggtggaggaggtggaccgggccatcacagcctgtgccgagctgcatgacctgaaggaggtggtgctggagaaccagaagaagctggagggcatccggcctgagagccctgcccagggcagcggcagccgccacagcgtgtggcagagggccctgtggagcctggagcgctacttctacctgatcctcttcaactactacctgcacgagcagtaccccctggcctttgccctgtccttcagccgctggctgtgtgcccaccctgagctgtaccgcctgcctgtgaccctgagcagcgctggccctgtggccccccgggacctgattgcccggggcagcctgcgggaggatgacctggtgtccccagatgccctgagcacagtgcgggagatggatgtggccaacttcagaagagtgcccaggatgcccatctatggaacagcccagcccagcgccaaggccctgggcagcatcctggcctacctgacagatgccaagaggcggctgaggaaggtggtgtgggtgtccctgcgggaggaggccgtgctggagtgtgatggccacacctacagcctgcgctggccaggcccccctgtggccccagaccagctggagaccctggaggcccagctgaaggcccacctgtctgagcccccacctgggaaggagggccccctgacctaccgcttccagacctgcctgaccatgcaggaggtgttcagccagcaccggcgggcctgccccggcctgacctaccaccgcatccccatgccagacttctgtgccccccgggaggaggactttgaccagctgctggaggccctgcgggccgccctgagcaaggaccccggcactggatttgtgttcagctgcctgagcggccagggccgcaccaccacagccatggtggtggccgtgctggccttctggcacatccagggcttccctgaggtgggggaggaggagctggtgtctgtgcctgatgccaagttcaccaagggggagttccaggtggtgatgaaggtggtgcagctgctgcctgatggccaccgggtgaagaaggaggtggatgctgccctggacacagtgtctgagaccatgacccccatgcactaccacctgcgggagatcatcatctgcacctaccggcaggccaaggccgccaaggaggcccaggagatgaggcggctgcagctgcggagcctgcagtacctggagcgctacgtgtgcctgatcctcttcaatgcctacctgcacctggagaaggctgacagctggcagaggcccttcagcacctggatgcaggaggtggccagcaaggccggcatctatgagatcctgaatgagctgggcttccctgagctggagagcggggaggaccagcccttcagccggctgcgctaccgctggcaggagcagagctgcagcctggagcccagcgcccctgaggacctgctgtag

SEQ ID NO: 41108 - DNA, 1230 bp, Artificial Sequence
  Description of Artificial Sequence: Synthetic coding sequence
atgagcctgcacgcctgggagtgggaggaggaccctgccagcattgagcccatcagcagcatcaccagcttctaccagagcaccagtgaatgtgatgtggaggagcacctgaaggccaaggcccgggcccaggagagtgacagcgaccggccctgcagcagcattgagagcagcagcgagcccgccagcaccttcagcagtgatgtgccccacgtggtgccctgcaagttcaccatcagcctggccttccctgtgaacatgggccagaagggcaagtatgccagcctgattgagaagtacaagaagcaccccaagacagacagctctgtgaccaagatgaggcgcttctaccacatcgagtacttcctgctgcctgatgatgaggagcccaagaaggtggacatcctgctcttccccatggtggccaaggtgttcctggagagcggcgtgaagacagtgaagccctggcatgaaggagacaaggcctgggtgtcctgggagcagaccttcaacatcaccgtgaccaaggagctgctgaagaagatcaacttccacaagatcaccctgcggctgtggaacaccaaggacaagatgagcaggaaggtgcgctactaccgcctgaagacagctggcttcacagatgatgtgggcgccttccacaagtctgaggtgcgccacctggtgctgaaccagaggaagctgtctgagcagggcatcgagaacaccaacatcgtgcgggaggagagcaaccaggagcaccccccaggcaagcaggagaagacagagaagcaccccaagagcctgcagggcagccaccaggccgagcctgagaccagcagcaagaacagcgaggagtatgagaagagcctgaagatggatgacagcagcaccatccagtggagcgtgtccaggacccccaccatcagcctggccggggcctccatgatggagatcaaggagctgattgagagcgagagcctgagcagcctgaccaacatcctggaccggcagaggagccagatcaagggcaaggacagcgagggccgcaggaagatccagaggaggcacaagaagcccctggccgaggaggaggccgaccccaccctgaccggccccaggaagcagagcgccttcagcatccagctggccgtgatgcccctgctggccggcacccactgcctgccctgcagccagcagctgctgctggtgctgtggccagagcggccctag

SEQ ID NO: 41109 - DNA, 3603 bp, Artificial Sequence
  Description of Artificial Sequence: Synthetic coding sequence
atggacccccccagcctggacacagccatccagcacgccctggccggcctgtaccccccatttgaggccacagcccccaccgtgctgggccaggtgttccggctgctggacagcggcttccagggagatggcctgtccttcctgctggacttcctgatcccagccaagaggctgtgtgagcaggtgcgggaggccgcctgtgccccctacagccactgcctcttcctgcacgagggctggcccctgtgcctgagagatgaggtggtggtgcacctggcccccctgaaccccctgctgctgcggcagggcgacttctacctgcaggtggagccccaggaggagcagagcgtgtgcatcatgatcaagtgcctgagcctggacctgtgcaccgtggacaagaagcctgtgcctgagcccgcctaccccatcctcttcacccaggagtggctggaggccatcaacagcgactttgagggcaaccccctgcacaactgcctggtggcctctgaaaatggaattgcccctgtgccctggaccaagatcaccagccctgagtttgtggatgaccggccccaggtggtgaatgccctgtgccaggcctggggccccctgcccctggaggccctggacctgagcagcccccaggagctgcaccaggccagcagcccagacaaccaggtgctgcctgcccagagcctggccaagggcaaaggaagaacctacggcagcaagtacccaggcctcatcaaggtggagcaggcccgctgtggggaggtggccttcaggatggatgaggtggtgtcccaggactttgaaggagactatgtggccctgctgggcttcagccaggagagcagaggagagagccccagccgggaggccggcaccagcagcggctgcaccagcggggccctggaggagattgctggcaccaaggagacccccctcttccagaagatcctgcccctgtctgaggccaatgaaggccccagcctgggcaacagagcctgcaccaagccagagagcagcgaggagcggccctacaacctgggcttccggaggaaggtgaacctgaaggcccccacccacaacagcgagcggcccccccagggcagctacatgaatgtgctggaggatgccctggactgtgccagcggcctgcgggccggcgtgtcccaggagcctgctgccagcaagatgcagggccccctgggcaaccctgagaacatggtgcagctgcggcccggcccccggcaggccagcagcccccggctgagccctgccagccctgctgctgctgccagcgagaccaagattgaggtgaagaccaaggagagaaatggccgcctgcccaagcccatgccctgccccagcaggaacaccagcagccctgagccccccaccccaggcctgaagttctccttcctgcggggccagaggcagcccagcgtgaccccagagaaggccagcctgcagcacaacggcccctggaaggtgctgtgcagcctgtacagccccaagcccaacagagccaagagcctgggcaaggccggcaccacccagaccaagaccagcggccctgccacagcccccagccccctgacagaggagaaggccgccctgcctgaggccagcgctggcagccctgagcggggccccaccctggaggaggagcccccaggccctgagccccgcatcggggccctgggcgtgaaggtgttccgcagccgcatcgcctgcctgcccggcggccgggaccgggccggccggcccctgctgctggtgtccaccacagagggcgcctgggaggccccctggtgcaccgtgtctgaggtgaccaagctgctgagctacctgtgcaccatccccaggcctgaggacaaggccaagggcctggccgtgctgattgatgcccggcggcagcccccccagcccggcctggtgtctgccctgcaggccacccaggcccaggtgcctgccagcatccgggccatcctcttcctgggggagaaggaggccgccctgcagctgcagaccctgcctgatgtgcaggtggaggtgctgaccagcctgaaggccctgagccaccacgtggaccccagccagctgcctgctgtgctggagggccccttcccctactgccacacagagtgggtgcacttcttccagaagctggaccccttcctggccgacctgcaccaggccagcagcctgctgcaggccagcattgaggagtttgagaaggctgaccccccaggcggcatgcaggaggccacccgctgcctgagcaagagcaaggagctgatggaggccgtgctgcgggaccccggcctgctgggcctgcagcgggagggcggggccaccctggcccggctgcagcatgatgccagccggctggacttctccccagatgtgcgcagccacctggccgccgccacagccctgtacagcctggtggatgagcagctgcacgtgctggtgacagccagcaacagcctgctgggcaagctggagctgcgggtgcggctgggccgcctggaggccgccatccaccaggtgtctgactggatggagcaggagggccgccgctgcctgcagagcctgacccccaaggatggcagcctggagaccgtggagaaggcccatgctgagtttgagaacttcttcctgcaggccgccgcccagtacagaagaggcctggagctgagcaagcaggccgcccagctgggcgccacagcccggggggccggggaggccgagcgggcagagttccctgagctggccgcctttgccagcacccagagggccttccaggccgagctgacccacttctacatggctgctgagcggcagaggacagacctggagaccctgctgcacctgcaccgcttctgcaagaggatgacctggttccacatggactgccaggacctgatggcccagctgcggctggacaagaccagccgggtgtcccctggggaccagaggcggctgcaccgctacctgcagaggctggccagcgagttccctgctgagaagctggccgctgtgggcctgcaggtggccagcctgagcagagctggcctgggccaggagctgtgggaggaggcccgcatcagacatgaggagatccgcatgctgctggagaaggccctgacccacagcagctgcccagaggccccagctgcccacagcgcccggcctgagcggcggggcgtggccgccaagggccagggcgtgtctgtggaggtgaccagcaagggccgctgggaccagccccccctggacagcctgggcatggaccacctgcccaagagctactggcccccaggccccccaagaggagagcagaacagaaccttccaggccggcagccccccccaggaggccggccaggccgctgaggctgaagatggcaagggcagccacaagctgcctgaccctgcccgggagcacctgctggccaccaccttcttccggcagcagcccccccggcagagccaggtgccccggctgactggaggcagcttcagcagcgagggcacagacagccagaccagcctggaggacagcccccagaccagccccctggccagcctgtag

SEQ ID NO: 41110 - DNA, 1734 bp, Artificial Sequence
  Description of Artificial Sequence: Synthetic coding sequence
atggctgatgtggccggccccagccggcccagcgctgctgccttctggagccgggacttcagtgatgaggagcagagcgtggtgtatgtgcccggcatctctgctgagggcaatgtgcgcagccgccacaagctgatgagccccaaggcagatgtgaagctgaagaccagccgggtgacagatgccagcatctccatggagagcctgaagggcaccggggacagcgtggatgagcagaacagctgccgcggggagatcaagagcgccagcctgaaggacctgtgcctggaggacaagaggcgcatcgccaacctgatcaaggagctggcccgggtgtctgaggagaaggaggtgacagaggagcggctgaaggccgagcaggagagctttgagaagaagatccggcagctggaggagcagaatgaactcatcatcaaggagcgggaggccctgcagctgcagtaccgggagtgccaggagctgctgagcctgtaccagaagtacctgtctgagcagcaggagaagctgaccatgagcctgtctgagctgggcgccgccaggatgcaggagcagcaggtgagcagcaggaagagcaccctgcagtgcagctctgtggagctggatggcagctacctgagcatcgcccggccccagacctactaccagaccaagcagaggcccaagtctgctgtgcaggacagcgccagcgagagcctcatcgccttcaggaacaacagcctgaagcctgtgaccctgcaccaccccaaggatgacctggacaagatccccagcgagaccaccacctgcaactgtgagagccctggcaggaagccagctgtgcccacagagaagatgccccaggaggagctgcacatgaaggagtgcccccacctgaagcccacccccagccagtgctgcggccaccggctggccgctgacagagtgcatgacagccaccccaccaacatgaccccccagcaccccaagacccaccctgagagctgcagctactgccgcctgtcctgggccagcctggtgcatggaggaggagccctgcagcccatcgagaccctgaagaagcagatcagcgaggacaggaagcagcagctgatgctgcagaagatggagctggagattgagaaggagcggctgcagcacctgctggcccagcaggagaccaagctgctgctgaagcagcagcagctgcaccagagccggctggactacaactgcctgctgaagagcaactgtgatggctggctgctgggcaccagcagcagcatcaagaagcaccaggacccccccaacagcggagaaaataggaaggagaggaagacagtgggcttccacagccacatgaaggatgatgcccagtggagctgccagaagaaggacacctgccggccccagaggggcaccgtgactggagtgaggaaggatgccagcaccagccccatgcccaccggcagcctgaaggactttgtgaccacagccagccccagcctgcagcacaccaccagccgctatgagaccagcctgctggacctggtgcagagcctgagccccaacagcgcccccaagccccagcgctaccccagccgggaggccggggcctggaaccacggcaccttccggctgagccccctgaagagcaccaggaagaagatgggcatgcacaggaccccagaggagctggaggagaaccagatcctggaggacatcttcttcatctag

SEQ ID NO: 41111 - DNA, 1416 bp, Artificial Sequence
  Description of Artificial Sequence: Synthetic coding sequence
atggtgctggacagcggggcccaggcctatgaccaggccccacccagcccccccaccagcccccccagcctgcggcaccggctgaagcccagcgacagagatggcccccccctgtacccctggagccagagcctggccctgcccctggccctggccgtgcccccagccctgcagccccagcctgagcagcagcccttcagccagatgctgctgggccaccggggccacatgagaagaagtgagagcacctacagcgtgaacagcactggaagaagaggccggggcaccctgggccggcccccacctggccggggcaggaaccctgggggcggcaccctgcggcctgctgccagcctgccccacatcgccaagacccagagagatgctggccacatcgccagcaagagcccctgcatgctggtggccctgcggcccaccaacatggaccgggagcgggacaagttcttccagagccactacacctacaacccccagtttgagtaccaggagcccatgcccacagctgtgctggagaagtactgtgaggccagcggccagttcatccaccaggccgtgggcatcattgaagctgtgctggagaagtttggcacctatgagcactttgaggccgccaccggcggccagctgctgaccaagtgccagatctggagcatcgtgaggaagtacatgcagaaggagggctgtgccggggaggtggtggtgcagctgtctgaggacctgctgagccaggccgtgatgatggtggagaacagccggcccaccctggccatcaacctgactggagcccggcagtactggctggagggcatgctgcggcatgagatcggcacccactacctgcggggcgtgaacaatgcccggcagccctggcacaatgctgagggccgcctgcgctatggcctgcggcctgccaaccccacagaggagggcctggccagcctgcacagcgtgctcttcaggaagcagcccttcctgtggagggctgccctgctgtactacaccatccacagagctgccaggatgtccttccggcagctgttccaggacctggagcgctacgtgcaggatgctgatgtgcgctgggagtactgtgtgcgggccaagaggggccagacagacaccagcctgcccggctgcttcagcaaggaccaggtgtacctggatggcatcgtgcgcatcctgcggcaccggcagaccatcgacttccccctgctgaccagcctgggcaaggtgtcctatgaagatgtggaccacctgcggccccatggagtgctggacaacaccagggtgccccacttcatgcaggacctggcccgctaccggcagcagctggagcacatcatggccaccaaccggctggatgaagctgagctgggccgcctgctgcctgactag

SEQ ID NO: 41112 - DNA, 432 bp, Artificial Sequence
  Description of Artificial Sequence: Synthetic coding sequence
atggtggtgtttgtgggccgccgcctgcctgccctgctgggcctcttcaagaagaagggcagcgccaaggcagaaaatgacaagcacctgtctgtgggccctggccagggccctggcagcgctgtggatgagcaccaggacaacgtgttcttccccagcggccggcccccccacctggaggagctgcacacccaggcccaggagggcctgcggagcctgcagcaccaggagaagcagaagctgaacaagggcggctgggaccacggggacacccagagcatccagagcagcaggactggaccagatgaggacaacatctccttctgcagccagaccaccagctatgtggccgagagcagcacagcagaagatgccctgagcatccgctctgagatgatccagaggaaggacagccagaaggagctggcctag

SEQ ID NO: 41113 - DNA, 2124 bp, Artificial Sequence
  Description of Artificial Sequence: Synthetic coding sequence
atgagccggggctacagcgagaacaacaacttcctgaacaacaacaaccagatggtgctggacatgatcctgtaccccctcatcggcatcccccagaccatcaactgggagaccatcgcccggctggtgcccggcctgacccccaaggaatgtgccaagagatttgatgagctgaagagcagcggcagcagccctgtggacaaccagtacaacagcctgatggccgccggggagagccctgtggagaccctggccacctacatcaagagcagcctgctggacatccacggggagttccaggagacccctgtgggccatgatgctgtgtccaagacaggccgccacagcatcgccagcaccaggaactgcagcagcgagagcgagaactgcaccacccacaacggcggggagatgacagaggagagcgagggccccaacatggtgatccacgtgtgtgatgaggccaagaacctgaaggaggacttcacctgcccccgggacctgctgatcagcgagatgaagtactttgctgagtacctgtccatggatgcccagcgctgggaggaggtggacatctctgtgcactgtgatgtgcacatcttcaactggctgatcaagtacatcaagaggaacaccaaggagaacaaggactgtgagatgcccaccctggagcctggaaatgtcatcagcatcctgatcagcagcgagttcctgaagatggacagcctggtggagcagtgcatccagtactgccacaagaacatgaatgccatcgtggccaccccctgcaacatgaactgcatcaatgccaacctgctgaccagaattgctgacctcttcagccacaatgaggtggatgacctgaaggacaagaaggacaagttcaagagcaagctgttctgcaagaagattgaaagactctttgatcctgagtacctgaacccagacagccgcagcaatgctgccaccctgtaccgctgctgcctgtgcaagaagctgctgaccaaggagacagagcggcgcatcccctgcatccctgggaagatcaacgtggacagaagaggcaacatcgtgtacatccacatccgggacaagacctgggatgtgcatgagtacctgaacagcctgtttgaggagctgaagtcctggagagatgtgtactggaggctgtggggcaccatcaactggctgacctgcagccgctgctaccaggccttcctgtgcatcgagttcagccactgccagtaccacagcgagaccgtggtgtaccccacagctgccagcagcctgaacacagtgggcaccggcatctacccctgctgcaaccagaaggtgctgcgctttgaccccacccagctgaccaagggctgcaaggtgcgggaccacatggtgaccctgcgggaccagggcgagggcggggacctgcccagctgccccacagccaggatgctggatgacctgcacaagtacagagatgtgattgtggtgcccttcagcaaggacacagtgtctgatgtgggcgtgggcctgtgtgatgagaagggcattgaatgtgatgtgctgctggagcccaacaccccctggggccccaagacaggagagctgaatgccttcctgagcctgaagaactggaccctgcagctgaagcagcagagcctcttcagcgaggaggaggagtacaccaccggcagcgaggtgacagaagatgaggtgggagatgaggaggaggtgtccaagaagcagaggaagaaggagaagcccaagaagttcacccggcagcccaagaagcaggtgagcagcccctgtgcccagaggaaggagaaggccctggagaagagcgccagcagagatgtgagcccctttgtgatgtccatgcagaagaacaagtgggatgccaccaggagcctgcgcttcaaccaggatgcccagagagaagatgaccagaggaggatgacagagatcaccggccacctgatcaagatgaggctgggggacctggacagagtgaagagcaaggaggccaaggagacagacaagctgcggcccagagatggcaccgtgtccaagagcaacaggaagagcggcctgagctctgtgctgctgatgacagtgctgctgtgctag

SEQ ID NO: 41114 - DNA, 2811 bp, Artificial Sequence
  Description of Artificial Sequence: Synthetic coding sequence
atgctgctggccccccagggccgctccttcagcaagaagaggatgggcctgaaccgctggaagcgcttcaccaggaagcccagccccaagcccacctttggaccagattctgtggagcactggatcaagagggtggagaaggccagcgagtttgctgtgtccaatgccttcttcaccaggaacagcgacctgcccaggagcccctggggccagatcacagacctgaagaccagcgagcagatcgaggaccatgatgagatctatgcagaggcccaggagctggtgaatgactggctggacaccaagctgaagcaggagctggccagcgaggaggagggagatgccaagaacacagtgtcctctgtgaccatcatgcctgaggccaacggccacctgaagtatgacaagtttgatgacctgtgtggctacctggaggaggaggaggagagcaccaccgtgcagaagttcatcgaccacctgctgcacaagaatgtggtggacagcgccatgatggaggacctgggcaggaaggagaaccaggacaagaagcagcagaaggacccccggctgaccatggagatgaggcacaagcaggtgaaggaaaatcggctgcggcgggagaaggagctggagtaccagagaattgagaagaccctgaagaagagcgccttcctggaggcccagtgcctggtgcaggaggagaagaagaggaaggccctggaggccaagaaggaggaggaggagatccagcgggagatggtgaagctgcggcgggagatcattgaaagaagaagaacagtgaaggccgcctggaagattgagaagaagaggcaggaggagaacagccagaacagcagcgagaaggtgatgttccagagcacccacatcctgcctgatgaggagaagatggtgaaggagaggaagaggaagctgaaggaggtgctgatccagaccttcaaggagaaccagcagtgccagaagcgctactttgctgcctggcacaagctgatcctggaccaccgcatcaagctgggcaaggccggcaccctgagtgactggaagatccagctgaaggtgctgcgggcctggagggactacacccgcttccagaagctggagcgggagacccaggccctggagaatgacctgcgggaggagaacaggaagcagcagctggccacagagtacaacaggaagcaggtgctgcggcactgcttcacagagtggcagcactggcatggagctgagctgctgaagcgggagctggccctgaccaaggaggagaccaggaagaagatggatgccctgctgcaggccgccagcctgggcaagctgagcgccaacggcctgagcggcatcagcctgcctgaggaggccacagccatggtgggcccccctgtgaagaatggccaggagacagctgtgccccccctgtgggagaagccacccctgggcagcagcggctgcatgctgagcccccccctgggccgcaccaccaccggcaacctgcagggcagcctgcagaatgtgtccctgagcgcccctggcaacaagcagcacaagaccctgggcgctgagcccagccagcagcccggcagcaatgagaccctgcggaccaccagccagaaggccgagcccctgtgcctgggccacttccacaacagacatgtgttccagcagcagctgattgagaagcagaagaagaagctgcaggagcagcagaagaccatcctggagctgaagaagaacctgcagctggccgaggcccagtgggccgctgagcacgccctggccgtgacagaggcccagagccacctgctgagcaagccccgggaggaggagcccaggacctgccagatgctggtgaacagccctgtggccagccctggaacagagggccgcagtgacagcaggaacagcctgagcggcctgcggaggaagcccaagcagctgatgaccccccaccccatcctgaaggccatggaggagcgggccatccagagagctgagtgccgccgcatcctggccgagaagaagaagaagcaggaggaggagaagctggcccagctgaaggcccaggaggaggagcggcagaagcgggaggccgaggagaaggaggcccagctggagaggaagcgggaggagaagaggctgaagaagatgaaggagctggagaagcagaagaggatcaagaggaaccagcagctggaggccatcgccaaggagcactatgaaagagtgctgctgaggaagaagggcctggagccctggaagaggctgaggatgcagagcaagcagaacatccaggtggccgaggagcactacagcctcttcctgcagaggaagtacatgctgacctggttccagaggagccaggagagcctggccaggaagatggcccaggccgaccagttctacagccagatcctgctgaagagggtcatccagagctggctgcagtatgtgattgacctgcaggaggaggtgaggaagttctgtgtgcacttcctgcagaagaagatcttccgggcctggttcaacatggtgcgggaggtgaagattgacagccagggcaagcatgaaattgctgctgagcacagcgaccggcgcatcctgtggatcaccctgcggacctggaagaagtttgtgaagttcatgaaggaggagcgggtgaaggaggagcggcggcagcagctgcggaggaaggtggtggagatcctgcctgacttccaggtgcccggccgctaccacgagctgtaccagcagagcgacacctggagcctgagcaagaccagcctggtgaatgaatag

SEQ ID NO: 41115 - DNA, 465 bp, Artificial Sequence
  Description of Artificial Sequence: Synthetic coding sequence
atgagcaagaggaaccaggtgtcctatgtgcggcctgctgagcccgccttcctggcccgcttcaaggagcgggtgggctaccgggagggccccaccgtggagaccaagaggatccagccccagcccccagatgaagatggagaccacagcgacaaggaggatgagcagccccaggtggtggtgctgaagaagggggacctgtctgtggaggaggtgatgaagatcaaggccgagatcaaggccgccaaggcagatgaggagcccaccccagcagatggccgcatcatctacaggaagcctgtgaagcaccccagtgatgagaagtacagcggcctgacagccagcagcaagaagaagaagcccaatgaagatgaggtgaaccaggacagcgtgaagaagaacagccagaagcagatcaagaacagcagcctgctgagctttgacaatgaagatgaaaatgaatag

SEQ ID NO: 41116 - DNA, 495 bp, Artificial Sequence
  Description of Artificial Sequence: Synthetic coding sequence
atggatgaggaggtgtctgaccccaccagcgctgctgcccagctgcggcagctgcgggaccacctgcccccacccagcagcgccagccccagccgggccctgcctgagccccaggaggcccagaagctggccgctgagcgggcccgggcccctgtggtgccctatggagtggacctgcactactggggccaggagctgcccacagctgggaagatcgtgaagagtgacagccagcaccgcttctggaagcccagcgaggtggaggaggaggtggtgaatgctgacatcagcgagatgctgcggagccgccacatcacctttgctgggaagtttgagcctgtgcagcactggtgccgggcccccaggccagatggccgcctgtgtgagcggcaggaccggctgaagaccttccacagctgcccccggcccagcggcagccggggcggcacagagcccagcccccggccctgtggcagccaggatgccctgctgtag

SEQ ID NO: 41117 - DNA, 6801 bp, Artificial Sequence
  Description of Artificial Sequence: Synthetic coding sequence
atgatgcctggagagacccacagcgctgcccctggaacagctgctgacctgagccgctgccagggctgtgccagcctgcagcagaacctgaatgaatatgtggaggccctgatcaccctgaagcagaagatcatcaacacagacaacctgctgacagagtaccagaagaagtgtgatgagctgcagtttgcccggcgggagaacagcaacctgcaccaccaggtggaggagatgctgcagaagatcagccccctgcagaagtgccaggaggagctgggcagcctgaaggccgagctggaggagaagaagagcagcctgaagctgtaccaggacacccaccaggagtatgcccgggtgaaggaggagtgcctgaagagtgatgcccagaagaagaagctggaggccaaggtgaagaagctgcaggaggccgctgtgaagcagacccaggacttcaagcagctgagaaatgagaagaagatcctggagaaggagttcaagaagacccaggagcggctggatgagttcagcaagcagaagaatgagaaggagctgcggcacatcggcacccagatcagcagtgacagctatggcagcattgacaagaggaaggtgaagctgctgctgaaggagctgtggctgtgtgtgaacaccacccaccggctgcccggggagggcagccgctgtgtgcctgagaagccagccaaggccatcaccagcagccgggtgcctggagaagatggcaccctgccccccacccagggcagccccctgcggaccagcaatgtgcagacctgcctgaccaagctgtccatggagatcaaggaggacttcctgtgccagaatgtggagaagcagagcagcagcggcaccaactgcagcagtgaccacgtgttcaatgaaaatggaaacctggaggtgctggtgcagagccacagagatggcggcagcacagaatttgtggaccatgaccacttctttgatgaggacctgcaggccgccatcgacttcttcaagctgcccccacccctgctgagccctgtgcccagccccccacccatgagcagcccccaccctggcagcctgcccagcagctttgcccctgagacctactttggagagtacacagacagcagtgacaatgacagcgtgcagctgaggaacagcgcagaatgtgtgtctgaagatgacaccacagagagccagaactacttcggcagcctgaggaagaacaagggcagcggcacctgggaggagaagcccaagagccatgaggccatccaggccctgaacacctgggaggtgaacaaggtgaccaccagcggcctggagaccttcaccgccaccctgcgggagagcagcgccacccacagcctggtgggggagaagcactggaccacagccagccgctccatgtctgacaggaagagggacatcctgcacgagaccaagacccagatggaggtgcgggagatggacaagtctgtgcagacagagaagaccatccacaagctgacccggggcctgtgcatcgagcggctgagcgccagccctgcccaggagaaggaggccgcccctgggaagtctgagctgtgcagcagccccctgggcaagaggcccctgaatgagctgatggagagcgagggcaagacagtgctgagcaagatgatgggcagccccaagtctgagttcaccaagtggacccgcatcaatgagatcaccagcgagccagaccgcatcaccgtgtctggccacttccaccggctgagccgggagctggagaaggagaaggaggacacccagggcttcaccctgggggagagccctgagagtgaagatgatgattctggagatggcatggatgtggccggcctggacatcgagaccagcttcagcagcagcagcaccctggtggccctgtctgtgggcagcaacccccagagcagcagcggcctggactgtggaaatgacacagacatcaccaccaaggtgttcagcacagagccccaccacagcgagcacaagctgcagaccaagaccctgaacaccctgcacctgcagagcgagcccccagaatgttccatcggcggcaacaacctggagaacagcctgtgtgccctgagccctgagctgggcgccagcaacttcaatgaccagaagagcagcggcatcgagtacaccaaggtggtgaagggcctgaccaagatccacagcctgcccaggtctgtgttcatgaaggccaccaaggatggccagtgtgagagccaggaccccagaattgagctgaccctgaacaagccagacttcaccagcctcatcggcagccaggccgccctgatcaagagcggcctgggctttgtgaagagcacctcctggcaccacagcgacctgctgaggaaaggaggagaggagagcctgcgggccaagtcagaacatgagcagaagaccagccaccagctgcagaaggccatgcccttcctgcagaacagaggccccacccccaagccagacctgctgcgggagaacaacaaccctgtggagttcaagaccacagcctctgtgctgcccaaccaggtgtctgtcatcaccaagcagaccaggcctgagaaggtgcagagcgccaagctggagcacctgcggccccaccgggtggagcccaccctggtgacagagaacagcggcaacaagacaggcatgagcacagtggccaagtgtgatggagagagagatgacaccacccagaacatcacagaggtggccgctgtgaagagcatcagccctgaggtgtctgccagcaggaggaagctggacttcaacagccctgggggcagcagccctgtggagaacagcgactgcagcaccaacagccggctgtccttcagccctgagaacatcctgatccagaaccaggacatcgtgcgggaggccgctgtgcagggagatggccagaagcagaggcagccccaggccacagacctggacagcagcggcacccacggcagcgagatgctgcctgccacagaggtgacagtgtctgggggcttctctgtggaggagaccagctgtggggacaccggccgctctggaggagaggccctggccgtggccaatgacagcaccagcaccccccagaatgccaacggcctgtggaagctgaagagcaccacccctgggggcgccctgcctgagtgcttcggcaccacagacaccaccttcagcagcgccttctgcaggaagcatggagagacccaggacaccagccagagcagcctgcccggcaccctgcactgctacacaggcatccgggagggcggagatgacacagaggtggagagcgaggccttcagctgcagcgagggcagcgagcagcaggatgccccagatgacagccagaagaacctgggggacacagatgctgctgtggccgaggtgcggcccagcctggaggtgggctacctgaccagcgccctgcaggacttcaacatcagcaccttcagcgagctggaccggctgagcaccagcgaggtggtgatgttcctggagagctgccagctgggggactacagcagcggggacagcgtgtctgaatgtagcagcaagggcaccctgagcaaggagatgaacaaggagctgaaggccagcgagattggagagaagtacaggaagcagccctgtgaggaggagaccctgggcacctgtgaggagtggattgagagcgaggaggatgactacagcctgaagaacaccagccagctgacccagtgcagcctggagaccctgtctgaggtgctgaccaagatccggcaggagctgcagaccaacagcgaggactgcaatggcaaggacaccggcagcctgctgctgctgaatgtgaacaacaacatgaccacagagaacctgaaggagaagagccccttccgggagaccaccggcagcagcagccacgccagcgagcccaccccccaggccgccgccctggacacagagggcagcagccccatcagcggcatgccccagaatgaaaacccccagagcaggcctgaggcccggagtgatgctggccggcagacagatggaggagaggaggacctgcctgagcctgtggagcccagcgccctgtgcagcgacagcgtgatggagcccagcattgagcagagcagcaactgtgaggccgagaccaccttccagtgccagatcgccaccgtgaccagcgaggtgatcaacgtgctgatcaacaaggaccagaacctggtgattgagaagggggacaactggaccatcatcagcggcgtggccgtgctgccccacgtggaccaggtgaccctgtgtgacatccctggggacatccccatcagccaggaccagggcgagctggaggccggctgcatccctgtgaccagcgctgagaagagccctgaggccagccacacaggccctgccttccaggaggccccctgtggcaacaacctgagctgcccccaggaggatgtgagcagcagcggccagagcaccaactttgacaagagccggctgaggaacagacctgtgaagcccagcatctggatcagcagccagatctatgaccagaactttgagacccagatcgtggccagtgaccacacctactacaacagcaagctggagcccagcggcaagaacaagaacagaagcaagatcagcaacaaggaccagagcaacaagcctgtgaagaccagcgccagcagccgggtggagacccaccagagcgaggtggcccagagcttcagcggggagaaggccaacaccaagacccagaggagccagacccagaccatcctggccaatgctgacaccagcacccccacagactgcagcccagacaccctgagcaagatccggcaggaggtgggcccccccctgccccccctgctggcccccctcatcgccaccccacccaggaccagccagcccctgagccccctcatcagcagcagcagccccagcagccctgccagccctgtgggccaggtgagccccttccgggagacccctgtgcccccagccatgagcccctggccagaggacccccggcgggccagccccccagaccccagccccagccccagcgctgccagcgccagcgagcgggtggtgcccagccccctgcagttctgtgccgccacccccaagcacgccctgcctgtgcccggccgcctgcccccctgtgccagcggccatgctgctgtgggcggcccccaggagaacagcgtgaagatcctggacaccatgtacccagagctgagcgcccgggcccggaccctgaacatcctgaagggcaacatccagctgacccggggccccccagctgactgcaagaacctgcccggccctgccagcgccatgattggcttcaagaccatcaccagcgctgccacagcctttgtgaagacaggcagcagcagtggaggagactgcaaccaggacaagagccgggacctgggcacccagcaggacagcagcggcaagaggaccctgagcaccagcaccctgcggagcgccaagaggctgcggctggacaccggcagccctgagcctgagacccggggcgtgacagctgagggcatccacaagaacctgcccggcaacctgcccccagctgaggtggccaccaccaatgaggagaggagctgcagcagccctgctgtgtctgctgtgtcccagctgcccctgagccccaaggagaccgtggagagccatgacaaggccatcgccaatgccctgaagaagattgctgagttctcctttgacctgctgcctgtgatccgcagccacgtgtatgtgggcaacatcagcaagaagcctgtgatgagggaccaggagaaggaggtggtgtatgagttcagcaccaccaagaagcacctggccgagtgcctgctgcacagcatcctgtctgagctgaagatccagaagatctccatggaccacaactacatccacgccctgtgccgggtgtatgtgggcatctgccggcagctgggggacctggagcgggcccggctcttctgctacagcctgctgaaggaggacttccctgagagcgagaagctgaccctcttcatcgccaacatgtggcatgacatcttcctgagccagagcgtcatcaacaaggccatgcagctggtggcccggcagagggccaagggggaggtgctgaactgcctgcgggccttcctgaactgggagaagaatgcccctgtggatgtgggcttcatggtgtccaagctgctgctgaccatccagctgtgccccaagacagagttccagcccagcgagaagtttggagaggacctgagtgacaacacctgggagtacatctttgccatcgacctgctgtgctgccaccagaagtggatctggacccatgacaacatcatcagcaaggagctgtggcctgtgatggacaagtggatcaagtacagaaaaggacatgccaacatcgcctacaccccagacatcatcatcgccagcatcctgcggctgattggccgcctgggccagctgggcctgaaggagggcttccccagcgctgtgaagaacatcagcagcgtcatcggcatgttcatccagcacgcccatgatgaggacatcccctggggcatccagctggccgctgtgtatgccctgtgtgacctgagccccagcaacccagctgagatcagcaagatcctggaggcctggaggcgggaggccagcaagtctgtgcccagcgccatcgtgtcctgcctggaggaggtgtctgccctgagcacagaggagctgggctag

SEQ ID NO: 41118 - DNA, 1362 bp, Artificial Sequence
  Description of Artificial Sequence: Synthetic coding sequence
atggaccagtttggagacatcctggagggggaggtggaccacagcttctttgacagcgactttgaggagggcaagaagtgtgagaccaacagcgtgtttgacaagcagaatgatgaccccaaggagagaattgacaaggacaccaagaatgtgaacagcaacacaggcatgcagaccacagagaactacctgacagagaagggaaatgaaagaaatgtgaagttccccccagagcaccctgtggagaatgatgtgacccagacagtgtcctccttcagcctgcctgccagcagccgcagcaagaagctgtgtgatgtgaccaccggcctgaagatccacgtgtccatccccaaccgcatccccaagatcgtgaaggagggggaggatgactactacacagatggagaggagagcagtgatgatggcaagaagtaccacgtgaagagcaagagcgccaagcccagcaccaacgtgaagaagagcatcaggaagaagtactgcaaggtgagcagcagcagcagcagcagcctgagcagcagcagcagcggcagcggcacagactgcctggatgctggcagtgacagccacctgagtgacagcagccccagcagcaagagcagcaagaagcacgtgtctggcatcaccctgctgagccccaagcacaagtacaagagcggcatcaagagcacagagacccagcccagcagcaccacccccaagtgtggccactacccagaggagagtgaagatactgtgacagatgtgagccccctgagcaccccagacatcagccccctgcagagctttgagctgggcatcgccaatgaccagaaggtgaagatcaagaagcaggagaatgtgtcccaggagatctatgaagatgtggaggacctgaagaacaacagcaagtacctgaaggccgccaagaagggcaaggagaagcatgagccagatgtgagcagcaagagcagctctgtgctggacagcagcctggaccaccgccacaagcagaaggtgctgcatgacaccatggacctgaaccacctgctgaaggccttcctgcagctggacaagaagggcccccagaagcaccactttgaccagcccagcgtggcccctgggaagaactacagcttcacccgggaggaggtgcggcagattgaccgggagaaccagaggctgctgaaggagctgagccggcaggccgagaagccaggcagcaagagcaccatccccaggtctgctgaccacccccccaagctgtaccacagcgccctgaaccggcagaaggagcagcagagaattgagcgggagaacctgaccatcagcctgtgccaccctggctggagcgctgtgacctag

SEQ ID NO: 41119 - DNA, 342 bp, Artificial Sequence
  Description of Artificial Sequence: Synthetic coding sequence
gaggagcgggcagagtacacagctgacatcatcagcaccaccgtggccgagccctaccgcacctgcttcaccgctgggggcagcaagaccagccctgtggagcagcagcctgagcagcagcagccccaggacatcgtgtccctgcccctgccccccctgccccacgccaccccagaccccttcaccctgtacagccacaggacagagagcgctgggggccacctgttcctgccccaggacctgcgctggaagagccctggcctgggcgtgtttgctgtgcagagcgtgtatgagctggcccggcggcacaacgtgagccccttctacagcggccccccatag

SEQ ID NO: 41120 - DNA, 1563 bp, Artificial Sequence
  Description of Artificial Sequence: Synthetic coding sequence
atggccggctgcaccaggaagctgacccacctgaggaagaggatccaccggcccaggaggaggaccacccggcgctggaagcgctggttcaagttcaggaagaggaagggggagaagaggccccggcccaaccacaaggctgtggcccggcgggccaagctgaagttcagcaccagcgagaagctgcactggccagagcaggagctggccaagaagagcatcctgaatgctgaggacagcctcatcatcgacaacaagaggagcatcagccacctgagcagcggcgtgctgaaggacatcttcaccaccggcaccagcagctacaacgtgctgctgcagagcaaggaggagaagaagtaccacagccagaagcagagcagcagcacctacagcaagcgctgcaggaagcccagcaagagccccaacaccagccgcagcaaggaccccaggaggatgaaggccctggtgcctgtgaccagcagcggcacctggtactgcctggagaggaggcctgctgtgtttgtgaccagctctgtgagcagccctgtgaagttcacccatgacatctctgtgactggaaatggcatcgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcagatcgtggtgcacctgacagaggacctgctgagccgggcctccatgacagtggtgaatggctgccccaccctgaccatcaacgtgtccacagcccgggagcactggctggagggcatgctgcggcatgaaattggcacccactacttccggggcatcaacaacctgcagcagccctggaacagctggacaggcaggaagaagcatgagctgaagcccaacaaccccacagaggagggcctggccagcatccacagcgtgctcttcaggaaggaccccttcctgtggagggctgccctgctgtactacacagtgtaccaggccagccagatgtccttctgtgagctgttcaaggacatcggccgctttgtgaaggaccccaacacccgctgggactactgtgtgcgggccaagaggggctggacagacaccagccagcccggctgcttcagcaaggaccaggtgtacctggatggcatcctgcagatcctgcgctacagagacaccatcgacttccacctgctgacagccctgggcaaggtgtcctatgaagatgtggaccggctgaagggcctggccgtgacagagaacatgagggtgccccacttcctgcaggaccacggccgctacatggagcacctggagaagatcatggaggtgaatgagctgacagaccgggagctgaaggacctgatctag

SEQ ID NO: 41121 - DNA, 2748 bp, Artificial Sequence
  Description of Artificial Sequence: Synthetic coding sequence
atgccccggggcagccgggcccggggcagcaagaggaagaggtcctggaacacagaatgtcccagcttccctggagagcggcccctgcaggtgcggcgggccggcctgaggacagctggagctgctgccagcctgtctgaggcctggctgcgctgtggggagggcttccagaacaccagcggcaaccccagcctgacagctgaggagaagaccatcacagagaagcacctggagctgtgcccccggcccaagcaggagaccaccaccagcaagagcaccagcggcctgacagacatcacctggagcagcagcggcagtgacctgagtgatgaggacaagaccctgagccagctgcagagagatgagctgcagttcatcgactgggagattgacagcgacagagctgaggccagtgactgtgatgaatttgaagatgatgagggcgctgtggagatcagtgactgtgccagctgtgccagcaaccagagcctgaccagtgatgagaagctgtctgagctgcccaagcccagcagcattgagatcctggagtacagcagtgacagcgagaaggaggatgacctggagaatgtgctgctgattgacagcgagagcccccacaagtaccacgtgcagtttgccagtgatgcccggcagatcatggagcggctgattgaccccaggaccaagagcacagagaccatcctgcacaccccccagaagcccacagccaagttccccaggaccccagagaacagcgccaagaagaagctgctgcggggcggcctggccgagcggctgaatggcctgcagaaccgggagaggtctgccatcagcctgtggaggcaccagtgcatctcctaccagaagaccctgagcggcaggaagagcggcgtgctgactgtgaagatcctggagctgcatgaagaatgtgccatgcaggtggccatgtgtgagcagctgctgggcagccctgccaccagcagcagccagagcgtggcccccaggcctggggccggcctgaaggtgctcttcaccaaggagacagctggctacctgcggggccggccccaggacacagtgcgcatcttccccccctggcagaagctgatcatccccagcggcagctgccctgtgatcctgaacacctacttctgtgagaaggtggtggccaaggaggacagcgagaagacctgtgaggtgtactgcccagacatccccctgcccaggaggagcatcagcctggcccagatgtttgtgatcaagggcctgaccaacaacagccctgagatccaggtggtgtgcagcggcgtggccaccaccggcacagcctggacccacggccacaaggaggccaagcagaggatccccaccagcacccccctgcgggacagcctgctggatgtggtggagagccagggcgccgcctcctggccaggggccggcgtgcgggtggtggtgcagagggtgtacagcctgcccagccgggacagcacccggggccagcagggcgccagcagcggccacacagatcctgctggcacccgggcctgcctgctggtgcaggatgcctgtggcatgtttggagaggtgcacctggagttcaccatgagcaaggcccggcagctggagggcaagagctgcagcctggtgggcatgaaggtgctgcagaaggtgacccggggccgcacagctggcatcttcagcctgattgacaccctgtggcccccagccatccccctgaagaccccaggccgggaccagccctgtgaggagatcaagacccacctgcccccaccagccctgtgctacatcctgacagcccaccccaacctgggccagattgacatcattgatgaggaccccatctacaagctgtaccagccccctgtgacccgctgcctgcgggacatcctgcagatgaatgacctgggcacccgctgcagcttctacgccaccgtcatctaccagaagccccagctgaagagcctgctgctgctggagcagcgggagatctggctgctggtgacagatgtgaccctgcagaccaaggaggagcgggacccccggctgcccaagaccctgctggtgtatgtggcccccctgtgtgtgctgggcagcgaggtgctggaggccctggccggggccgccccccacagcctcttcttcaaggatgccctgcgggaccagggccgcatcgtgtgtgccgagaggacagtgctgctgctgcagaagcccctgctgtctgtggtgtctggggccagcagctgtgagctgcccggccctgtgatgctggacagcctggacagcgccacccctgtgaacagcatctgcagcgtgcagggcaccgtggtgggcgtggatgagagcacagccttctcctggcctgtgtgtgacatgtgtggaaatggccgcctggagcagaggcctgaggacagaggagccttcagctgtggggactgcagccgggtggtgaccagccctgtgctgaagaggcacctgcaggtgttcctggactgccgcagccggccccagtgccgggtgaaggtgaagctgctgcagaggagcatcagcagcctgctgcgctttgctgctggggaggatggcagctatgaggtgaagtctgtgctgggcaaggaggtgggcctgctgaactgctttgtgcagagcgtgacagcccaccccaccagctgcatcggcctggaggagattgagctgctgtctgctgggggcgccagcgctgagcactag

SEQ ID NO: 41122 - DNA, 918 bp, Artificial Sequence
  Description of Artificial Sequence: Synthetic coding sequence
atggccagccggcagcctgaggtgcctgccctggaggccagcgcccccctgggcaagatgagcctgcccatcggcatctaccgccgggctgtgtcctatgatgacaccctggaggaccctgcccccatgaccccaccacccagcgacatgggctctgtgccctggaagcctgtgattcctgagaggaagtaccagcacctggccaaggtggaggagggggaggccagcctgcccagccctgccatgaccctgagcagcgccatcgacagcgtggacaaggtgcctgtggtgaaggccaaggccacccacgtgatcatgaacagcctcatcaccaagcagacccaggagagcatccagcactttgagcggcaggccggcctgagagatgctggctacaccccccacaagggcctgaccacagaggagaccaagtacctgcgggtggccgaggccctgcacaagctgaagctgcagagcggggaggtgaccaaggaggagcggcagcctgccagcgcccagagcacccccagcaccaccccccacagcagccccaagcagaggccccggggctggttcaccagcggcagcagcacagccctgcccggccccaaccccagcaccatggacagcggcagcggggacaaggacaggaacctgagtgacaagtggagcctgtttggccccaggagcctgcagaagtatgacagcggcagctttgccacccaggcctacagaggagcccagaagcccagccccctggagctgatccgggcccaggccaacaggatggctgaagatcctgctgccctgaagccacccaagatggacatccctgtgatggagggcaagaagcagcccccccgggcccacaacctgaagccccgggacctgaatgtgctgacccccaccggcttctag

SEQ ID NO: 41123 - DNA, 3213 bp, Artificial Sequence
  Description of Artificial Sequence: Synthetic coding sequence
atgtactgctgcagcgcccaggacagcaagatggactacaagaggcgcttcctgctgggcggcagcaagcagaaggtgcagcagcaccagcagtaccccatgcctgagctgggccgggccctgagcgcccccctggccagcacagccaccacagcccccctgggcagcctgacagctgctggcagctgccaccacgccatgccccacaccacccccatcgctgacatccagcagggcatcagcaagtacctggatgccctgaatgtgttctgccgggccagcaccttcctgacagacctcttcagcacagtgttcaggaacagccactacagcaaggccgccacccagctgaaggatgtgcaggagcacgtgatggaggccgccagccggctgaccagcgccatcaagccagaaattgccaagatgctgatggagctgtctgctggggccgccaacttcacagaccagaaggagttcagcctgcaggacatcgaggtgctgggccgctgcttcctgactgtggtgcaggtgcacttccagttcctgacccacgccctgcagaaggtgcagcctgtggcccacagctgctttgctgaggtgattgtgcctgagaagaagaacagcggcagcggcggcggcctgagcggcatgggccacaccccagaggtggaggaggccgtgcgctcctggagaggagctgctgaggccaccagccggctgcgggagcggggctgtgatggctgcctggccggcatcgaggtgcagcagctgttctgcagccagagcgctgccatccctgagcaccagctgaaggagctgaacatcaagattgattctgccctgcaggcctacaagatcgccctggagagcctgggccactgtgaatatgccatgaaggccggcttccacctgaaccccaaggccatcgaggccagcctgcagggctgctgcagcgaggccgaggcccagcagacaggaagacggcagaccccaccccagcccatgcagtgtgagctgcccaccgtgcctgtgcagatcggcagccacttcctgaagggcgtgtccttcaatgaatctgctgctgacaacctgaagctgaagacccacaccatgctgcagctgatgaaggaggccggctgctacaacggcatcaccagcagagatgacttccctgtgacagaggtgctgaaccaggtgtgccccagcacctggaggggggcctgcaagacagctgtgcagctgctgtttggccaggccggcctggtggtggtggacacagcccagatcgagaacaaggaggcctatgccccccagatcagcctggagggcagccgcatcgtggtgcaggtgcccagcacctggtgcctgaaggaggaccctgccaccatgagcctgctgcagaggagcctggaccctgagaagaccctgggcctggtggatgtgctgtacacagctgtgctggacctgaaccgctggagggctggccgggagcaggccctgccctgcatccagatccagctgcagcgggagatctgtgactttggaaaccaggccgacctgcccagcggaaatggaaacaagagcagcggcggcctgcagaagaccttcagcaagctgaccagccgcttcaccaagaaggccagctgcaccagcagcagcagcagcaccaactacagcatccagaacacccccagcaagaacatcttcatcgccggctgcagcgaggagaaggccaagatgcctggcaacatcgacacccggctgcagagcatcctgaacatcggcaacttccccaggaccacagaccccagccagagcgcccagaacagcagcaacacagtggccaacggcttcctgatggagcggcgggagaacttcctgcatggagatgatggcaaggatgagaagggcatgaacctgcccacagaccaggagatgcaggaggtgattgacttcctgagcggcttcaacatgggccagagccaccagggcagccccctggtgaccaggcacaacagcgctgccacagccatggtgacagagcagaaggccggggccatgcagccccagcagcccagcctgcctgtgcccccaccaccccgggccccccaggccggggcccacacccccctgaccccccagcccggcctggccccccagcagcagagccccaagcagcagcagccccaggtgcagtactaccagcacctgctgcagcccatcggcccccagcagcccccaccccagccccgggcccctgggaagtgggtgcacggcagcagccagcagcctgcccaggccgtgggcgccggcctgagccccctgggccagtggccaggcatcagtgacctgagcagtgacctgtacagcctgggcctggtgagcagctacatggacaacgtgatgtctgaggtgctgggccagaagccccagggccccaggaacaacacctggcccaacagagaccagagtgatggagtgtttggcatgctgggggagatcctgccctttgatcctgctgtgggcagtgaccctgagtttgcccgctacgtggccggcgtgtcccaggccatgcagcagaagaggcaggcccagcacggccggcggcccggcaacccccggggcaactggccacccatggatgatgcccacaggacctggcccttccctgagttcttcacagaaggagatggcctgcacggcggctggagcggggcccagggcgacagcgccagcagcagtgatgagaccagcagcgccaatggagacagcctcttctccatgttcagcggccctgacctggtggccgctgtgaagcagaggaggaagcacagcagcggggagcaggacaccagcaccctgcccagcccccccctgctgaccaccgtggaggatgtgaaccaggacaacaagaccaagacctggccacccaaggccccctggcagcaccccagccccctgcccagcaccctgcccagccccagcgcccccctgtatgctgtgaccagccctggcagccagtggaatgacaccatgcagatgctgcagagccctgtgtgggccgccaccaatgactgcagcgctgctgccttctcctatgtgcagaccccaccccagcccccacctcctccagcccacaaggccgcccccaagggcttcaaggccttccctggaaaaggagagcggcggcctgcctacctgccccagtactag

SEQ ID NO: 41124 - DNA, 4188 bp, Artificial Sequence
  Description of Artificial Sequence: Synthetic coding sequence
atgtaccccatctgcaccgtggtggtggatggcctgcccagcgagagcagcagcagcagctacccaggccctgtgtctgtgtctgagatgagcctgctgcacgccctgggccctgtgcagacctggctgggccaggagctggagaagtgtggcattgatgccatgatctacacccgctacgtgctgagcctgctgctgcatgacagctatgactatgacctgcaggagcaggagaatgacatcttcctgggctgggagaagggggcctacaagaagtggggcaagagcaagaagaagtgcagcgacctgaccctggaggagatgaagaagcaggccgctgtgcagtgcctgcggagcgccagtgatgagagcagcggcatcgagaccctggtggaggagctgtgcagccggctgaaggacctgcagagcaagcaggaggagaagatccacaagaagctggagggcagccccagccctgaggccgagctgagccccccagccaaggaccaggtggagatgtactatgaggccttcccccccctgtctgagaagcctgtgtgcctgcaggagatcatgacagtgtggaacaagagcaaggtgtgcagctacagcagcagcagcagcagcagcacagcccccccagccagcacagacaccagcagccccaaggactgcaacagcgagagcgaggtgaccaaggagaggagcagcgaggtgcccaccaccgtgcatgagaagacccagagcaagagcaagaatgagaaggagaacaagttcagcaatggcaccatcgaggagaagccagccctgtacaagaagcagatccgccacaagccagagggcaagatccggcccaggtcctggagcagcggcagcagcgaggccggcagcagcagcagcggcaaccagggcgagctgaaggcctccatgaagtatgtgaaggtgcgccacaaggcccgggagatccggaacaagaagggcagaaatggccagagccggctgagcctgaagcacggggagaaggccgagaggaacatccacacaggcagcagcagcagcagcagcagcggctctgtgaagcagctgtgcaagaggggcaagaggcccctgaaggagattggaaggaaggaccccggcagcacagagggcaaggacctgtacatggagaacaggaaggacacagagtacaaggaggagcccctgtggtacacagagcccatcgccgagtactttgtgcccctgagcaggaagagcaagctggagaccacctacagaaaccggcaggacaccagtgacctgaccagcgaggccgtggaggagctgtctgagagcgtgcacggcctgtgcatcagcaacaacaacctgcacaagacctacctggccgccggcaccttcattgatggccactttgtggagatgcctgctgtgatcaatgaagatattgacctgaccggcaccagcctgtgcagcctgcctgaggacaacaagtacctggatgacatccacctgtctgagctgacccacttctatgaggtggacatcgaccagagcatgctggaccccggggccagcgagaccatgcagggcgagagccgcatcctgaacatgatccggcagaagagcaaagaaaatacagactttgaagctgagtgctgcatcgtgctggatggcatggagctgcagggcgagcgggccatctggacagacagcaccagctctgtgggcgctgagggcctcttcctgcaggacctgggcaacctggcccagttctgggagtgctgcagcagcagcagtggagatgctgatggagagagctttggaggagacagccctgtgcggctgagccccatcctggacagcacagtgctgaacagccacctgctggccggcaaccaggagctgttcagtgacatcaatgaaggcagcggcatcaacagctgcttctctgtgtttgaggtgcagtgcagcaacagcgtgctgcccttctcctttgagaccctgaacctgggcaatgaaaatacagacagcagcgccaacatgctgggcaagacccagagccggctgctgatctggaccaagaacagcgcctttgaagaaaatgagcactgcagcaacctgagcaccaggacctgcagcccctggagccacagcgaggagaccaggagtgacaatgagaccctgaacatccagtttgaggagagcacccagttcaatgctgaggacatcaactacgtggtgccccgggtgagcagcaactacgtggatgaggagctgctggacttcctgcaggatgagacctgccagcagaacagcaggaccctgggggagatccccaccctggtgttcaagaagaccagcaagctggagagcgtgtgtggcatccagctggagcagaagacagagaacaagaactttgagaccacccaggtgtgcaatgaaagcccccatggagatggctacagcagcggggtcatcaaggacatctggaccaagatggctgacaccaacagcgtggccaccgtggagattgaaagaacagatgctgagctgttcagcgcagatgtgaacaactactgctgctgcctggatgctgaggccgagctggagaccctgcaggagccagacaaggctgtgagaagaagtgagtaccacctgtgggagggccagaaggagagcctggagaagagggcctttgccagcagcgagctgagcaatgtggatggaggagactacaccacccccagcaagccctgggatgtggcccaggacaaggagaacaccttcatcctgggcggcgtgtatggagagctgaagaccttcaacagtgatggagagtgggccgtggtgccccccagccacaccaagggcagcctgctgcagtgtgccgccagtgatgtggtgaccatcgccggcacagatgtgttcatgaccccaggcaacagctttgcccctggccaccggcagctgtggaagccctttgtgtcctttgagcagaatgaccagcccaagagcggggagaatggcctgaacaagggcttctccttcatcttccacgaggacctgctgggcgcctgtggcaacttccaggtggaggaccccggcctggagtacagcttcagcagctttgacctgagcaaccccttcagccaggtgctgcacgtggagtgcagctttgagcctgagggcatcgccagcttcagccccagcttcaagcccaagagcatcctgtgcagcgacagcgacagcgaggtgttccacccccgcatctgtggggtggacaggacccagtaccgggccatccgcatcagccccaggacccacttccggcccatcagcgccagcgagctgagccctgggggcggcagcgagagcgagtttgagagcgagaaggatgaggccaacatccccatccccagccaggtggacatctttgaggacccccaggccgacctgaagcccctggaggaggatgctgagaaggagggccactactacggcaagtctgagctggagagcggcaagttcctgccccggctgaagaagagcggcatggagaagagcgcccagaccagcctggacagccaggaggagagcacaggcatcctgtctgtgggcaagcagaaccagtgcctggagtgcagcatgaatgaaagcctggagattgacctggagagcagcgaggccaactgcaagatcatggcccagtgtgaggaggagatcaacaacttctgtggctgcaaggccggctgccagtttcctgcctatgaggacaaccctgtgagcagcggccagctggaggagttccctgtgctgaacacagacatccagggcatgaacagaagccaggagaagcagacctggtgggagaaggccctgtacagccccctcttccctgcctctgaatgtgaggagtgctacaccaatgccaagggggagagcggcctggaggagtacccagatgccaaggagacccccagcaatgaggagcggctgctggacttcaacagagtgtcctctgtgtatgaggcccgctgcaccggggagcgggacagcggggccaagagtgatggcttccggggcaagatgtgcagcagcgccagcagcaccagcgaggagactggaagtgaaggaggaggagagtgggtgggccccagcgaggaggagctgttcagcaggacccacctgtag

SEQ ID NO: 41125 - DNA, 5229 bp, Artificial Sequence
  Description of Artificial Sequence: Synthetic coding sequence
atgtggccagctggggccggcaccaagctgccctgcccccgggacagcgccctgcggcgggccgccttcagcggcaacctgacagccctgcccagccacctggtgcctgctggccgctctgtgcgggtcttcatcagcgccaaccctgaggacaccggggctgagcggcaggccctgagagaaaatgtgtaccccaagctgcgggagttctgcagagaaaattatggcctggagttccaggtgattgacctgtactggggcgtggaggaggatgagtgggacagccctgagctgcagaagaccaggatgaagctgctggagaactgcctgaagaccagcgctggcccctgctttgtgggcctgctgggggagaagtatggcaacatccgcatccctggagaggtggaggccagcgagtttgagatgatcctggatgctgccatcgaggccaagctggagaccaagctgctggaggagtggtactgcagagatgaaaattctgtgcctgctgcctactacctgcggcccaagtctgagatgctgcggagcaacagaaatgccatgcagcccagcaccaatgcagaaaatgagaagacctggcaggagatcagtgatgagatcaagaagatcttcaaggctgctgtgaagctgctgcacgagaagggcaagatgaagcacagccaggccaagcgctacctgttcagcgccattgaagatgaatttgattttgccctgggcaagcagaccccagccttcctgaagaagtgtgtgtgctacatcaggaagatcgccaacatcgagagatttgtgaagatccctgagatgggcaagtacatggacatcaccggcacagagccccgcatcatccgggaccctgaggcccaggagaagctgatcaagctgagagatgagttcatccccaccatcgtggccagcagcaacctgcgggtgtacacctctgtgacccactgtgacatgaagctgggctacagccaggagattgagaaccactacatcgagggcctgggcaagcagttctatgaggacatgattgacatcatccaggccaccatccagcagaactttgacacagaaacagacaccctgtatgatgagatcctgcagcacagcagcctgtgcaagacctacgccagcttctatgagtacaagtgtgagagcctgaacatcgtgcacaactacatcctgcccagcaaggccggccacatcaaccccctcatcatctatggaggcccctgcaccgggaagaccctgctgctggccgaggtggccaagaaggcctacggctggctgcatgaagatactggacctgagagtgaccctgtggtgattgtgcgcttcctgggcaccacagacatgagcagtgacctgcggaccctgctgctgtctgtgtgtgagcagctggccgtgaactaccgctgcctggtgcagagctaccccaagaagatccatgacctgtgtgacctcttcatcaacctgctgaatgaaagcagcctgcagaggcccctggtgatcatctttgatgccctggagcagctgtctgaaaatgatgatgccaggaagctgtggtggctgcctgcccacctgcccaggtttgtgagaattgtgctgagcaccctgcccaacaagcacggcatcctgcagaagctgcgctgcctgattcatgaggaggacaactacatcgagctgatcccccgggacaggaagatgtgcagccaggtgctgaagcaccagctgctgcgggtgaagaggaaggtgaccagcggccagcagatctacgtgaacaatgccctgagcaagtgcaccctgcccatgtttgtgaacctgaccttccgggaggtgcgccactggaggagccacaaggatgtggatgagagcagcctgtctgtgacagtgcatgagagcattgagcagctgttctggagcctggagaagaagtgtggccagaagctggtgtcccgggccctgggctacatcaccatggccaagatgggcctgtctgagatggagctggaggatgtgctggccctggacaacagcgtgatgtctgagctgaaggagaacacccggcccagcaaccccctgcgggtgccctacctgtacatcgcccggctgaaggagggcctgagcggctacctgattgaaagacatgtgaagaatgtgaccctgctggtgtgggccaacagacacctgcagctgattgcccagaagctgtacctgcaggatgacaatgacctgcgggagatgcacaccatcctggccgactacttcctgggcgtgtggagcggcggccgcaggaaggccttctgcctggaggacccctacctgaatggctgcctggacctggagaacagaagcctgctggaggaggagaagcacttcatggagcaggccagctttgaccggcaggccccagaccagccctgggtgttccagtgcaaccccctggagccagacatcttctttgtgaaccacaggaagatgtctgagctgctgtaccacctgacccgctgtgggaagacagatgacctgctgtatggcatcatcatgaacttctcctggctgtacaccatgatcaagattggccagtttgacaaggtgctgagtgacatcgagctggcctacaactacagccaggagaaggagctgaagttcctggccaacaccctgcggagcatcaagaacaaggtgacagccttccctggcagcctgtctgctgagctgcagcagaggctgctgcctgtggtgagcagcctgcccaagctgcggcacctgctgctggagtgtgacaaggatggccccaagtactgcagcatcgtgcccctgcacagctccatggatgtgacctacagccctgagcggctgcccctgagcagcagccacctgcacgtgacagagatcctgcccacctgcaaccccagcacagtgctgacagccctggagaatggcagcatcagcacctgggatgtggagacccggcagctgctgcggcagatcaccacagcccagagcgtcatcctgggcatgaagctgaccagtgatgagaagtacctggtggtggccaccaccaacaacaccctgctgatctatgacaacgtgaacagctgcctgctgtctgaggtggagatcaagggcaccaagcacggcagcagcgccacctacatcaatggcttcaccctgagcgccaaccacgccctggcctggctggaggccagcaaggatgtgaccgtcatcgacctgctgtatggctggcccctgtaccagttccactgctggtatgaggtgacctgtgtgcagtgcagcctggatggcctgtatgccttctgtggccagtacctgaacaccaccaccatcttccacctgggcagcggggagaagctgtgcaccgtgaccagcgagttcagcggcggctttgtgaagttcctgctgatcctggacacagcccaggagatggtgatggtggacagcgagggcagcctgtctgtgtggaacacagaggacatcagcagcccccagctgacagatgactttgactgccggcgggaggacagcgaggtggtgtccattgagctgtctgaggaccagagcgctgtgctgatctgcaaggccctgagcattgagctgctggacaccggcctgtggaaggtggccgagaagttccgggccaagcacaatgaacgcttcatctctgctgtgctgagcaagaatggagactgcatcatcgccaccatggagaacaccagcgctgtgttcttctggaggcgggacaccggccagtgcatggccagcctgcaggagatcagcggcagcatcgtgaagctggtgaagagcagccaccacaacatgctgctgagcctgagcaccagcggcgtgctgagcatctgggacatcgacatcatcacagccatgagcaacatcgacaagacaggcaagcccatccagagcctgctgctgcctgcccggggggagatcatctacagcctggatggcagtgactgtgtgcacaagtggaacttcagcagcggcttcatcgaggccgtgttcaagcatgagggcatcgtggagcactgtgtgctgaccagcactggagacatcatggtgaccagtgatgacaagagcagccagtatgtgtggcacaccagcagcggggagaacctcttccgcatcaatggccagaggatcagccagctgctgatcacccacaatgaccagtttgtggtgtccctgtgtgaggagaatgccagccgggtgtggaggctggccaccggccaccgggtgtgcaacatcctgaccaccctgcagaatgccttcatcaccagcgccaacacctttgtggtgggcatgaccaagagcaaggtgctggccgtgtccctgtggacaggcagcatcaccaagaagttctgctgtgaagatggcaccaccatcgtgaacttcaagctgatcccagactgcccagacatcatcgtgttcatcaccagcgctgagaccgtgaacatctggagcctgacagatgaggtgatctgcagaagagtgcagctgcccaacaacttcctgaagaacctggaggactttgagatcagccccaacgggaagctgggcatcatcgcccggggagatgagaacatcaacgtgctggacctgtacagcggcaagctgcgggtggtgcacgccagcggcatcatctggaggcagaggctgagcagagatggccgctacctggtgtacatctgcttcagaaatggagaggaggaggatgaaaatggagccatcttcagcctcatcgtgatgaggctggctgatggcaagaacatcggggcctgcagcctgtacaagacccccaccttcctggccctgagccagaggcacctgaacatcatcgtgggctttgatgatggcagcatcggcatctacacagtggtggacagagtggatgctgccctgaagatcaagatcgccaccagcaacagccggcagatcttcaacaatgccacccacaccagccggcccaagtgcaacagctactgcttcaagatctctgtggactgcctgtggagggagagcacagaggtgtttgcccgggacagccccatcaccgtgtctgacagcacagagagcaatgaggccacccccagcaagaagcacaacagctgctatgaaagagtgtgcagcgccctggaggcccggggccacagctatgccccagacaactag

SEQ ID NO: 41126 - DNA, 348 bp, Artificial Sequence
  Description of Artificial Sequence: Synthetic coding sequence
gtgtctgggggcgtgcggctgcctgccagcgagcggcgcttcctgagctgctgccccctgcctgcccggcccctgctgcagaggctggccagccgccacccagccagcctgccctgcagccagcagctgctgtggaggagcagccgggccccacccctgctgcccagcctgcccctgggcgtgctgatcacagaccccctgaccaggcaccctggccaccaccacccagcccccttccacagcgctgccctgctggtgcctgtgaagccacccacagcctgggagggcaagagccggctggcccggccctgcctgagccaggccctggaggcctgccagctgacctag

SEQ ID NO: 41127 - DNA, 585 bp, Artificial Sequence
  Description of Artificial Sequence: Synthetic coding sequence
atggccgccaagagcacccaggacagcctgccccgggacaccggggagcccagcgccctgcctgtgcagggccgggcagagggccgcagcagcgagggcaggaaggagaggacagcagaatgtgccctgcggggcaagcaggccagcgagcccgccctgaggaagaggaacttcctgcccggccccaacagcgacacagtgcggcctgctgctgagacagagctggtgccctgcagcctgcggcacccccggcaggacctgtgtggggagcaccccagcttccctgtgatgcagcccagcctggagacccaggccaagccagagcgggacagagctgtgctgatcccccccaagggcccctggcccccagcccagggcctggccatgaggacccactgccccactggaccacccagcaaggcctactgccggggcggcagcagcagcaccagcaggaaccaggtggccagcctggcctaccgcacccagaacacagctgccagccagccccggcagcccggcggccggggcaaggaggacacagctggctacggcagctgcagccccaggagcctggccgtgtag

SEQ ID NO: 41128 - DNA, 2817 bp, Artificial Sequence
  Description of Artificial Sequence: Synthetic coding sequence
atggactgggatgatgagtacagccacaacagctttgacctgcactgcctgctgaacagcttccctggggacctggagtttgagcagatcttcagtgacattgatgagaagattgagcagaatgctgccagcatcaagcactgcatcaaggagatccagagcgagatcaacaagcagtgccctggggtgcagctgcagaccaccacagactgctttgagtggctgaccaactacaactacagcaccagcgagagcagcttcatcagccacggggacctgatcaagttcttcaagaccctgcaggacctgctgaagaatgagcagaaccaggaggagatgaccctggacctgctgtgggacctgagctgccacagctctgtgtccttccccagcaccctgagcggcaccagcttccacttcctgagcaggaccagcctgcacagcgtggaggacaacagctccatggatgtgaagtccatgtgggatgacatccggctgcacctgcggcgcttcctggtgtccaagctgcagagccacaatgagatcaacaacagccagcagaagatcctgctgaagaagcagtgcctgcagcagctgctcttcctgtacccagagagcgaggtgatcatcaagtaccagaacatccagaacaagctgctggccaacctgctgtggaactgcttccccagctacaacagagacagcaacctggatgtgattgcccacggctaccagagcaccatgctgaagctgtacagcgtcatcaaggaggacttcaacaccctgtgtgagatcctggcccccagctccatggtgaagttcatcaaggagacctacctggacacagtgacagaggagatggccaagttcctggagaacttctgtgagctgcagttcagagaaaatgctgtgcgggtggtgaagaccagcaagagcagcagcaagcacagaggagctgtgcacgccctggtgaccacagaatgtccccagaagggcaggaacttcagcctgcccctggacaaggtggagttcctgagccagctgatcaagagcttcatgaagctggagaagggcgtgcaggagctgtttgatgagatcctgctgagcctgaagatcacccgggacaccagcggcatcctggagaagagtgaccgggaggtggtgatggagaagccccgggccaatgagaccaacatccccagcgagcagagcctgcccgggaaggaggccaccctgctggactttggctggaggtctgccttcaaggaggtgtccctgcccatggcccactgtgtggtgacagccatcgagggcttcagcaccaagatcctgcagcaggagcagaatgaaagaagcagcgctgtgtcctatgccatgaacctggtgaatgtgcagcaggtgtggcaggacagccacatgtttcctgaggaggagcagcccaagaagattggcaagttctgcagcgacatcatggagaagctggacaccatgctgcccctggccctggcctgcagagatgacagcttccaggagatccgggccaacctggtggaggcctgctgcaaggtggccacagctgtgctgcagaggctgcaggagcgggccaaggaggtgcccagcaaggcccccctgaagaacctgcacacctacctgagcacagctgtgtatgtgttccagcacttcaagagatatgacaacctgatgaaggagatgaccaagaagcccatcttcctggtgctggtgcagcgctaccaggagttcatcaacaccctgcagttccaggtgaccaactactgtgtgcgggtgtgtgccaccagcatcctgcaggatgctgagagccaccactgggatgactacaaggccttctatgaaggagagcgctgcagcttcagcatccagatgtggcactacttctgctggagcctgcactatgacctgtggaccatcctgccccccaagctggcccaggagatcctggtggaggtgctggagaagagcctgagcctgctggccagccgctatgcccgggcccaccccagcaggaagaggaccccccagctgcggctggatgtgaccaccatcctgatctgcacagagaacatgctgtggagcgtgtgcacctctgtgcagaagctgctgaacccccaccagcacacagatgacaagatcttcaagatccacacccactgcaacaacctcttcaccaccctggtgatcctgaccagccccctgacagagctgtacaagaccttccagcacggcctggatgagagcgccagtgacagcctgaagagcttcttcaagcagcccctgtactgggtgtcctgcatcagccacttctaccccagcctgctgcggaccccatctgctgggggcctgaaggccgagggccagctgaagctgctgctgagccagccccgctgcaactggaacctgctgctggagaccctgctgcaccatgatggcctgctgctgcgcatcctgctgaagagcagcaagaggaccttccaggagcaggtgtctgacacagagaacaacctgaaccagggccccagcctgatggaggccatcttcaagatcctgtaccactgcagcttcagcccccagacctttgccaacgtgtttgtgtcctacatggaggaggagcagctgtgggacttcctgtacaacatccctggcatgaggcacctgctgtttgtgaaggagatgttctaccgctacctgtatgtgcccctgaagatgttccgcagctgcatcgacaccggctttgctgagagcgtggtgggggagagcctgccctacatcttctctgtgtag

SEQ ID NO: 41129 - DNA, 480 bp, Artificial Sequence
  Description of Artificial Sequence: Synthetic coding sequence
atgagaaatgcccggagcatccggcctgcccgggcagagagctggaggctgagcctgtgcttcctgaactggcaggatgccatcatcagcaagccccactgcccagctggccgcacctgccccacagctgctgccagccacggcagcagaggagctggccacagcgacaaggaccagggccgcagccccaagcacgtggtgtgccacgtggagcacaagaagcagtgcccagctgagttcacagacagcagaggagtgcacaatgctgctgccagcatcagcagccaggtgggcttccctggccacctgacagccaggacagctgcccacaagcgggaggccctggccgtgagccccacccccaccctgcaggtgaatgcccctggggccaagctgcgggcccccaaggcccccaggaccccagaggccctgggccggggccccaagagagctggggagtggaagacaggctgcttctag

SEQ ID NO: 41130 - DNA, 3240 bp, Artificial Sequence
  Description of Artificial Sequence: Synthetic coding sequence
atggatgatgatgatgacagctgcctgctggacctgattggagacccccaggccctgaactacttcctgcacggccccagcaacaagagcagcaatgatgacctgaccaatgccggctacagcgctgccaacagcaacagcatctttgccaacagcagcaatgctgaccccaagagcagcctgaagggcgtgagcaaccagctgggggagggccccagtgatggcctgcccctgagcagcagcctgcagttcctggaggatgagctggagagcagccccctgcctgacctgacagaggaccagccctttgacatcctgcagaagagcctgcaggaggccaacatcacagagcagaccctggccgaggaggcctacctggatgccagcatcggcagcagccagcagtttgcccaggcccagctgcaccccagcagcagcgccagcttcacccaggccagcaatgtgagcaactacagcggccagaccctgcagcccatcggcgtgacccacgtgcctgtgggcgccagctttgccagcaacacagtgggcgtgcagcacggcttcatgcagcacgtgggcatctctgtgcccagccagcacctgagcaacagcagccagatcagcggcagcggccagatccagctgattggcagctttggaaaccaccccagcatgatgaccatcaacaacctggatggcagccagatcatcctgaagggcagcggccagcaggcccccagcaatgtgtctgggggcctgctggtgcaccggcagaccccaaatggaaacagcctgtttggaaacagcagcagcagccctgtggcccagcctgtgacagtgcccttcaacagcaccaacttccagaccagcctgcctgtgcacaacatcatcatccagaggggcctggcccccaacagcaacaaggtgcccatcaacatccagcccaagcccatccagatgggccagcagaacacctacaacgtgaacaacctgggcatccagcagcaccacgtgcagcagggcatcagctttgccagcgccagcagcccccagggctctgtggtgggcccccacatgtctgtgaacatcgtgaaccagcagaacaccaggaagcctgtgaccagccaggccgtgagcagcactggaggcagcatcgtcatccacagccccatgggccagccccacgccccccagagccagttcctgatccccaccagcctgtctgtgagcagcaacagcgtgcaccacgtgcagaccatcaatggccagctgctgcagacccagcccagccagctgatcagcggccaggtggccagcgagcacgtgatgctgaacagaaacagcagcaacatgctgcggaccaaccagccctacacaggccccatgctgaacaaccagaacacagctgtgcacctggtgtctggccagacctttgctgccagcggcagccctgtgattgccaaccacgccagcccccagctggtgggcggccagatgcccctgcagcaggccagccccaccgtgctgcacctgagccctggccagagctctgtgtcccagggccggcccggctttgccaccatgcccagcgtgacctccatgagcggccccagccgcttccctgctgtgtcctctgccagcacagcccaccccagcctgggcagcgctgtgcagagcggcagcagcggcagcaacttcaccggggaccagctgacccagcccaacagaacacctgtgcctgtgtctgtgagccaccggctgcctgtgagcagcagcaagagcaccagcaccttcagcaacaccccaggcaccggcacccagcagcagttcttctgccaggcccagaagaagtgcctgaaccagaccagccccatcagcgcccccaagaccacagatggcctgcggcaggcccagatccctggcctgctgagcaccaccctgcccggccaggacagcggcagcaaggtgatcagcgccagcctgggcacagcccagccccagcaggagaaggtggtgggcagcagccctggccaccctgctgtgcaggtggagagccacagcggcggccagaagaggcctgctgccaagcagctgaccaagggggccttcatcctgcagcagctgcagagggaccaggcccacacagtgaccccagacaagagccacttccgcagcctgagtgatgctgtgcagaggctgctgagctaccacgtgtgccagggctccatgcccacagaggaggacctgaggaaggtggacaatgaatttgagaccgtggccacccagctgctgaagaggacccaggccatgctgaacaagtaccgctgcctgctgctggaggatgccatgaggatcaaccccagcgctgagatggtgatgattgacaggatgttcaaccaggaggagcgggccagcctgagccgggacaagaggctggccctggtggaccctgagggcttccaggccgacttctgctgcagcttcaagctggacaaggccgcccacgagacccagtttggccgcagtgaccagcacggcagcaaggccagcagcagcctgcagcccccagccaaggcccagggccgggaccgggccaagacaggagtgacagagcccatgaaccacgaccagttccacctggtgcccaaccacatcgtggtgtctgctgagggcaacatcagcaagaagacagagtgcctgggccgggccctgaagtttgacaaggtgggcctggtgcagtaccagagcaccagcgaggagaaggccagccggcgggagcccctgaaggccagccagtgcagccctggccctgagggccacaggaagaccagcagcagaagtgaccatggaacagagagcaagctgagcagcatcctggccgacagccacctggagatgacctgcaacaacagcttccaggacaagagcctgaggaacagccccaagaatgaggtgctgcacacagacatcatgaagggcagcggggagccccagcctgacctgcagctgaccaagagcctggagaccaccttcaagaacatcctggagctgaagaaggccggccggcagccccagagcgaccccaccgtgtctggctctgtggagctggacttccccaacttcagccccatggccagccaggagaactgcctggagaagttcatcccagaccacagcgagggcgtggtggagacagacagcatcctggaggccgctgtgaacagcatcctggagtgctag

SEQ ID NO: 41131 - DNA, 1566 bp, Artificial Sequence
  Description of Artificial Sequence: Synthetic coding sequence
atggaggcctctgtgctgagccccacctcctgggagaagaggcgggcctggctgcggcagagcaggaactggcagacccaggtgctggaggaggaggccgctgctgccctgcaggatgtgcctgaccctgagcccagcagcctggatgatgtgttccaggagggcaaccccatcaacaagattgaggactggctgcaggactgtggctacagcgaggagggcttcagcgaggaggccggccagttcatctacaacggcttctgcagccacggcaccagctttgaagatgacctgaccctgggcgctgaggccaccctgctggccgccaacgggaagctgttcagccgctccttcctggagacagcccggccctgccagctgctggacctgggctgcagcctggccagcagctccatgactggaggcaccaacaagaccagcagcagcatcagcgagatcctggacaaggtgcaggaggatgctgaagatgtgctcttcagcctgggcttcggccaggaggaccacaaggacaccagccgcatcccagcccgcttcttcaccacccccagccaggccaagggcatcgacttccagctgttcctgaagagccaggtgcggcgcatcgagatggaggacccctgcctgatgctggccagccgcttcaagcaggtgcagaccctggccgtgacagcagatgccttcttctgcctgtacagctatgtgtccaagacccctgtgcagaagttcacccccagccacatgttctggaactgcaaccaccccacagatgtgcccagcatccgcatcctgagccgggagcctgagccccagagcccccgggaccggctgaggaaggccatcagcaagatgtgcctgtacacctgcccccgggaccggcccccaccaccccacaacacccccaagaggaacagcctggaccaggtggtgctggaggtgatggacaaggtgaaggaggagaagcagttcctgcagcaggacagcgacctgggccagttcagccaggaggaccctgtgcccccagctgagggcaagaagctgcccaccagcccctacccctgtgtgttctgctgtgaggaggagacccagcagaggatgagcacagtgctggcccccagccagaccctggacagcaaccccaaggtgccctgctgcacccacagcctgcccatcgaggacccccagtggagcacagatcctgcccagatccggcgggagctgtgcagcctgcctgccaccaacacagagacccacccagccaaggatgagaccttctggaagaggaagagccgggccaggaagagcctcttccagaagaacctgatgggcaggaaggtgaagagcctggacctgagcatcacccagcagaagtggaagcagagcgtggacaggcctgagctgcggcgcagcctgagccagcagccccaggacacctttgacctggaggaggtgcagagcaacagcgaggaggagcagagccagagccgctggcccagccggcccaggcacccccaccaccaccagacctttgctgggaaggacagctag

SEQ ID NO: 41132 - DNA, 372 bp, Artificial Sequence
  Description of Artificial Sequence: Synthetic coding sequence
atgccagatgccagcctgggcagcctgggcatcacctggtgcttcctggagagccccctggaggtgagcagcggccgcttcggcctggcccggctgctgggcagccaggaccatggagatgatcctgctgagcggggccgcacagccacagatgcctggggccccagccgctggggccagagccctggaaatggaggcggctactgtgatgccagccccccatctgccctggcccctggggaccgggcctgggccctgcctgccagccccagcagcggggccccagccagccagcactgctgcctggagaaggccggcaccaggaccaaggccagccctgtgtggggcagagatggcaacacctggaactag

SEQ ID NO: 41133 - DNA, 1410 bp, Artificial Sequence
  Description of Artificial Sequence: Synthetic coding sequence
atgctggagagcatccgggtgacagagaagctgcactggccagagcaggagctggccaagaagagcatcctgaatgctgaggacagcctcatcatcgacaacaagaggagcatcagccacctgagcagtggagtgctgaaggacatcttcaccaccggcaccagcagctacaacgtgctgctgcagagcaaggaggagaagaagtaccacagccagaagcagagcagcagcacctacagcaagcgctgcaggaagcccagcaagagccccaacaccagccgcagcaaggaccccaggaggatgaaggccctggtgcctgtgaccagcagcggcacctggtactgcctggagcggcggcctgctgtgtttgtgaccagctctgtgagcagccctgtgaagttcacccatgacatctctgtgactggaaatggaattgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcagatcgtggtgcacctgacagaggacctgctgagccgggcctccatgacagtggtgaatggctgccccaccctgaccatcaacgtgtccacagcccgggagcactggctggagggcatgctgcggcatgagatcggcacccactacttccggggcatcaacaacctgcagcagccctggaacagctggacaggcaggaagaagcatgagctgaagcccaacaaccccacagaggagggcctggccagcatccacagcgtgctcttcaggaaggaccccttcctgtggagggctgccctgctgtactacacagtgtaccaggccagccagatgtccttctgtgagctgttcaaggacatcggccgctttgtgaaggaccccaacacccgctgggactactgtgtgcgggccaagaggggctggacagacaccagccagcccggctgcttcagcaaggaccaggtgtacctggatggcatcctgcagatcctgcgctacagagacaccatcgacttccacctgctgacagccctgggcaaggtgtcctatgaagatgtggaccggctgaagggcctggccgtgacagagaacatgagggtgccccacttcctgcaggaccacggccgctacatggagcacctggagaagatcatggaggtgaatgagctgacagaccgggagctgaaggacctgatctag

SEQ ID NO: 41134 - DNA, 69 bp, Artificial Sequence; identical to SEQ ID NO: 23602
  Description of Artificial Sequence: Synthetic coding sequence

SEQ ID NO: 41135 - DNA, 3933 bp, Artificial Sequence
  Description of Artificial Sequence: Synthetic coding sequence
atgctgctgaatggagactgcccagagagcctgaagaaggaggccgctgctgctgagcccccaagagaaaatggcctggatgaagctggccctggagatgagaccaccggccaggaggtgattgtcatccaggacaccggcttctctgtgaagatcctggcccctggcatcgagcccttcagcctgcaggtgagcccccaggagatggtgcaggagatccaccaggtgctgatggaccgggaggacacctgccacaggacctgcttcagcctgcacctggatggaaatgtgctggaccacttcagcgagctgcggtctgtggagggcctgcaggagggctctgtgctgcgggtggtggaggagccctacacagtgcgggaggcccgcatccacgtgcgccacgtgcgggacctgctgaagagcctggaccccagtgatgccttcaatggagtggactgcaacagcctgtccttcctgagcgtcttcacagatggagacctgggggacagcggcaagaggaagaagggcctggagatggaccccatcgactgcaccccacctgagtacatcctgcccggcagccgggagcggcccctgtgccccctgcagccccagaacagagactggaagcccctgcagtgcctgaaggtgctgaccatgagcggctggaaccccccacctggcaacaggaagatgcatggagacctgatgtacctgtttgtgatcacagcagaagatcggcaggtgtccatcacagccagcacccggggcttctacctgaaccagagcacagcctaccacttcaaccccaagccagccagcccccgcttcctgagccacagcctggtggagctgctgaaccagatcagccccaccttcaagaagaactttgctgtgctgcagaagaagagggtgcagaggcacccctttgaaagaattgccacccccttccaggtgtacagctggacagccccccaggccgagcacgccatggactgtgtgcgggcagaagatgcctacaccagccggctgggctatgaggagcacatccctggccagacccgggactggaatgaggagctgcagaccacccgggagctgcccaggaagaacctgcctgagcggctgctgcgggagcgggccatcttcaaggtgcacagcgacttcaccgctgctgccaccaggggggccatggctgtgattgatggaaatgtgatggccatcaaccccagcgaggagaccaagatgcagatgttcatctggaacaacatcttcttcagcctgggctttgatgtgcgggaccactacaaggactttggaggagatgtggccgcctacgtggcccccaccaatgacctgaatggagtgaggacctacaatgctgtggatgtggagggcctgtacaccctgggcaccgtggtggtggactaccggggctacagagtgacagcccagagcatcatccctggcatcctggagcgggaccaggagcagagcgtcatctacggcagcattgactttgggaagacagtggtgagccacccccgctacctggagctgctggagaggaccagccggcccctgaagatcctgcggcaccaggtgctgaatgacagagatgaggaggtggagctgtgcagctctgtggagtgcaagggcatcattggaaatgatggccgccactacatcctggacctgctgcggaccttccccccagacctgaacttcctgcctgtgcctggagaggagctgcctgaagaatgtgcccgggccggcttcccccgggcccaccgccacaagctgtgctgcctgcggcaggagctggtggatgcctttgtggagcaccgctacctgctcttcatgaagctggccgccctgcagctgatgcagcagaatgccagccagctggagacccccagcagcctggagaatggaggccccagcagcctggagagcaagtcagaagatcctcctggccaggaggccggcagcgaggaggagggcagcagcgccagcggcctggccaaggtgaaggagctggccgagaccatcgccgcagatgatggaacagaccccaggagccgggaggtgatcagaaatgcctgcaaggctgtgggcagcatcagcagcacagcctttgacatccgcttcaacccagacatcttcagccctggccgggtgcgcttccctgagagctgccaggatgaggtgcgggaccagaagcagctgctgaaggatgctgctgccttcctgctgagctgccagatccctggcctggtgaaggactgcatggagcacgctgtgctgcctgtggatggagccaccctggccgaggtgatgaggcagaggggcatcaacatgagatacctgggcaaggtgctggagctggtgctgcggagccctgcccggcaccagctggaccacgtgttcaagattggcatcggggagctgatcaccaggtctgccaagcacatcttcaagacctacctgcagggcgtggagctgagcggcctgtctgctgccatcagccacttcctgaactgcttcctgagcagctaccccaaccctgtggcccacctgcctgcagatgagctggtgtccaagaagaggaacaagaggaggaagaaccggcccccaggagctgctgacaacacagcctgggccgtgatgaccccccaggagctgtggaagaacatctgccaggaggccaagaactactttgattttgacctggagtgtgaaacagtggaccaggccgtggagacctacggcctgcagaagatcaccctgctgcgggagatcagcctgaagacaggcatccaggtgctgctgaaggagtacagctttgacagccgccacaagccagccttcacagaggaggatgtgctgaacatcttccctgtggtgaagcacgtgaaccccaaggccagtgatgccttccacttcttccagagcggccaggccaaggtgcagcagggcttcctgaaggagggctgtgagctgatcaatgaggccctgaacctcttcaacaacgtgtatggagccatgcacgtggagacctgtgcctgcctgcggctgctggcccggctgcactacatcatgggagactatgcagaggccctgagcaaccagcagaaggctgtgctgatgtctgagcgggtgatgggcacagagcaccccaacaccatccaggagtacatgcacctggccctgtactgctttgccagcagccagctgagcacagccctgagcctgctgtaccgggcccgctacctgatgctgctggtgtttggagaggaccaccctgagatggccctgctggacaacaacatcggcctggtgctgcacggcgtgatggagtatgacctgagcctgcgcttcctggagaatgccctggccgtgtccaccaagtaccacggccccaaggccctgaaggtggccctgagccaccacctggtggcccgggtgtatgagagcaaggccgagttccgcagcgccctgcagcacgagaaggagggctacaccatctacaagacccagctgggagaagatcatgagaagaccaaggagagcagcgagtacctgaagtgcctgacccagcaggccgtggccctgcagaggaccatgaatgagatctacagaaatggcagcagcgccaacatcccccccctgaagttcaccgcccccagcatggcctctgtgctggagcagctgaatgtcatcaatggcatcctcttcatccccctgagccagaaggacctggagaacctgaaggccgaggtggcccggcggcaccagctgcaggaggccagcaggaacagagacagagctgaggagcccatggccacagagcccgccccagctggggcccctggggacctgggcagccagcccccagctgccaaggaccccagccccagcgtgcagggctag

SEQ ID NO: 41136 - DNA, 1518 bp, Artificial Sequence
  Description of Artificial Sequence: Synthetic coding sequence
atggtgagcaaccactacttcctgctgtgtgtgaacctgcccctgcgggagatccacaccccaggagctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagccagattctgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggagctgggggacttcaatgacatcacagagacctgcagctgcagctgcagcagcagcaagtctgtgacctatgagccagacttcaacagcgctgagctgctggccaaggagctgtacagagtcttccagaagtgctggatcctgtctgtggtgaacagccagctggccggcagcctgtctgctgctggcagcatcgtggtgaatgaagaatgtgtgaggaaggactttgagagctccatgaatgtggtgcaggagatcaagttcaagagccgcatccggggcacagaggactgggccccaccccgcttccagatcatcttcaacatccacccccccctgaagagggacctggtggtggccgcccagaacttcttctgtgccggctgcggcacccctgtggagcccaagtttgtgaagaggctgcgctactgtgagtacctgggcaagtacttctgtgactgctgccacagctatgcagagagctgcatcccagcccgcatcctgatgatgtgggacttcaagaagtactacgtgagcaacttcagcaagcagctgctggacagcatctggcaccagcccatcttcaacctgctgagcatcggccagagcctgtatgccaaggccaaggagctggacagagtgaaggagatccaggagcagctgttccacatcaagaagctgctgaagacctgccgctttgccaacagcgccctgaaggagtttgagcaggtgcccggccacctgacagatgagctgcacctgttcagcctggaggacctggtgcgcatcaagaagggcctgctggcccccctgctgaaggacatcctgaaggccagcctggcccacgtggccggctgtgagctgtgccagggcaagggcttcatctgtgagttctgccagaacaccaccgtcatcttccccttccagacagccacctgccgccgctgcagcgcctgccgggcctgcttccacaagcagtgcttccagagcagtgaatgtccccgctgtgcccgcatcacagcccggaggaagctgctggagagcgtggccagcgctgccacctag

SEQ ID NO: 41137 - DNA, 366 bp, Artificial Sequence
  Description of Artificial Sequence: Synthetic coding sequence
atgaggaggagcctgaagaccagccacttcagcgaggagcccagcacctgcctcttcctgaaccacagaaatggcagcacagaccccaccatcatcctgcacatcagcgagcccatgtttaatggaggcaagcgggagatgcacggcaagaggaccccacccttcctgctgagcctgaagttcaaggatgtgtgcttcggcatgcccagcctgctgcccatccaccggctgctgaagagcctcatctacagccgccacatgtgcctgctgtgccccaagtgcatcaccttcctgctggtgatggctgactttggctgtgtgtgtgtgagacatgctgtgaacaatgagatgaaggccatcgcctag

SEQ ID NO: 41138 - DNA, 1518 bp, Artificial Sequence
  Description of Artificial Sequence: Synthetic coding sequence
aagtctgtgcagatcagaacagaagctggcccccggctgcacatcgagccccctgtggactacagtgatgactttgagctgtgtggagatgtgaccctgcaggccaacaacaccagcgaggaccggccccaggacaccaagagccccaccagcaccaagccctgtggcttcaacttcagcctgctgaatgcctgtggccacagcgaccccagcagctctgtggacaaggagcgcatcctgctgaccatccaggatgtgatggagctgcggcgcagcctggagctgtctgtgaacctgcagaggaagcagaaggactgcagcagtgatgaatatgacagcattgaggaggacatcctgtctgagcctgagccagaagatcctgccctggtgggccaccccaggcatgaccggccccccagcagcggggactggacccagaaggatgtgcacggggagcaggagacagagggccgcagcagccctggccctgacaccctggtggtgctggagttcaacccagccagcaagagccacaagcgggagaggaacctgagcgccaagaggaaggacaatgctgaggtgtttgtgcccaccaagccagagcccaacctgaccccccaggccccagctgtgtttcctgaccaggagaggatgtgcagccggcccggcagcagaagagagcggcccctgagcgccaccaggaagaccctgtgtgaggccgagtacccagaagaagatgccagcgctgtgctgcaggccatccaggtggagaatgctgccctgcagagggccctgctgagcaggaaggccgagcagcctgccagccccctgcaggatgctgagggccccccagccaagccctggaccagcctgctggaggagaaggaggagaccctggagctgctgcccatcaccacagccaccaccacccaggagcctgctggagctgctggaggagcccgggccatcaaccaggccatggaccgcatcggcctgctgggcagccggcagcagcagaagctgctgaaggtgctgcaggccgtggagagtgacagcgcccacctgggccgggtggtgagccccaccaaggagcaggtgtctgacacagaggacaagcagaggatgagagcagatgagatcaaggatgccatctacgtgaccatggagatcctgagcaactggggcaacagctggtgggtgggcctgacagaggtggagttctttgacctgaatgacaccaagctgtatgtgagcccccatgatgtggacatccggaacacagccaccccaggagagctgggccgcctggtgaacagaaacctggccggcaagaaggacagcagcccctggacctgccccttccacccccccctgcagctgttcttcgtcatccggaacacccggcagctgggggacttccacctggccaagatcaaggtgaggaactactggacagcagatggcagcctgtctgctgcccaggccggcgtgcagtggagggaccacggcagcctgtag

SEQ ID NO: 41139 - DNA, 612 bp, Artificial Sequence
  Description of Artificial Sequence: Synthetic coding sequence
aagccctatgcctgcaatgaatgtgtgaagagcttctgtgtgaagagcagcctcatcatccaccagaggacccacactggagagaagccctacaagtgcaatgaatatggcaagaccttccaccacaagagcaccctgactgtgcaccagaggacccatggagagaagccctacaagtgcaatgaatgtaggaagagcttctacatgaagagccacctggccaagcaccacaggaagtacaccaagaagccctatgagtgcaagcagtgtgggaagaccttccagaagagccacctgattgagcaccagaggacccaccctggagagatcccccatgagtgcaacaagtgtgggaagagcttctgctacaagagccccctgaccatccaccagaggacccacatcgaggagaagccctacaagtgcagcaagtctgtgacctacttctgcatgaagagccacctgactgtgcaccagaggccccacaccaggaagaacccctttgaatgtaatgaatgtaggaagatgttctacgtgaagagcaacctgatcaaccaccagaggacccacactggagagaagccctatgagggcaacacctgtgggaagtag

SEQ ID NO: 41140 - DNA, 975 bp, Artificial Sequence
  Description of Artificial Sequence: Synthetic coding sequence
atggactgggatgatgagtacagccacaacagctttgacctgcactgcctgctgaacagcttccctggggacctggagtttgagcagatcttcagtgacattgatgagaagattgagcagaatgctgccagcatcaagcactgcatcaaggagatccagagcgagatcaacaagcagtgccctggggtgcagctgcagaccaccacagactgctttgagtggctgaccaactacaactacagcaccagcgagagcagcttcatcagccacggggacctgatcaagttcttcaagaccctgcaggacctgctgaagaatgagcagaaccaggaggagatgaccctggacctgctgtgggacctgagctgccacagctctgtgtccttccccagcaccctgagcggcaccagcttccacttcctgagcaggaccagcctgcacagcgtggaggacaacagctccatggatgtgaagtccatgtgggatgacatccggctgcacctgcggcgcttcctggtgtccaagctgcagagccacaatgagatcaacaacagccagcagaagatcctgctgaagaagcagtgcctgcagcagctgctcttcctgtacccagagagcgaggtgatcatcaagtaccagaacatccagaacaagctgctggccaacctgctgtggaactgcttccccagctacaacagagacagcaacctggatgtgattgcccacggctaccagagcaccatgctgaagctgtacagcgtcatcaaggaggacttcaacaccctgtgtgagatcctggcccccagctccatggtgaagttcatcaaggagacctacctggacacagtgacagaggagatggccaagttcctggagaacttctgtgagctgcagttcagagaaaatgctgtgcgggtggtgaagaccagcaagagcagcagcaagcacagaggagctgtgcacgccctgggctag

SEQ ID NO: 41141 - DNA, 459 bp, Artificial Sequence
  Description of Artificial Sequence: Synthetic coding sequence
atgcctggcctggtgttcttcaagtttgccaacctgggcggcggctggggcagcaggaagatgctggagcccggcatgtgcccagctgagatgagcctgaccccatttgtgaccaggagcctgaacctgctgtgcttctctgtgacccaccggggccggggcaaggacaaccccctgcacttcttcctgcagctgctggcccccagcgccagcgccagcctgggcctgggccgggagaccggccccctgcccagccctggcctgagccctggcctgctgtctgagacctttgtgtctgagggccccctgctgaccctgcagatctcctggtgtggcacagagtgcctgatggatggccagggccccctcatccacctgcacagccagaacatccgcatcagctttggagccacccagccccccctgctgctggtgtatgagatccgctggaacagatag

SEQ ID NO: 41142 - DNA, 558 bp, Artificial Sequence
  Description of Artificial Sequence: Synthetic coding sequence
atgcacggcctgtgcatggtgcccagcccccacggccaccctggcatcagcggcacctgctgtgcccctggccaggccccagacagacaccccctgagcctgtgtgcccccaccccaggcaggaagaggcagcaccacctggtggcctggcagccctgcccagcccccagctgcctgtggccccactggacccagccccccagccgggaggccttcggctgccgggccggggccggccgggcccaccctgtggccggcggcacccaggagccctggctgcacctgtgcagcaggaggacctgtggccagctgaccctgcagcagggcagcggccccaagagcctgacccaccgggtgctgagcccagacagagctgtggacagcttccccttccaccctggcacctgctggcaggagctgcccggcccccaccctggagctgccaccccagcccccccagccaccccaggccacgagaaggtgcagaacagcagcggccccagccacaacttcctggagctgcgggacagcttcctgagcaccaacggggtgaggtag

SEQ ID NO: 41143 - DNA, 3003 bp, Artificial Sequence
  Description of Artificial Sequence: Synthetic coding sequence
atgcctgggaagctgaaggtgaagatcgtggccggccgccacctgcctgtgatggaccgggccagtgacctgacagatgcctttgtggaggtgaagtttggaaacaccaccttcaagacagatgtgtacctgaagagcctgaacccccagtggaacagcgagtggttcaagtttgaggtggatgatgaggacctgcaggatgagcccctgcagatcaccgtgctggaccatgacacctacagcgccaatgatgccatcggcaaggtgtacattgatattgaccccctgctgtacagcgaggccgccaccgtcatcagcggctggttccccatctatgacaccatccacggcatccggggggagatcaacgtggtggtgaaggtggacctcttcaatgacctgaaccgcttccggcagagcagctgtggggtgaagttcttctgcaccaccagcatccccaagtgctaccgggccgtcatcatccacggctttgtggaggagctggtggtgaatgaagatcctgagtaccagtggattgaccgcatccgcaccccccgggccagcaatgaggcccggcagaggctcatcagcctgatgtctggagagctgcagaggaagattggcctgaaggtgctggagatgagaggaaatgctgtggtgggctacctgcagtgctttgacctggagggggagagcggcctggtggtgcgggccatcggcacagcctgcaccctggacaagctgagcagccctgctgccttcctgcctgcctgcaacagccccagcaaggagatgaaggagatccccttcaatgaagaccccaaccccaacacccacagcagcggccccagcacccccctgaagaaccagacctacagcttcagccccagcaagagctacagccggcagagcagcagcagtgacacagacctgagcctgacccccaagacaggcatgggcagcggcagcgctgggaaggagggcggccccttcaaggccctgctgcggcagcagacccagagcgccctggagcagcgggagttccccttcttcaccctgacagccttccccccaggcttcctggtgcacgtgggcggcgtggtgtctgcccggtctgtgaagctgctggaccgcatccacaacccagatgagcctgagaccagagatgcctggtgggccgagatccggcaggagatcaagagccacgccaaggccctgggctgccacgctgtggtgggctacagcgagagcaccagcatctgtgaggaggtgtgcatcctgagcgccagcggcacagctgctgtgctgaacccccgcttcctgcaggacggcaccgtggagggctgcctggagcagaggctggaggagaacctgcccacccgctgtggcttctgccacatcccctatgatgagctgaacatgcccttccctgcccacctgacctactgctacaactgcaggaagcagaaggtgcctgatgtgctcttcaccaccatcgacctgcccacagatgccaccgtcatcggcaagggctgcctgatccaggcccggctgtgccgcctgaagaagaaggcccaggccgaggccaatgccacagccatcagcaacctgctgcccttcatggagtatgaggtgcacacccagctgatgaacaagctgaagctgaagggcatgaatgccctgtttggcctgcgcatccagatcaccgtgggggagaacatgctgatgggcctggccagcgccaccggggtgtacctggccgccctgcccacccctgggggcatccagattgctgggaagaccccaaatgatggcagctatgagcagcacatcagccacatgcagaagaagatcaatgacaccatcgccaagaacaaggagctgtatgagatcaaccccccagagatcagcgaggagatcatcggcagccccatccctgagccccggcagaggagccggctgctgcggagccagagcgagagcagtgatgaggtgacagagctggacctgagccacggcaagaaggatgcctttgtgctggagattgatgacacagatgccatggaggatgtgcacagcctgctgacagatgtgcccccacccagcggcttctacagctgcaacacagagatcatgcctggcatcaacaactggaccagcgagatccagatgttcacctctgtgcgggtcatccggctgagcagcctgaacctgaccaaccaggccctgaacaagaacttcaatgacctgtgtgagaacctgctgaagagcctgtacttcaagctgcgctccatgatcccctgctgcctgtgccacgtgaacttcaccgtgtccctgcctgaagatgagctgatccaggtgacagtgacagctgtggccatcacctttgacaagaaccaggccctgcagaccaccaagacccctgtggagaagagcctgcagagggccagcacagacaatgaggagctgctgcagttccccctggagctgtgcagcgacagcctgcccagccaccccttccccccagccaaggccatgacagtggagaaggccagccctgtgggagatggcaacttcaggaacagaagtgccccaccctgtgccaacagcacagtgggcgtggtgaagatgacccccctgtccttcatccctggggccaagatcaccaagtacctgggcatcatcaacatgttcttcatccgggagaccaccagcctgcgggaggagggcggcgtgtctggcttcctgcacgccttcatcgccgaggtgtttgccatggtgcgggcccacgtggccgccctgggcggcaatgctgtggtgtcctacatcatgaagcagtgtgtgttcatggagaaccccaacaagaaccaggcccagtgcctgatcaacgtgtctggagatgctgtggtgtttgtgcgggagagtgacctggaggtggtgagcagccagcagcccaccaccaactgccagagcagctgcacagaaggagaggtgaccacctag

SEQ ID NO: 41144 - DNA, 1215 bp, Artificial Sequence
  Description of Artificial Sequence: Synthetic coding sequence
atgctgcgggccatcgccgaggagcggggccgcctgagcctgcggcgggaggtgtgtggcctgggctgcttcaaggatgacagaattgtgttctggacctggatgttcagcacctacttcatggagaagtgggccccccggcaggatgacatgctgttctacgtgcggaggaagctggcctacagcggcagcgagagcggggctgatggcaggaaggctgctgagcctgaggtggaggtggaggtgtaccgccgggacagcaagaagctgcccggcctgggggaccctgacatcgactgggaggagagcgtgtgcctgaacctgatcctgcagaagctggactacatggtgacctgtgctgtgtgcaccagggcagatggaggagacatccacatccacaagaagaagagccagcaggtgtttgccagccccagcaagcaccccatggacagcaagggggaggagagcaagatctcctaccccaacatcttcttcatgattgacagctttgaggaggtgttcagtgacatgacagtgggggagggggagatggtgtgtgtggagctggtggccagtgacaagaccaacaccttccagggcgtcatcttccagggcagcatccgctatgaggccctgaagaaggtgtatgacaacagagtgtctgtggccgccaggatggcccagaagatgagctttggcttctacaagtacagcaacatggagtttgtgaggatgaagggcccccagggcaaaggacatgctgagatggctgtgtcccgggtgtccactggagacaccagcccctgtggcacagaggaggacagcagccctgccagccccatgcatgagcgggtgaccagcttcagcaccccacccaccccagagaggaacaacagacctgccttcttcagccccagcctgaagaggaaggtgcccaggaacagaattgctgagatgaagaagagccacagcgccaatgacagcgaggagttcttccgggaggatgatggcggcgctgacctgcacaatgccaccaacctgcggagccgcagcctgtctggaacaggccgcagcctggtgggctcctggctgaagctgaacagagcagatggcaacttcctgctgtatgcccacctgacctacgtgaccctgcccctgcaccgcatcctgacagacatcctggaggtgcggcagaagcccatcctgatgacctag

SEQ ID NO: 41145 - DNA, 2151 bp, Artificial Sequence
  Description of Artificial Sequence: Synthetic coding sequence
atggaggactgcctgcacaccagcagcgagaacctgagcaagctggtgtcctgggcccacagccacggcaccatctgcagcctcatccccaacctgaagcacctgctgtctgagggcagccacggcaacctgacagccatgtggggctgcagcgctggccacgcctaccactggcccctgacagccacctgccgggccggcagccaggagcgggtgtgcttccaggacaacagaagcttcaacagcgacagccccagcatcatcggcgtgcccagcgagacccagaccagccctgtggagcgctacccaggccggcctgtgaaggccaagctggactgcaacagaacccgggacagctgtgacttctcctactgcagcgagcccagcgagctggatgagaccgtggaggagtatgaagatgagaacaccctgtttgacatggtgtgtgagagctctgtgacagatgaggacagcgactttgagccccagacccagaggccccagagcatcgccaggaagaggcctggggtggtgcccagcagcctgcacagcagcagccagacccagatggtggatgaatgtagcaatgatgtgatcatcaagaagatcaagcaggagatccctgaggactactacatcgtggccaatgctgagctgaccggcggcgtggatggccctgccctgagcctgacccagatggccaagcccaagccccagacccacgccggccccagctgtgtgggcagcgccaagctgatcccccacgtgaccagcgccatcagcacagagctggacccccacggcatgtctgccagccccagcgtcatcagccggcccatcgtgcagaagacagcccgggtgtccctggccagccccaacagaggccccccaggcacccacggcaccaaccagcaggtggccatgcagatgcctgtgtccaccagccaccccaacaagcagatcagcatccccctgagcgccctgcagctgcccggccaggatgagcaggtggccagcgaggagttcctgagccacctgcccagccaggtgagcagctgtgaggtggccctgagccccagcgtgaacacagagcctgaggtgagcagcagccagcagcagccccctgtggccccagccatcaccacagaggccacagcccagtgcatcccagcctacagcaccaagctgaacaagtttcctgtgttcaacatcaatgatgacctgaatgacctgtgcaccagcgctgtgagccccaacaccaccaaggccaccaggtatgccctgaatgtgtggagatactggtgcatgaccaacggcctgaaggaccacacagacatcaccaagatcccagctgtgaagctgaatgagctgctggagaacttctacgtgacagtgaagaagagtgatggcagtgacttcctggccaccagcctgcacgccatccggcggggcctggaccgcatcctgaagaatgctggggtgggcttcagcatcaccagcagcaccttcagcagcagcaccaagaagctgaaggagaagctgtgggtgctgagcaaggccggcatgtctggggcccggagcaggaacatcgtgtacttcagcctgagtgatgaggaggagatgtggcaggccggctgcctgggagatgacagccccatcaccctgctgagcacagtggtgaagtacaacagccagtacctgaacatgaggaccctgcaggagcacgccgacctgatgtacggggacatcgagctgctgaaggacccccagaaccagccctactttgccaggacagacagcgtgaagcgggagagccgcagcggcagcaccagggtgtgccacggcaagatctaccacgagcacagccggggccacaagcagtgcccctactgcctgctgtacaagtacatgtacatccaccggccccccacccagatggaggccaagagccccttctacctgacagccaggaaggaggccacagacatgggctctgtgtggtatgaggagcagaggatgggcctgcggagcctgcggggcatcgtgcccaacctggccaagaaggtgaagctggagaactgtgagaacttcacctttgtgtccttcacccaggtgtcccggcggctgggcagccacagctgctgccagtag

SEQ ID NO: 41146 - DNA, 1605 bp, Artificial Sequence
  Description of Artificial Sequence: Synthetic coding sequence
atgaggaggcacagcgagacagatgtggaggagcagacccaggagctgaagaccatcacccagctgcaggagcagtgccgggccctgcagatccagggcgtgaaggagaacatggaccagaacaaggccaccctggccctgctgcggagcaacatcagaagaggagcccaggactgggccctggccaagaagtatgaccagtggaccatcagcaaggcctgtgggaagaacctgcccctgcggctggcccactgccgcagcaccatggaggtggtgcgggagaagctgaggaaatatgtgtttgacagagtgaacatgcacaacctgctgatccacctggtgagaagaagaggccagaagctggagagcatgcagctggagctggacagcctgcggagccagccagatgccagcaaggaggagctgcggctgctgcagatcatccggcagctggagaacaacatcgagaagaccatgatcaagatcatcaccagccagaacatccacctgctgtacctggacctgctggactacctgaagacagtgctggccggctaccccatcgagctggacaagctgcagaacctggtggtgaactactgcagcgagctgagtgacatgaagatcatgagccaggatgccatgatgatcacagatgaggtgaagaggaacatgaggcagcgggaggccagcttcatcgaggagcggcgggcccgggagaaccggctgaaccagcagaagaagctgattgacaagatccacaccaaggagaccagcgagaagtacagaagaggccagatggacctggacttccccagcaacctgatgagcacagagaccctgaagctgcggaggaaggagaccagcacagctgagatggagtaccagagcggcgtgacagctgtggtggagaaggtgaagtctgctgtgcgctgcagccacgtgtgggacatcaccagccgcttcctggcccagaggaacacagaggagaacctggagctgcagatggaggactgtgaggagtggagggtgcagctgaaggccctggtgaagcagctggagctggaggaggccgtgctgaagttccggcagaagcccagcagcatctccttcaagtctgtggagaagaagatgacagacatgctgaaggaggaggaggagcggctgcagctggcccacagcaacatgaccaagggccaggagctgctgctgaccatccagatgggcatcgacaacctgtatgtgcggctgatgggcatcaacctgcctgccacccagcgggaggtggtgctgagcaacaccctggacctgaacagcaagctggcctactgtgagggcaagctgacctacctggccgacagagtgcagatggtgtccaggacagaggagggggacaccaaggtgcgggacaccctggagagcagcaccctgatggagaagtacaacacccgcatcagctttgagaaccgggaggaggacatgattgacaccttccagttcccagacatggaccacagctatgtgcccagcagagctgagatcaagaggcaggcccagaggctcatcgagggcaagctgaaggccgccaagaagaagaagaagtag

SEQ ID NO: 41147 - DNA, 5520 bp, Artificial Sequence
  Description of Artificial Sequence: Synthetic coding sequence
atgtaccacatcgactgccgggaccagctggagagggtcttcctgcggctgggccacgccgagacagatgagcagctgcagaacatcatcagcaagttcctgccccctgtgctgctgaagctgagcagcacccaggagggcgtgaggaagaaggtgatggagctgctggtgcacctgaacaagaggatcaagagccggcccaagatccagctgcctgtggagaccctgctggtgcagtaccaggaccctgctgctgtgtcctttgtgaccaacttcaccatcatctacgtgaagatgggctacccccggctgcctgtggagaagcagtgtgagctggcccccaccctgctgacagccatggagggcaagccccagccccagcaggacagcctgatgcacctgctgatccccaccctcttccacatgaagtaccctgtggagagcagcaagagcgccagccccttcaacctggccgagaagcccaagacagtgcagctgctgctggacttcatgctggatgtgctgctgatgccctacggctacgtgctgaatgaaagccagagccggcagaacagcagcagcgcccagggcagcagcagcaacagcggcggcggcagcggcatcccccagcccccacctggcatgtccttctatgctgccaagagggtcatcggggacaacccctggaccccagagcagctggagcagtgcaagctgggcatcgtgaagttcattgaagctgagcaggtgcctgagctggaggccgtgctgcacctggtgattgccagcagtgacaccaggcacagcgtggccacagctgctgacctggagctgaagagcaagcagagcctgattgactggaacaacccagccatcatcaacaagatgtacaaggtgtacctgggggacatccccctgaagaccaaggagggcgctgtgctgaagccagagctgaagagggaccctgtgtccaccagggtgaagctgaagatcgtgccccacctgctgcggagccggcaggccgctgagaccttccctgccaacatccaggtggtgtatgatggcctgtttggcaccaacaccaacagcaagctgcggaccctgagcctgcagtttgtgcaccacatctgcatcacctgcccagagatcaagatcaagcccctgggccccatgctgctgaatggcctgaccaagctgatcaatgagtacaaggaggaccccaagctgctgtccatggcctacagcgctgtgggcaagctgagcagcaggatgccccacctgttcaccaaggacatcgccctggtgcagcagctgtttgaggccctgtgcaaggaggagcctgagacccggctggccatccaggaggccctgtccatgatggtgggcgcctacagcaccctggagggcgcccagaggaccctgatggaggccctggtggccagctacctgatcaagccagaggtgcaggtgcggcaggtggccgtgaagtttgccagcaccgtcttccccagcgaccacatccccagccgctacctgctgctgctggccgccggggacccccgggaggaggtgcatggagaggcccagagggtgctgcgctgcctgcccggcaggaacaggaaggagagcaccagcgagcagatgcccagcttccctgagatggtgtactacatccaggagaaggccagccacaggatgaagacccctgtgaagtacatgacaggcaccaccgtgctgcccttcaacccagctgccttcggggagatcgtgctgtacctgaggatgtgcctggcccacagcgctggggtggtgcccaccagccagagcctggccgacatgcaggaccacgccccagccatcggccgctacatccgcaccctgatgagcagcggccagatggcccccagcagcagcaacaagtctggagagaccaaccctgtgcagatctacatcggcctgctgcagcagctgctggccggcgtgggcggcctgcctgtgatgtactgcctgctggaggccgtgtctgtgtacccagagaagctggccaccaagtttgtggacaagacagagtggatcaagagcctgatgaacaacagcaaggaggagatgagggagctggccgccctcttctacagcgtggtggtgtccacagtgtctggaaatgagctgaagtccatgattgagcagctgatcaagaccaccaaggacaaccacagccctgagatccagcacggcagcctgctggccctgggcttcaccgtgggccgctacctggccaagaagaagatgaggatgtctgagcagcaggacctggagagaaatgctgacaccctgcctgaccaggaggagctgatccagagcgccacagagaccatcggcagcttcctggacagcaccagccccctgctggccatcgccgcctgcacagccctgggggagatcggcagaaatggccccctgcccatccccagcgagggcagcggcttcaccaagctgcacctggtggagagcctgctgagccgcatccccagcagcaaggagaccaacaagatgaaggagcgggccatccagaccctgggctacttccctgtgggagatggagacttcccccaccagaagctgctgctgcagggcctgatggacagcgtggaggccaagcagatcgagctgcagttcaccatcggggaggccatcaccagcgctgccatcggcaccagctctgtggccgccagagatgcctggcagatgacagaggaggagtacaccccacctgctggggccaaggtgaatgatgtggtgccctgggtgctggatgtgatcctgaacaagcacatcatcagccccaacccccacgtgcggcaggccgcctgcatctggctgctgagcctggtgaggaagctgagcacccacaaggaggtgaagagccacctgaaggagatccagagcgcctttgtgtctgtgctgtctgaaaatgatgagctgagccaggatgtggccagcaagggcctgggcctggtgtatgagctgggcaatgagcaggaccagcaggagctggtgtccaccctggtggagaccctgatgaccgggaagagggtgaagcatgaggtgtctggagagaccgtggtgttccagggcggggccctgggcaagaccccagatggccagggcctgagcacctacaaggagctgtgcagcctggccagtgacctgagccagcctgacctggtgtacaagttcatgaacctggccaaccaccacgccatgtggaacagcaggaaaggagctgccttcggcttcaacgtcatcgccacccgggccggggagcagctggcccccttcctgccccagctggtgccccggctgtaccgctaccagtttgaccccaacctgggcatccggcaggccatgaccagcatctggaatgccctggtgacagacaagtccatggtggacaagtacctgaaggagatcctgcaggacctggtgaagaacctgaccagcaacatgtggagggtgcgggagagcagctgcctggccctgaatgacctgctgcggggccggcccctggatgacatcatcgacaagctgcctgagatctgggagaccctcttccgggtgcaggatgacatcaaggagagcgtgaggaaggctgctgagctggccctgaagaccctgagcaaggtgtgtgtgaagatgtgtgaccctgccaagggagctgctggccagaggaccatcgccgccctgctgccctgcctgctggacaagggcatgatgagcacagtgacagaggtgcgggccctgagcatcaacaccctggtgaagatcagcaagtctgctggggccatgctgaagccccacgcccccaagctgatcccagccctgctggagagcctgtctgtgctggagccccaggtgctgaactacctgagcctgcgggccacagagcaggagaaggccgccatggattctgcccggctgtctgctgccaagagcagccccatgatggagaccatcaacatgtgcctgcagtacctggatgtgtctgtgctgggggagctggtgccccggctgtgtgagctgatccgctctggagtgggcctgggcaccaagggcggctgtgcctctgtgattgtgtccctgaccacccagtgcccccaggacctgaccccctacagcggcaagctgatgtctgccctgctgagcggcctgacagacaggaacagcgtcatccagaagagctgtgcctttgccatgggccacctggtgaggaccagccgggacagcagcacagagaagctgctgcagaagctgaatggctggtacatggagaaggaggagcccatctacaagaccagctgtgccctgaccatccacgccatcggccgctacagcccagatgtgctgaagaaccacgccaaggaggtgctgcccctggccttcctgggcatgcatgaaattgctgatgaggagaagtctgagaaggaggagtgcaacctgtggacagaggtgtggcaggagaatgtgcccggcagctttggaggcatccggctgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgacagccctgctgcagggcctggccggccgcacctgggccggcaaggaggagctgctgaaggccatcgcctgtgtggtgacagcctgcagcgctgagctggagaagtctgtgcccaaccagcccagcaccaatgagatcctgcaggccgtgctgaaggaatgttccaaagaaaatgtgaagtacaagatcgtggccatcagctgtgccgctgacatcctgaaggccaccaaggaggaccgcttccaggagttcagcaacatcgtcatccccctcatcaagaagaacagcctggagagcagcggcgtgaggaccaccaagaatgaggaggagaatgagaaggagaaggagctgcagctggagtacctgctgggcgcctttgagagcctgggcaaggcctggcccagaaatgctgagacccagcgctgctaccggcaggagctgtgcaagctgatgtgtgagcggctgaagctgagcacctggaaggtgcagctgggcgtgctgcagagcatgaatgccttcttccagggcctgatgctgctggaggaggagcacgccgaccctgaggccctggccgagatcctgctggagacctgcaagagcatcacctacagcctggagaacaagacctacagctctgtgaggacagaggccctgtctgtgattgagctgctgctgaagaagctggaggagagcaagcagtgggagtgcctgaccagcgagtgccgggtgctgctgattgagagcctggccaccatggagccagacagcaggcctgagctgcaggagaaggccgccctgctgaagaagaccctggagaacctggagtag

SEQ ID NO: 41148 - DNA, 1524 bp, Artificial Sequence
  Description of Artificial Sequence: Synthetic coding sequence
atggtggccaccggctgggcccggcgcagcggcctgcacccagccccccggcccctgcggggggcccaggaggccctggccaagaacctgtggagggaggagaggaaccggcccctcatcctgagcagcctcatcatcaagaagctgcactggccagagcaggagctggccaagaagagcatcctgaatgctgaggacagcctcatcatcgacaacaagaggagcatcagccacctgagcagtggagtgctgaaggacatcttcaccaccggcaccagcagctacaacgtgctgctgcagagcaaggaggagaagaagtaccacagccagaagcagagcagcagcacctacagcaagcgctgcaggaagcccagcaagagccccaacaccagccgcagcaaggaccccaggaggatgaaggccctggtgcctgtgaccagcagcggcacctggtactgcctggagcggcggcctgctgtgtttgtgaccagctctgtgagcagccctgtgaagttcacccatgacatctctgtgactggaaatggaattgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcagatcgtggtgcacctgacagaggacctgctgagccgggcctccatgacagtggtgaatggctgccccaccctgaccatcaacgtgtccacagcccgggagcactggctggagggcatgctgcggcatgagatcggcacccactacttccggggcatcaacaacctgcagcagccctggaacagctggacaggcaggaagaagcatgagctgaagcccaacaaccccacagaggagggcctggccagcatccacagcgtgctcttcaggaaggaccccttcctgtggagggctgccctgctgtactacacagtgtaccaggccagccagatgtccttctgtgagctgttcaaggacatcggccgctttgtgaaggaccccaacacccgctgggactactgtgtgcgggccaagaggggctggacagacaccagccagcccggctgcttcagcaaggaccaggtgtacctggatggcatcctgcagatcctgcgctacagagacaccatcgacttccacctgctgacagccctgggcaaggtgtcctatgaagatgtggaccggctgaagggcctggccgtgacagagaacatgagggtgccccacttcctgcaggaccacggccgctacatggagcacctggagaagatcatggaggtgaatgagctgacagaccgggagctgaaggacctgatctag

SEQ ID NO: 41149 - DNA, 576 bp, Artificial Sequence
  Description of Artificial Sequence: Synthetic coding sequence
cagagcggcttcatggacctgcccaaggagaaggtgggcaggaaggagcaggtggagaagctggagctgggcttcatccagctgagcggggccacagatggcatgagggagtacatcacagaatatgagagccagggcgctgtgcccaacaccaggcaccaggagaaggaggacatcatccggctggcccagaaggaggaggagatgaaggtgaagctgctggagctgcaggagctggtgctgcccctggtgggggaccacgagggccacggcaagttcctgacagctgcccagaacccagcagatgagcccgcccctggggccccagccccccaggagctgggcgctgctgatgagcagggcgacttctatgaggtgtccctggatgattctgaggagcccgcccctggagctgctggggagggcagcccccatgacaaccccacagcccagcagatcgtgcagctgccccctgtgatgcaggacacccaggagcaccctggcctgcccggcaacccctgtgtgtccttcttctaccaggccgcagaaaatcgggagatcaacatcatcatctag

SEQ ID NO: 41150 - DNA, 375 bp, Artificial Sequence
  Description of Artificial Sequence: Synthetic coding sequence
atggagcacatgctgctggccaaccacacagacaaggccaccttcaccggcacccagaggcagaggagctgcagcggggcctctgtgtcccagccccggcccctgcggggcaagctggtgggctactgggacccccacagccggctgctgagccggggccgggccctgggctctgtgtctgcccccagcaccccccggggccggggctggaaggccacctttgatggctgcatcctgcatgatgacctgctgaccaaggtgcacggcttccagagcctcatcggcctgcagcagcacctggcctgtggggacagcggcagcctgatgaagaactgccatgatggcaacagaaacaaccagaggaagctgccctag

SEQ ID NO: 41151 - DNA, 1371 bp, Artificial Sequence
  Description of Artificial Sequence: Synthetic coding sequence
atgggcaacagccgcagccgggtgggccgctccttctgcagccagttcctgcctgaggagcaggccgagattgaccagctgtttgatgccctgagcagtgacaagaacagccccaacgtgagcagcaagagcttcagcctgaaggccctgcagaaccacgtgggggaggccctgcccccagagatggtgacccggctgtatgatggcatgagaagagtggacctgaccgggaaggccaagggccccagtgaaaatgtgtcccaggagcagttcaccgcctccatgagccacctgctgaagggcaacagcgaggagaagagcctgatgatcatgaagatgatcagcgccacagagggccctgtgaaggcccgggaggtgcagaagttcacagaggacctggtgggctctgtggtgcacgtgctgagccaccggcaggagctgcggggctggacaggcaaggaggcccctggccccaacccccgggtgcaggtgctggccgcccagctgctgagtgacatgaagctgcaggacggcaagaggctgctgggcccccagtggctggactatgactgtgacagagctgtgattgaggactgggtgttccgggtgccccacgtggccatcttcctgtctgtggtgatctgcaagggcttcctgatcctgtgcagcagcctggacctgaccaccctggtgcctgagcggcaggtggaccagggccggggctttgagagcatcctggatgtgctgtctgtgatgtacatcaatgcccagctgccccgggagcagaggcaccgctggtgcctgctcttcagcagcgagctgcacggccacagcttcagccagctgtgtggccacatcacccaccggggcccctgtgtggccgtgctggaggaccatgacaagcacgtgtttggaggctttgccagctgctcctgggaggtgaagccccagttccagggcgacaaccgctgcttcctgttcagcatctgccccagcatggctgtgtacacccacacaggctacaatgaccactacatgtacctgaaccacggccagcagaccatccccaacggcctgggcatgggcggccagcacaactacttcggcctgtgggtggatgtggactttgggaagggccacagccgggccaagcccacctgcaccacctacaacagcccccagctgagcgcccaggagaacttccagtttgacaagatggaggtgtgggccgtgggggaccccagcgaggagcagctggccaagggcaacaagagcatcctggatgctgaccctgaggcccaggccctgctggagatcagcggccacagccgccacagcgagggcctgcgggaggtgcctgatgatgaatag

SEQ ID NO: 41152 - DNA, 438 bp, Artificial Sequence
  Description of Artificial Sequence: Synthetic coding sequence
atgggcccctggccccgggactggctgggcaagggctggaggctgggcagctgtgaggcccgggccggggccaaggaggtgtctgtcatccgccacggggcccccaacccagcccagagccacctgcacgtgcaggcccgggcccaggtgcacagtgaagatggccacagcctgccccctgtggtggatggagaagatgaggtgctgagcctgctggtgtttgtgcaggacagccaggagtgctgccggcaggccgtgcagggccggcagggccggggcgtgacctggggcctgggcctgcccagctaccacctgcggaccctgctgagccctgtgtgtgtgcctgcccgggaccagagggcccccaggaagtgctgtgaggccgtgctggcctgccccctggtggagaccctggtgaccaccctgctgaccaggtag

SEQ ID NO: 41153 - DNA, 1653 bp, Artificial Sequence
  Description of Artificial Sequence: Synthetic coding sequence
atgggctggagcgacctgcagcctgccatgggcggggaggccgagcgcttccaggcccagctggaggtgaagctggtgactggaggcagccctgtggtgttcaccggcaacctgacccggcaggtgggcagcaagctggccttcagcgccagcctgagccacctgctgagtgaccaggccaacgtgacagccctgctggagaggaaggaggagaatggccggcgggtggccgccctgggcgctgagctgtttgtgcccggcctggtgggcctgcgggccctgggcctgctgcagcagaggggccagctgtggaccaacagcctgcgcatccagtacagcctgctgggccaggccaagcaggccgcccacgagtgcagcaccagccagaagctgcgggctgacagcggcagtgatggagcctaccgcctggagctgcggcatgagctgcactgcacccagatcctggccttcagccacaaggtgcagctgtggcatgaagaagattctggccacctgcacagccagctggaggtgtcctatggcaagcactgggacaagaacagcaacaagaggcacctgcgggtgtcccagaccttcaagaatgattctggccctgccctgagcaaccacttcatggagtttgtgctgcaggtgcctgagcggcaggtggactgccgggtgcagctgtaccacctgagcctgcggctgccctacgtggagagcagcagccacctgaaggtgcagtacaacggccggcccctgtttgtggccggcggccagtggaaggacaccagccgggccaccctgtggaagtgggagggcgccctgaacctggacagcccctggctgatggtgtctgctgcccaccggctgtactggccccacagagctgtgttccaggccgtgctggagctgaccctgggcaaggcctggaccctgaaggacctggtggtgtctgtgggctgccgcagccagggccccaaccgggagggcaagatccaggtgtacacagctgccaccacctacctgcgggtgtccacagtgacagtgctggcccagagcctcttccacagctggagcgagctggagagcgcctggaatgctgctgtgcagggcgagatccacgccgagaacagccgggacaggaagatcctgaactgctggctgaagggcccccagcaggagctgaacctgacagctgcctaccgccacctggagtggcccaggaagacccaggtgtccctgacagctgtgcgcatcggggcccagggccagccccggggcctgcagctggagggggagctggaggagctgcggcaggacaggaccctgtacaggaagagaggagccctgctgctgcggcaccccctgcacctgcccatcccccagagcctgctgctgcaggagaccttcaccgctgacagaagacaccagcgctacagcctggagaccagggtggtgctgaatggccgggaggagaccctgcagaccatggtgctgggctgccaggccggccacccctacgtgtgtgccggcctgatgcacccctatgatggcaaggtgatccccaggaacacagagggctgcctggtgacctggaaccagcacaccagcctgaccctgctgagccggctggagagcggcgtgcagtag

SEQ ID NO: 41154 - DNA, 411 bp, Artificial Sequence
  Description of Artificial Sequence: Synthetic coding sequence
cgcagcaggacaggccctgtgtccctgcagggcgaccccaagcaggccccctggagcagcagccagagcaacagcagcaggaagaccctcttcctgagcctgtgcccccccttccccacccagccccagatccacctgcacttcacagagcaccgggccagcagccaccagggcggccccttcaagctgcagatctgcctgagcagcctgtacagcaacctgctgctgcactgccactaccgggaggtgcaccacatgagcggccacaggacagaatctgctgggggccacctgttcctgccccaggacctgcgctggaagagccctggcctgggcgtgtttgctgtgcagagcgtgtatgagctggcccggcggcacaacgtgagccccttctacagcggccccccatag

SEQ ID NO: 41155 - DNA, 372 bp, Artificial Sequence
  Description of Artificial Sequence: Synthetic coding sequence
atggccctgctggccagcaatggctgcttcatccgctgcaatgaggccggggacatcgaggccaagagcaagacagctggggaggaggagatgatcaagatccgcagctgtgccgagcgggagaccaagaagaaggatgacatcccagaagaagataaaggaaatgtgaagcagtgtgagatcaactacgtgaagaagttccagagcttccaggagcacaagctgaagatcagcaaggaggacagcaagatcctgaagaaggcccagaaggatggcttcctgcaggagaccctgctggacagcctgggctatgagcaccgctggaagcgctggctgctgtactggatcaaggacatgagcagagatggatag

SEQ ID NO: 41156 - DNA, 291 bp, Artificial Sequence
  Description of Artificial Sequence: Synthetic coding sequence
gaggtgcagctggtggagagcggcggcggcctggtgcagcccggcggcagcctgcggctgagctgtgccgccagcggcttcaccttcagcaaccactacacctcctgggtgcggcaggcccctgggaagggcctggagtgggtgtcctacagcagcggcaacagcggctacaccaactatgctgacagcgtgaagggccgcttcaccatcagccgggacaatgccaagaacagcctgtacctgcagatgaacagcctgcgggcagaggacacagctgtgtactactgctag

SEQ ID NO: 41157 - DNA, 438 bp, Artificial Sequence
  Description of Artificial Sequence: Synthetic coding sequence
ggggagagtgaagatgtgacccagttcctgcagagccacaagaagaccctgaccaatgagaagctgttcctgatggatggcaagaggacctggttcctggagatggagagcaccccaggagaagatgccatgaacacagtgaagatgaccaccaaggacctgaagtatgacaggagcctgattgacaaggccggctttgagaggacagacagcaactttgagaggagccacacagtgggcaagatgctgagcaacagcatcatgtgctacagagacatcttctatgagcgggagagccagctgatgcagcagaccagcctgctgtcctatgagatcgccatcgccacccccaccttcagcaactactacccagactggagcgcccccatcaacatcgtggcccggcccagcaccagcaagaagatcatgacctgctag

SEQ ID NO: 41158 - DNA, 396 bp, Artificial Sequence
  Description of Artificial Sequence: Synthetic coding sequence
atgaggaagcccaggagagctggctgggagaccctgagcaggaaggcccctggccccagcgctggcctgcggcccagccctgccacctgtgacacctgccacttccccatcctgggagatggcaaggccaccctgccctttgcccctgggaagaccagccgggtgcccagcgacagcggggtcttcagcagtgacccccgggccaactggagcagcatccggaacttccccagcgccaagtgtgtgggcatcgagctgcacgagagcctgagcaccagcgctgagtggctgctgcggggccggggcggggccctgccctggatcgtgcgctgcctggccgccacagacctgctgctgcccgggaagaagggcgtggagagctgccctgtgggctag

SEQ ID NO: 41159 - DNA, 291 bp, Artificial Sequence
  Description of Artificial Sequence: Synthetic coding sequence
gaggtgcagctggtggagagcggcggcggcctggtgcagcccggcggcagcctgcggctgagctgtgccgccagcggcttcaccttcagcaacagaagcacccactgggtgcggcaggcccctgggaagggcctggagtgggtgggccacagcgtgtccaagaagaagaagaagaagaagaagaagaagaagaagggccgcttcaccatcagcagagatgacagcaagaacaccctgtacctgcagatgaacagcctgaagacagaggacacagctgtgtactactgctag

SEQ ID NO: 41160 - DNA, 387 bp, Artificial Sequence
  Description of Artificial Sequence: Synthetic coding sequence
atgtactgccaggacagcaacatctgtgctgtgtttgctgtgcagggcggcaaggtgggcaggaagcacggcatcaagagaggaagaagacccagcatccgcagccctgcccagagggcccggggcccctggatccacgagagcaagcacccagcctttgccaagcagcagatcaacctggagatgcccaacagccgggccaccacagagctggcctgggtgtgcagcagcaccagcaggaagaagaagtgggcccggagcctgaccctgagcacagcccccctgagccccccacccagcctggtgcactgtgaggactgcagctgcctgcccggctgccacagcggggacctgtacaacctggccccagctgagaggacctgctag

SEQ ID NO: 41161 - DNA, 2157 bp, Artificial Sequence
  Description of Artificial Sequence: Synthetic coding sequence
atgagccggggctacagcgagaacaacaacttcctgaacaacaacaaccagatggtgctggacatgatcctgtaccccctcatcggcatcccccagaccatcaactgggagaccatcgcccggctggtgcccggcctgacccccaaggaatgtgccaagagatttgatgagctgaagagcagcggcagcagccctgtggacaaccagtacaacagcctgatggccgccggggagagccctgtggagaccctggccacctacatcaagagcagcctgctggacatccacggggagttccaggagacccctgtgggccatgatgctgtgtccaagacaggccgccacagcatcgccagcaccaggaactgcagcagcgagagcgagaactgcaccacccacaacggcggggagatgacagaggagagcgagggccccaacatggtgatccacgtgtgtgatgaggccaagaacctgaaggaggacttcacctgcccccgggacctgctgatcagcgagatgaagtactttgctgagtacctgtccatggatgcccagcgctgggaggaggtggacatctctgtgcactgtgatgtgcacatcttcaactggctgatcaagtacatcaagaggaacaccaaggagaacaaggactgtgagatgcccaccctggagcctggaaatgtcatcagcatcctgatcagcagcgagttcctgaagatggacagcctggtggagcagtgcatccagtactgccacaagaacatgaatgccatcgtggccaccccctgcaacatgaactgcatcaatgccaacctgctgaccagaattgctgacctcttcagccacaatgaggtggatgacctgaaggacaagaaggacaagttcaagagcaagctgttctgcaagaagattgaaagactctttgatcctgagtacctgaacccagacagccgcagcaatgctgccaccctgtaccgctgctgcctgtgcaagaagctgctgaccaaggagacagagcggcgcatcccctgcatccctgggaagatcaacgtggacagaagaggcaacatcgtgtacatccacatccgggacaagacctgggatgtgcatgagtacctgaacagcctgtttgaggagctgaagtcctggagagatgtgtactggaggctgtggggcaccatcaactggctgacctgcagccgctgctaccaggccttcctgtgcatcgagttcagccactgccagtaccacagcgagaccgtggtgtaccccacagctgccagcagcctgaacacagtgggcaccggcatctacccctgctgcaaccagaaggtgctgcgctttgaccccacccagctgaccaagggctgcaaggtgcgggaccacatggtgaccctgcgggaccagggcgagggcggggacctgcccagctgccccacagccaggatgctggatgacctgcacaagtacagagatgtgattgtggtgcccttcagcaaggacacagtgtctgatgtgggcgtgggcctgtgtgatgagaagggcattgaatgtgatgtgctgctggagcccaacaccccctggggccccaagacaggagagctgaatgccttcctgagcctgaagaactggaccctgcagctgaagcagcagagcctcttcagcgaggaggaggagtacaccaccggcagcgaggtgacagaagatgaggtgggagatgaggaggaggtgtccaagaagcagaggaagaaggagaagcccaagaagttcacccggcagcccaagaagcaggtgagcagcccctgtgcccagaggaaggagaaggccctggagaagagcgccagcagagatgtgagcccctttgtgatgtccatgcagaagaacaagtgggatgccaccaggagcctgcgcttcaaccaggatgcccagagagaagatgaccagaggaggatgacagagatcaccggccacctgatcaagatgaggctgggggacctggacagagtgaagagcaaggaggccaaggagtttgctgggggcatctacagccggctggaggcccagatcaaggcctctgtgcctgtgtctgcccggcagagcagcagcgagaagaacaccaggagcaagagccgcttcggccagggccgcccagcctag

SEQ ID NO: 41162 - DNA, 942 bp, Artificial Sequence
  Description of Artificial Sequence: Synthetic coding sequence
atgcaggaggctgatgccagcatcaagacagctgagaccaagggccgcacctggaagtaccagaacatcgagcccggcggcggcccccagaccagcggcaagggcggcttcggcagcctggtgctggtgttcctgggccagagggtgggctgcaatgagaccggctccatgaacctggagaagctgcagacccggcccaacatgaccatcttcaccaggaacaacatcgccaccaacttcagcagcagcagcagcagcagctacttcagccccccacctcctcctgtgctgctgcccctgctgctgctgctgccccagctgttcagcagcagcagcagcagcttcttcttctccttcagccccagcaccagccccctggtgagcccctgcttcttcagcagcagcagcagcttctgcttctctgtgtccctgctgcccagcagcagccccacctccatgaccaagttccccaaggctgtgaccaccaagatcaagacagacaagagggacctgatcaagctgaagggcttctgcacagccaaggagaccatcaacagaaccaaccggcagcccatcgagtgggagaagatcttcaccaactatgccagcaacaagggcctcatcagccgcatctacaaggagctgggccagagcgacaagcagaggcccaacaaccccatcaagaagtgggccaaggacatgaacagacacttcagcaaagaagacatccaggtggccaacaagcatgagaagatgctgagcaccagcctcatcatcggcaagatgcagatcaagaccaccgtgcgctaccacctgatgcctgccaggaaggccaccatcaagaagtctgagaacaaccgctgctggcagggctgccggggcaagggcaccttcacccactgctggagcaagtgcaagctgaagtgcaagtgcaagatgtag

SEQ ID NO: 41163 - DNA, 864 bp, Artificial Sequence
  Description of Artificial Sequence: Synthetic coding sequence
gtcttcttcctgaccggcatccctggcctggagacccggcagatctggaccagcatccccttctgctgcctgtatgtgattgccatctctggaaatggcatgatcctgtttgtgatcatcacagagagcagcctgcacgagcccatgtaccacttcctgtccatgctgtccttcatggacctgggcctgtgcctgagcaccctgaccaccatgctgggcatcttctggttcaatgcccgggagatcagctttgatgcctgcatcggccagatgttcttcatccacggcttcaccttcatggagagctctgtgctgctggccatggcctttgaccgcttcatcgctgtgtgcaaccccctgcgctatgccaccatcctgaccaacagccgcatcatcaaggtgggctttgccatcgtgctgcggggcaccacagccctggtgcccctgctgctgctgctgaagaggctgtccttctgccgcagccacgtgctgcaccacagctactgcttccacccagatgccatgaagctgagctgcacagacacctggatcaacagcgccttcggcctggccatcgtcatcagcacagctggcctggacagcgtgctgatcctgatctcctatgtgctgattgtgcgctctgtgctgtgcatcgccagccctgaggagcagaagaaggccttcggcacctgtgtgagccacatctctgctgtggccatcttctacatccccatgatcagcctgagccctgtgcacagatttgggaagcacgccccacccctggtgcacatgctgattgccaacgtgtacctgctgatcccccctgtgatgaaccccatcatctacagcgtgaagaccaagtag

SEQ ID NO: 41164 - DNA, 396 bp, Artificial Sequence
  Description of Artificial Sequence: Synthetic coding sequence
atgaggaagcccaggagagctggctgggagaccctgagcaggaaggcccctggccccagcgctggcctgcggcccagccctgccacctgtgacacctgccacttccccatcctgggagatggaaatgccaccctgccctttgcccctgggaagaccagccgggtgcccagcgacagcggggtcttcagcagtgacccccgggccaactggagcagcatccggaacttccccagcgccaagtgtgtgggcatcgagctgcacgccagcctgagcaccagcgctgagtggctgctgcggggccggggcggggccctgccctggatcgtgcgctgcctggccgccacagacctgctgctgcccgggaagaagggcgtggagagctgccctgtgggctag

SEQ ID NO: 41165 - DNA, 5421 bp, Artificial Sequence
  Description of Artificial Sequence: Synthetic coding sequence
atggccaccagggtggaggtgggcagcatcacccccctgacagctgtgcccggcctgggggagatgggcaaggaggagaccctgaccaggacctacttcctgcaggccggggaggccagcggggcccccccagcccgcatcctggaggccaagagccccctgcggagccctgcccggctgctgcccctgccccggctggcccccaagcccttcagcaaggagcaggatgtgaagagccctgtgcccagcctgcggcccagcagcacaggccccagccccagcggcggcctgtctgaggagcctgctgccaaggacctggacaacaggatgcctggcctggtgggccaggaggtgggcagcggggagggccccaggaccagcagccccctcttcaacaaggctgtgttcctgcggcccagcagcagcaccatgatcctgtttgagaccaccaagagcggccctgccctgggcaaggctgtgtctgagggcgctgaggaggccaagctgggcgtgtctggcagcaggcctgaggtggccgccaagccagccctgcccacccagaagccagctggcaccctgcccaggtctgcccccctgagccaggacaccaagccccctgtgccccaggaggaggccggccaggaccacccccccagcaaggccagctctgtggaggacacagcccggcccctggtggagccccggccccggctgaagaggaggcctgtgtctgccatcttcacagagagcatccagccccagaagccaggccctggagctgctgccaccgtgggcaaggtgccccccaccccacctgagaagacctgggtgaggaagccccggcccctgtccatggacctgacagccaggtttgagaacaaggaggccctgctgaggaaggtggctgatgagggcagcggccccacagctggggacatggccggcctggagcggcccagggctgccagcaagctggaccgggactgcctggtgaaggccgaggcccccctgcatgaccctgacctggacttcctggaggtggccaagaagatccgggagaggaaggagaagatgctgagcaagccagagatgggcagcccccgggccctggtgggcggcagcagtggagtgacccccagcaatgaccagagcccctgggaggagaaggccaagctggaccctgagcctgagaaggctgctgagagccccagcccccggctgggccggggcctggagctggccgaggtgaagagccgggtggctgatggagaggccgctgctggaggagagtgggccagccgccgctctgtgaggaagtgcatcagcctcttccgggaggacagcaccctggccctggccgtgggcagcgagagccccctggccaccccagccagccccagcgctgcccctgagcctgagaagggcgtggtgtctgtgcaggagcgcatccggggctggacagctgagagcagcgaggccaagccagaggtgagaagaaggaccttccaggcccggcccctgtctgctgacctgaccaagctgttcagcagcagcgccagcagcaatgaggtgaagtatgagaagtctgctgagctgtctggagagttccccaaggagccccgggagaagcagaaggagggccacagcctggatggagcctgcatccccaggagcccctggaagccaggcaccctgcgggacaagagccggcagacagagcagaaggtgagcagcaaccaggaccctgacagctgccggggcggcagctctgtggaggccccctgccccagtgatgtgaccccagaagatgacaggagcttccagacagtgtgggccaccgtgtttgagcaccacgtggagcggcacacagtggccgaccagagcggccgctgcctgagcaccaccccacctggggacatggcccacgcccgggtgtctgagccccggcccaggcctgagatgggctcctggctgggccgggaccccccagacatgaccaagctgaagaaggagaacagccggggctttgacaaccctgagacagagaagctgggccccaccaccctgctgaatggagagctgcggccctaccacacccccctgcgggacaagtaccccctgtctgagaaccacaacaacaacaccttcctgaagcacctggagaacccccccaccagccagagaattgagcccaggtatgacatcgtgcatgctgtgggggagcgggtgcacagcgaggccatcagccctgcccctgaggagaaggctgtgaccctgcggagcctgcgctcctggctgagcctgaaggaccggcagctgagccaggaggtgaccccagctgacctggagtgtggcctggagggccaggccggctctgtgcagagggccagcctcatctgggaggcccggggcatgcctgaggccagcggccccaagtttggaggcaactgccccttccccaagtggacaggaggagctgtggtgagcagccacaaggccaccgtggccgtgtctgaggagcactgtgcccctggggccacctctgtgcgggccatcaaggccgccatctgggagagccagcacgagggccctgagggcgcccggagcaagccaggagtgggcgcccggggccccccccagggctgccccctggaccccctgagccgggccaccaacggccccagcgacagccaggcccggacccacccagatgcctttgctgtgcagaagggccccttcatcgtggccgcccgggagggggaccccggccctgcccaggtgccccagcctgctgtgaggatgaggaaggccggggccatggaccagaggatggaccgctggaggaggaggaccctgcccccaaatgtgaagtttgacaccttcagcagcctggtgcctgaggacagcccccacgtgggccacagaagaacagattatgtgagccccacagccagcgccctgaggaagccccagctgagccactacagagtggagacccaggaggtgaaccctggggccagccgggaccagaccagccctgctgtgaagcagggcagccctgtggagcccaaggccaccttctttgctgtgacctaccagatccccaacacccagaaggccaagggcgtggtgctgagcggggctgagagcctgctggagcacagcaggaagatcaccccacccagcagcccccacagcctgaccagcaccctggtgtccctgggccacgaggaggccctggagatggccggcagcaagaactggatgaagggccgggagcatgaaaatgccagcatcctgaagaccctgaagcccacagaccggcccagcagcctgggcgcctggagcctggaccccttcaacggccgcatcattgatgtggatgccctgtggagccaccggggctctgaagatggcccccggccccagagcaactggaaggagagcgccaacaagatgagccccagcggcggggccccccagaccacccccaccctgcggagccggcccaaggacctgcctgtgcggaggaagacagatgtgatcagtgacaccttccctgggaagatcagagatggctaccgcagctctgtgctggacattgatgccctgatggccgagtaccaggagctgagcctgaaggtgcctggagaggcccaggagcggcgcagccccaccgtggagcccagcaccctgccccgggagaggcctgtgcagctgggcggcgtggagcagaggagaagaagcctgaaggagatgccagacaccggcggcctgtggaagccagccagcagcgctgagatcaaccacagcttcaccccaggcctgggcaagcagctggccgagaccctggagacagccatgggcaccaagagcagcccccccttctgggccctgccccccagcgcccccagcgagcgctacccaggcggcagccccatcccagctgaccccaggaagaagacaggctttgctgaagatgacaggaaggcctttgccagcaagcaccacgtggccaagtgccagaactacctggccgagagcaagcccagcggccgggaggaccccggcagcggcgtgcgggtgagccccaagagccccccaacagaccagaagaagggcacccccaggaagagcacaggccgcggggaggaggacagcgtggcccagtggggagaccacccccgggactgtggccgggtgcccctggacatcaagagggcctacagcgagaagggccccccagccaacatccgggagggcctgagcatcatgcatgaggcccgggagcggcggcgggagcagcccaagggccggcccagcctgactggagagaacctggaggccaagatgggcccctgctggtgggagagcggcaccggggacagccacaaggtgctgccccgggacctggagaaggaggatgccccccaggagaaggagcggcccctgcagcaggtgtcccctgtggcctctgtgccctggaggagccacagcttctgcaaggaccggcgcagcggcccctttgtggaccagctgaagcagtgcttcagccggcagcccacagagcccaaggacacagacaccctggtgcatgaggccggcagccagtatggcacctggacagagcagtgccagagcggggagagcctggccacagagagcccagacagcagcgccaccagcaccaggaagcagccccccagcagccggctgagcagcctgagcagccagacagagcccaccagcgctggggaccagtatgactgcagccgggaccagaggagcacctctgtggaccacagcagcacagacctggagagcacagatggcatggagggccccccacctccagatgcctgcccagagaagagggtggatgacttctccttcatcgaccagacctctgtgctggacagcagcgccctgaagaccagggtgcagctgagcaagaggagcagaagaagagcccccatcagccacagcctgcggcgcagccgcttcagcgagagcgagagccgcagccccctggaggatgaaacagacaacacctggatgttcaaggacagcacagaggagaagagccccaggaaggaggagagtgatgaggaggagacagccagcaaggccgagaggacccctgtgagccacccccagaggatgcctgccttccctggcatggaccctgctgtgctgaaggcccagctgcacaagaggcctgaggtggacagccctggagagacccccagctgggccccccagcccaagagccccaagagccccttccagcccggggtgctgggcagccgggtgctgcccagctccatggacaaggatgagaggagtgatgagcccagcccccagtggctgaaggagctgaagagcaagaagaggcagagcctgtatgagaaccaggtgtag

SEQ ID NO: 41166 - DNA, 741 bp, Artificial Sequence
  Description of Artificial Sequence: Synthetic coding sequence
atggccatcctgcccaaggtgatctaccgcttcaatgccatccccatcaagctgcccatgaccttcttcacagagctggagaagaccaccctgaagttcatctggaaccagaagagggcctgcatcaccaagagcatcctgcggcagaagaagaaggccggcggcatcaccctgcctgacttcaagctgtactacacagccaccgtgaccaagacagcctggtactggtaccagaacagagacatcgaccagtggaacagaacagagcccagcgagatcatgccccacatctacaactacctgatctttgacaagccagacaagaacaagcagtggggcaaggacagcctgagcaacaagtggtgctgggagaactggctggccatctgcaagaagctgaagctggaccccttcctgaccccctacaccaagatcaacagccgctggatcaaggacctgaacatccggcccaagaccatcaagaccctggaggagaacctgggcatcaccatccaggacatcggcatgggcaagcacttcatgagcaagacccccaaggccatggccaccaaggccaagattgacaagtgggacctgatcaagctgaagagcttctgcacagccaaggagaccaccatccgggtgaaccggcagcccacagagtgggagaagatcttcaccacctacagcagtgacaagggcctcatcagccgcatctacaatgagctgaagcagatctag

SEQ ID NO: 41167 - DNA, 63 bp, Artificial Sequence
  Description of Artificial Sequence: Synthetic coding sequence
atcatgcccctgtacagcagcagcggggacaggacccccatcagcaagaaccccaccaagtag

SEQ ID NO: 41168 - DNA, 867 bp, Artificial Sequence
  Description of Artificial Sequence: Synthetic coding sequence
atgtatgtgttccagctgtttgactactacagcgccagcggcaccaccctgctgtggcaggccttctgggagtgtgtggtggtggcctgggtgtatggagctgaccgcttcacagatgacatcgcctgcatgattggctaccggccctgcccctggatgaagtggtgctggagcttcttcacccccctggtgtgcatgggcatcttcatcttcaacgtggtgtactatgagcccctggtgtacaacaacaccaacgtgtacccctggtggggcgaggccatgggctgggcctttgtgctgagctccatgctgtgcatgcccctgcacctgctgggctgcctgctgcgggccaagggcaccatggccgagtgctggaagcacctgacccagcccatctggggcctgcaccacctggagtaccgggcccaggatgctgatgtgcggggcctgaccaccctgacccctgtgtctgagagcagcaaggtggtggtggtggagagcgtgatgggccagctgagcagccaccaccagctgaccagcggcctgtggggcaagaggctgcagtacagcatcctgggcgtgtgggccgccaacctggcctgcagcggcttccccccctgtgccctgggctgggcccagccccaggagggcaccccagacacagcccccaccagccggctgaaggcagatgccctgcctgcccctcctgtgttctgtgtggccgccctgacccacgtgtgcctgagcaggcctgtgccccggcggctgagtgaccccaagaagggcttcccagacaccaggacagaggccggcggcctgggcctgcgggagggcggcggccctgctggcaccttcctgctgtgctag

SEQ ID NO: 41169 - DNA, 666 bp, Artificial Sequence
  Description of Artificial Sequence: Synthetic coding sequence
gccaggagaagaggagctgctgctgccctgagccgggcccgggtgtggggccgcctgtacccccagcccaagctgcaggaggccgcccccctgccccggcggggctgggatggcggcggccacgtgggcggcggcggagatgcccggggcccccggctggagggggagagcctgccccacccccggctggccccagctgcccccagcgccagccctgccctggcccaccccctggtggcccacccagcccggctggacagcagcagaaatcctggcaccggcatctactttggaggcagcgctgcctggaggcctggcctgagccgggtgtcccaggacaggagccccaacagcagccggcccctgagcctgagcggcatcccagcagatgtgtccccaccagccaagacccgggaggagaagcgggagcccgccctgtggagccgggagaaggaggagggcgccacagccctgcaggaccacggctgggagaaggagtggaggggcttccgcaccttctctgtgcggctgcacgtgcctgtgttcatcagcggcagccaggccctgggctcctgggcccgcatcacctgctgcccccccctgtggagccggggctgcttctgcaaggagagcagcggccgggagagcatggcctgcctgacctag

SEQ ID NO: 41170 - DNA, 1023 bp, Artificial Sequence
  Description of Artificial Sequence: Synthetic coding sequence
atggcccgggacctgattggccctgccctgcccccaggcttcaaggcccggggcacagcagaagatgaggagcgggaccccagccctgtggccggccctgccctgccccccaactacaagagcagcagcagtgacagcagtgacagtgatgaggacagcagcagcctgtatgaggagggcaaccaggagagcgaggaggatgattctggccccacagccaggaagcagaggaagaaccaggatgatgatgatgatgatgatgatggcttctttggacctgccctgcccccaggcttcaagaagcaggatgacagccccccccggcccatcatcggccctgccctgcccccaggcttcatcaagagcacccagaagagtgacaagggcagagatgatcctggccagcaggagacagacagcagtgaagatgaggacatcatcggccccatgcctgccaagggccctgtgaactacaacgtgaccacagaatttgagaagagggcccagaggatgaaggagaagctgaccaagggagatgatgacagcagcaagcccatcgtgcgggagagctggatgacagagctgcccccagagatgaaggactttggcctgggccccaggaccttcaagagaagagcagatgacaccagcggggacaggagcatctggacagacaccccagctgaccgggagaggaaggccaaggagacccaggaggccaggaagagcagcagcaagaaggatgaggagcacatcctgagcggccgggacaagaggctggccgagcaggtgagcagctacaatgaaagcaagaggtctgagagcctgatggacatccaccacaagaagctgaagagcaaggctgctgaggacaagaacaagccccaggagcgcatcccctttgaccgggacaaggacctgaaggtgaacagatttgatgaggcccagaagaaggccctgatcaagaagagccgggagctgaacacccgcttcagccatggaaaaggaaacatgttcctgtag

SEQ ID NO: 41171 - DNA, 1200 bp, Artificial Sequence
  Description of Artificial Sequence: Synthetic coding sequence
atggagaggaagaaccccagccgggagagcccccggcggctgagcgccaaggtgggcaagggcacagagatgaagaaggtggcccggcagctgggcatggctgctgctgagagtgacaaggacagcggcttcagtgatggcagcagcgagtgcctgagcagcgctgagcagatggagagcgaggacatgctgagcgccctgggctggagccgggaggaccggccccggcagaacagcaagacagccaagaatgccttccccaccctgagccccatggtggtgatgaagaatgtgctggtgaagcagggcagcagcagcagccagctgcagagctggacagtgcagcccagctttgaggtgatcagcgcccagccccagctgctcttcctgcacccccctgtgcccagccctgtgagcccctgccacactggagagaagaagagtgacagcaggaactacctgcccatcctgaacagctacaccaagatcgccccccaccctgggaagaggggcctgagcctgggccctgaggagaagggcaccagcggcgtgcagaagaagatctgcacagagcggctgggccccagcctgagcagcagcgagcccaccaaggccggggctgtgcccagcagccccagcaccccagcccctccttctgccaagctggccgaggacagcgccctgcagggcgtgcccagcctggtggccggcggcagcccccagaccctgcagcctgtgagcagcagccacgtggccaaggcccccagcctgacctttgccagccctgccagccctgtgtgtgccagtgacagcaccctgcacggcctggagagcaacagccccctgagccccctgagcgccaactacagcagccccctgtgggccgctgagcacctgtgccgcagcccagacatcttcagcgagcagaggcagagcaagcaccggcgcttccagaacaccctggtggtgctgcacaagagcggcctgctggagatcaccctgaagaccaaggagctgatccggcagaaccaggccacccaggtggagctggaccagctgaaggagcagacccagctgttcatcgaggccaccaagagccgggccccccaggcctgggccaagctgcaggccagcctgaccccaggcagcagcaacacaggcagtgacctggaggccttcagtgaccacccagccatctag

SEQ ID NO: 41172 - DNA, 315 bp, Artificial Sequence
  Description of Artificial Sequence: Synthetic coding sequence
acctgcatctccttcttcctgttcctgaagaagagcctggccctgctgccccggctggagtacagcggcaccatcctggcccactgcaacctgtgcctgctgggcagcagcaacagccacgccagcgccagccaggtggccggcatcaccggcatgtgccaccacgtgtggctgatctttgtgttcctggtggagaccggcttccaccacgtggcccaggccggcctggagctgctggtgagcagcagcagccctgccctggccagccagagcacagagatcaccggcatgagccagtgtgcctggcccctgtag

SEQ ID NO: 41173 - DNA, 303 bp, Artificial Sequence
  Description of Artificial Sequence: Synthetic coding sequence
tgtgagaccccccggctgcctgagatcgccctgcgggccctgcccaggcctggggtgagcagcctgggcaccatcctgtgtgtgcccagcgtgcctgtgggccccatcgtgctgaccagcgccaccccagagagcagccgcttcaccaggcctgcccccagcacagtgcctgaggcccaccgccacagccgcatcctgcggctggcccctgtgccctgccgctgctaccggcccccagccccagcccacaccagccgcagcaccagcctcttctatgagagccccagcaccttcaacgtgtag

SEQ ID NO: 41174 - DNA, 201 bp, Artificial Sequence
  Description of Artificial Sequence: Synthetic coding sequence
accaggaacctgtgggtgttcttcttcttcttctttgaaacagagagctgcagcgtggcccaggccggcgtgcagtgggcccagagccggctgaccacagccagccctggctgcaagcagttcagctgcctgagcctgctgagctcctgggactacagacatgccccaccccacccagccaactactgcatctttgtgtag

SEQ ID NO: 41175 - DNA, 261 bp, Artificial Sequence
  Description of Artificial Sequence: Synthetic coding sequence
gtcatctgccccccctggccacccaaggtgctgggcctgcaggccaagtaccacctgcacaaccacaagttctttgtgctgcggcgcagcctggccctgctgccccggctggagtgcagcggggctgtgctggcccactgcaacctgtgcctgcccagcagcagcaacagccctgccagcgccagccgggtggccggcatcaccggcagctgccaccacaccaggctcatcttctgcatcttcagccgggagggcgtgtag

SEQ ID NO: 41176 - DNA, 252 bp, Artificial Sequence
  Description of Artificial Sequence: Synthetic coding sequence
atcagcgcccactgcaacctgtgcctgcccggcagcagtgacagcagcgccagcgccagcagaattgctggcatcaccggggcccaccaccacaccaggctcatctttgtgttcctggtggagacagagttccaccacgtgggccaggccggcctgaagtggccccaggtgatccaccccccctggccacccaagtgctgggactaccgccgggagccccccaggcctgccctcttcttcaacttcctgtag

SEQ ID NO: 41177 - DNA, 318 bp, Artificial Sequence
  Description of Artificial Sequence: Synthetic coding sequence
ctgctgccccggctggactgcagcggcaccatcagcgcccactgcaacctgccccgcttcaagcgcttcagctgcctgcggctgcccaccggcatcactggagcctaccaccacacctggatcatctttgccttcctggtggagaccggcttccaccacgtgggccaggccggcctgaagctgctgaccagcgagcagctgggcaacaccaagagccgcagccggcccccaggctggagcgccatggcccccagctggctgacagccagcagcgccagccgggtgcacgtgatcctgctgccccagcccccagagtag

SEQ ID NO: 41178 - DNA, 348 bp, Artificial Sequence
  Description of Artificial Sequence: Synthetic coding sequence
atgagcaagtgctgtgcccagagcctgaatgtgccccaccccagcgagggcagcgagaacatcacccaggactacctggagaagaactggtacctgcagaggaacacccagaacacagagatcaagggccctgggggcaaggtgaacaaccccccccacccccggctgaccttccctggggtggtgtctgagcccccagagggcggccgggtgcccaaggtgctgaagctggcccccagcgccaagaacctggtgaaggccaccaagagcctgaccatccccatgatcagcatcaagcaccccccaggagtgcggctgtggagctggggccgccgcttcatcacctag

SEQ ID NO: 41179 - DNA, 2436 bp, Artificial Sequence
  Description of Artificial Sequence: Synthetic coding sequence
atgaaggcccggacccggcccctgcgggccagccatgacatcgtgcccaccatcacccagggcagcagagatggccacaggagccctgcccgggaccccaggaccaccccagcctgccgggacagcctgcagaatggccacaccagtgacagcagcagtggagagagcagcggcggccaccggccccggcggggccccagccccagccacgtgcgctttgaagatgaaagtgcccgggaggccgagttccgccacctggagcggctgcagcagaggcagaggcaggtgctgagcacagtgctgcaggccgctgaccagggccccctgcggagcaagccagacctggccgactacatcaacggggccccccggctgagagatgctggccagggcaccttccaccggctggtgggcagcctggaccggcggggccacccagcccccccagcccctggcagcgagcggcgctgccaggcctgtggcagctgcattgatgaccccaggcctgcccagggcaaggcccctcctgtgcccaggaccctgcaggagctgcaggccgcctgtggcatggagcgggtgctgggcggcctgagcagccccctgcggctgctgcctgctgagccccggctgcacatggagtggatccgggagacccacatcggggacacagtgtgcccagctgaggtggacagcgccctggacagcacagacaacagcgacaactgcaggacagacagcgaggaggccggcaccagccaggccggctgggcctgtggccgcacccagggcagcagcccccggctgcggctgcggggcagccggccccggggccaccgctggagcaagaaggccgaggccgagctgccctggggcctgcaggcccagcagcacctgcccagggcagatgatgtggaggtggagaatgaggtgaaggagggccggggccacaccccagagggcaccctcttcctgcgggaggatgccaagcccccagacctggagctgaagagggtgtccctgggcccccagtggcagcccggccctggcctgggcagccaccagccccaccccctggacagcaggaccccctgcaggacagcctatgccaccacagcccccatgaccccagagagcagcggccctgggggccaggcccaggtgacagagagccatgagagcctggagatcgtgagccccagcagcctgcagcagagccatgctgagcccagcgccccccaccaggcctggcagcccacagccagcctgtgcccagagggctgggcccccaccccaccacccagcaggaagaccaccagccctgtgagccacaggaaggccgccctggccggcctgctgcggctgggggaccagacagagcctgtgggcatcccccggccccccagccgctctgctgtgctgcggacctgtgagctgccccccagccagacccagcccagccggccccaggtgcgccaccccctgctggccctgagcaccaacaactgcaacaacagcgccccccggggcctgcaggagccctacggcggcgctgtgcatgagggccgggtggagcggggcccctgcagccgggagcctgagccccccctggagaacagcagagatggcggcccccagggcttcctgggcagcgcagatgtggccaccatcaacagcacaggcatcaccctgagcctgagcagcgaggagagcgagagcagcaaggagagcgagggcagcctgcagaggactggaagtggcagcggcggccacgtgctgagccgggccagcgctggagctggcactggacctggcagccccagcgctgcccccctggaccagaacaagaagaggagcagcagcatcgccagcaccctgggcctgaagaagctgttcagcgccctgggccagagcagccggcccaagctgggcaagagccgcagctacagcgtggagcagctgcagcctgcccctcctggcctgaccagccagagccgggcccccagcctgcagagcctgcaccctgtgagccccagccaccagaggaggaaggccgccagcttccagaacctgcacagcctgctgagcagcaaaggaaacagaagcagcctgtacctggtggccggccctggggaccacagcgctgctggccggcctgccaagaccagcccccggcgggccctgtctgtggaggatgtgggcgcccccagcctggccaggacagtgggccgcctggtggaggtgtttcctgatggcaccagccagctgcagctgcagaggagccctgggggcaccttcggcttctgtgtggccagcggaaatggccgcccagacagcggcatgcccagccccctgccccagccccacggctggggcggcctgagcaagcagggccgggccttctggctgtggagcgaggccttcctggtgtttggatag

SEQ ID NO: 41180 - DNA, 3573 bp, Artificial Sequence
  Description of Artificial Sequence: Synthetic coding sequence
atggagggcacagaggccgccgccgccaagccagctgggggcagcccccagggccccaagacaggcagcggcacagccagccctgtggagggcaccagcgctgtggagtggagcggccctgagccccagctggacaatggccaccccccccggccctggccctgcccccaggagaacagaaccagcagcctgatggccccccagcccccccgggtgtggggcgtgcagctgcagggccccagcgtgctggagagcaaggtgcgggccctgaaggagaagatgacagtggccaagcagggcgtgagcccctgcagcgccagccaggagtggagcagccccaagaagccccagtgcagaagaggcaaggccggccgggccggcacccccagcgagggcagcttcctgcccggggctgtggtggcccccaggacccagaacctgcctgatggccagctggatggcagcatcaatgaggagcagcctgccagagatggcggcccccggctgccccggcccccagcccctggccgggagtactgcaacagaggcagcccctggcccccagaggccgagtggaccctgcctgaccatgaccggggccccctgctgggccccagcagcctgcagcagagccccatccacggcgtgaccccaggccggcctgggggccctggccactgcaacaagatcatccacatccccagccccaggacaggccgcagctaccccttcccagatggagtggtgacagaggccgacctggacagcaccagcctgaccagcgaggaggtgtttgtgcccaggacagccctgctgggggagcgctggagggctggggacctggaggccctgggcgccggcagctctgtgctgagcctgagtgacagagtggagaggaaccggctgctgctgcaggagatgctgaatgtgtctggccagagccccaggaaggtgggcaccccagcctggacccccagctgggacacagctgcccctgagaggcctgtgggagatgtggactgggccagcggcaccagcctgcaggacagcggccagaacagaacagtgggccccaaccctgagcctgtgctgagccccaggcatgaggaggccacccacctgctgcagagggccaggatgaaggcccggacccggcccctgcgggccagccatgacatcgtgcccaccatcacccagggcagcagagatggccacaggagccctgcccgggaccccaggaccaccccagcctgccgggacagcctgcagaatggccacaccagtgacagcagcagcggggagagcagcggcggccaccggccccggcggggccccagccccagccacgtgcgctttgaagatgagagcgcccgggaggccgagttccgccacctggagcggctgcagcagaggcagaggcaggtgctgagcacagtgctgcaggccgctgaccagggccccctgcggagcaagccagacctggccgactacatcaatggagccccccggctgagagatgctggccagggcaccttccaccggctggtgggcagcctggacagaagaggccacccagcccccccagcccctggcagcgagcggcgctgccaggcctgtggcagctgcattgatgaccccaggcctgcccagggcaaggcccctcctgtgcccaggaccctgcaggagctgcaggccgcctgtggcatggagcgggtgctgggcggcctgagcagccccctgcggctgctgcctgctgagccccggctgcacatggagtggatccgggagacccacatcggggacacagtgtgcccagctgaggtggacagcgccctggacagcacagacaacagcgacaactgcaggacagattctgaggaggccggcaccagccaggccggctgggcctgtggccgcacccagggcagcagcccccggctgcggctgcggggcagccggccccggggccaccgctggagcaagaaggccgaggccgagctgccctggggcctgcaggcccagcagcacctgcccagggcagatgatgtggaggtggagaatgaggtgaaggagggccggggccacaccccagagggcaccctcttcctgagagaagatgccaagcccccagacctggagctgaagagggtgtccctgggcccccagtggcagcccggccctggcctgggcagccaccagccccaccccctggacagcaggaccccctgcaggacagcctatgccaccacagcccccatgaccccagagagcagcggccctgggggccaggcccaggtgacagagagccatgagagcctggagatcgtgagccccagcagcctgcagcagagccacgccgagcccagcgccccccaccaggcctggcagcccacagccagcctgtgcccagagggctgggcccccaccccaccacccagcaggaagaccaccagccctgtgagccacaggaaggccgccctggccggcctgctgcggctgggggaccagacagagcctgtgggcatccccaggcctcccagccgctctgctgtgctgcggacctgtgagctgccccccagccagacccagcccagccggccccaggtgcgccaccccctgctggccctgagcaccaacaactgcaacaacagcgccccccggggcctgcaggagccctatggaggagctgtgcatgagggccgggtggagcggggcccctgcagccgggagcctgagccccccctggagaacagcagagatggcggcccccagggcttcctgggcagcgcagatgtggccaccatcaacagcacaggcatcaccctgagcctgagcagcgaggagagcgagagcagcaaggagagcgagggcagcctgcagaggacaggcagcggcagcggcggccacgtgctgagccgggccagcgctggggccggcaccggccctggcagccccagcgctgcccccctggaccagaacaagaagaggagcagcagcatcgccagcaccctgggcctgaagaagctgttcagcgccctgggccagagcagccggcccaagctgggcaagagccgcagctacagcgtggagcagctgcagcctgcccctcctggcctgaccagccagagccgggcccccagcctgcagagcctgcaccctgtgagccccagccaccagaggaggaaggccgccagcttccagaacctgcacagcctgctgagcagcaagggcaacagaagcagcctgtacctggtggccggccctggggaccacagcgctgctggccgcccagccaagaccagcccccggcgggccctgtctgtggaggatgtgggcgcccccagcctggccaggacagtgggccgcctggtggaggtgtttcctgatggcaccagccagctgcagctgcagaggagccctgggggcaccttcggcttctgtgtggccagcggaaatggccgcccagattctggcatgcccagccccctgccccagccccacggctggggcggcctgagcaagcagggccgggccttctggctgtggagcgaggccttcctggtgtttggatag

SEQ ID NO: 41181 - DNA, 405 bp, Artificial Sequence
  Description of Artificial Sequence: Synthetic coding sequence
atgatccctgtgcggggcctgtggtactgctacctgcaggtgaagaaggtgcggctgcgggaggccgagcggctgggccccaagagccagtgcccagcagaatgtggggccgcctcctggatctcctgggtgctgcagcaccagcagctgctggccagcgagtgggccaccaaggatggccggggcacctggggcagcaagcccagctgcaccgtgcctgccctgagcgccaccagccagctgctgcagctgggccgcctgaacagcgacctgcagtttgtgcggcagagggccaagaagtctgtgagcagccccagcctgctgcagttctggtgctgcctgagccggctgtccttccacgccctgaaccagaagatcaacagcaccaacatcaacatcacctag

SEQ ID NO: 41182 - DNA, 1155 bp, Artificial Sequence
  Description of Artificial Sequence: Synthetic coding sequence
atgtctgctggcagcgccacccaccctggagctgggggccgccgcagcaagtgggaccagcctgccccagcccccctgctcttcctgcccccagctgcccctggaggagaggtgaccagcagcggcggcagccctgggggcaccacagctgcccccagcggggccctggatgctgctgctgctgtggccgccaagatcaatgccatgctgatggccaagggcaagctgaagcccacccagaatgccagcgagaagctgcaggcccctgggaagggcctgaccagcaacaagagcaaggatgacctggtggtggccgaggtggagatcaatgatgtgcccctgacctgcaggaacctgctgacccggggccagacccaggatgagatcagccggctgtctggagctgctgtgtccacccggggccgcttcatgaccacagaggagaaggccaaggtgggccctggggaccggcccctgtacctgcacgtgcagggccagacccgggagctggtggacagagctgtgaaccgcatcaaggagatcatcaccaacggggtggtgaaggccgccaccggcaccagccccaccttcaacggggccaccgtgacagtgtaccaccagcctgcccccatcgcccagctgagccctgctgtgtcccagaagccacccttccagagcggcatgcactacgtgcaggacaagctgtttgtgggcctggagcacgctgtgcccaccttcaacgtgaaggagaaggtggagggccctggctgcagctacctgcagcacatccagattgaaacaggagccaaggtgttcctgcggggcaagggcagcggctgcattgaaccagccagcggccgggaggcctttgagcccatgtacatctacatcagccaccccaagccagagggcctggccgccgccaagaagctgtgtgagaacctgctgcagacagtgcatgctgagtacagcagatttgtgaaccagatcaacacagctgtgcccctgcctgctgccagcagcaccagcctgcggagcaccaagcacagcgccaccagctgcttcatcagcacctggagcctggccggcatcacctactggagccccacctgtgccaacaccatcccagacaacaccagcgctgccagcagctag

SEQ ID NO: 41183 - DNA, 1695 bp, Artificial Sequence
  Description of Artificial Sequence: Synthetic coding sequence
atgtctgctggcagcgccacccaccctggagctgggggccgccgcagcaagtgggaccagcctgccccagcccccctgctcttcctgcccccagctgcccctggaggagaggtgaccagcagcggcggcagccctgggggcaccacagctgcccccagcggggccctggatgctgctgctgctgtggccgccaagatcaatgccatgctgatggccaagggcaagctgaagcccacccagaatgccagcgagaagctgcaggcccctgggaagggcctgaccagcaacaagagcaaggatgacctggtggtggccgaggtggagatcaatgatgtgcccctgacctgcaggaacctgctgacccggggccagacccaggatgagatcagccggctgtctggagctgctgtgtccacccggggccgcttcatgaccacagaggagaaggccaaggtgggccctggggaccggcccctgtacctgcacgtgcagggccagacccgggagctggtggacagagctgtgaaccgcatcaaggagatcatcaccaacggggtggtgaaggccgccaccggcaccagccccaccttcaacggggccaccgtgacagtgtaccaccagcctgcccccatcgcccagctgagccctgctgtgtcccagaagccacccttccagagcggcatgcactacgtgcaggacaagctgtttgtgggcctggagcacgctgtgcccaccttcaacgtgaaggagaaggtggagggccctggctgcagctacctgcagcacatccagattgaaacaggagccaaggtgttcctgcggggcaagggcagcggctgcattgaaccagccagcggccgggaggcctttgagcccatgtacatctacatcagccaccccaagccagagggcctggccgccgccaagaagctgtgtgagaacctgctgcagacagtgcatgctgagtacagcagatttgtgaaccagatcaacacagctgtgcccctgcccggctacacccagcccagcgccatcagctctgtgcccccccagcccccctactaccccagcaatggctaccagagcggctaccctgtggtgcccccaccccagcagcctgtgcagcccccctacggcgtgcccagcatcgtgcccccagctgtgtccctggcccctggggtgctgcctgccctgcccaccggggtgccccctgtgcccacccagtaccccatcacccaggtgcagcccccagccagcacaggccagagccccatgggcggccccttcatcccagctgcccctgtgaagacagccctgcctgctggcccccagccccagccccagccccagccccccctgcccagccagccccaggcccagaagaggcgcttcacagaggagctgcctgatgagcgggagagcggcctgctgggctaccagcacggccccatccacatgaccaacctgggcaccggcttcagcagccagaatgaaattgaaggagctggcagcaagccagccagcagcagcggcaaggagcgggagcgggaccggcagctgatgcctcctccagccttccctgtgacaggcatcaagacagaaagtgatgaaagaaatggaagtggcaccctgaccggcagccacggggagtgtgacattgctgggggcactggagagtggctgcggctggtgtag

SEQ ID NO: 41184 - DNA, 1845 bp, Artificial Sequence
  Description of Artificial Sequence: Synthetic coding sequence
atgtctgctggcagcgccacccaccctggagctgggggccgccgcagcaagtgggaccagcctgccccagcccccctgctcttcctgcccccagctgcccctggaggagaggtgaccagcagcggcggcagccctgggggcaccacagctgcccccagcggggccctggatgctgctgctgctgtggccgccaagatcaatgccatgctgatggccaagggcaagctgaagcccacccagaatgccagcgagaagctgcaggcccctgggaagggcctgaccagcaacaagagcaaggatgacctggtggtggccgaggtggagatcaatgatgtgcccctgacctgcaggaacctgctgacccggggccagacccaggatgagatcagccggctgtctggagctgctgtgtccacccggggccgcttcatgaccacagaggagaaggccaaggtgggccctggggaccggcccctgtacctgcacgtgcagggccagacccgggagctggtggacagagctgtgaaccgcatcaaggagatcatcaccaacggggtggtgaaggccgccaccggcaccagccccaccttcaacggggccaccgtgacagtgtaccaccagcctgcccccatcgcccagctgagccctgctgtgtcccagaagccacccttccagagcggcatgcactacgtgcaggacaagctgtttgtgggcctggagcacgctgtgcccaccttcaacgtgaaggagaaggtggagggccctggctgcagctacctgcagcacatccagattgaaacaggagccaaggtgttcctgcggggcaagggcagcggctgcattgaaccagccagcggccgggaggcctttgagcccatgtacatctacatcagccaccccaagccagagggcctggccgccgccaagaagctgtgtgagaacctgctgcagacagtgcatgctgagtacagcagatttgtgaaccagatcaacacagctgtgcccctgcccggctacacccagcccagcgccatcagctctgtgcccccccagcccccctactaccccagcaatggctaccagagcggctaccctgtggtgcccccaccccagcagcctgtgcagcccccctacggcgtgcccagcatcgtgcccccagctgtgtccctggcccctggggtgctgcctgccctgcccaccggggtgccccctgtgcccacccagtaccccatcacccaggtgcagcccccagccagcacaggccagagccccatgggcggccccttcatcccagctgcccctgtgaagacagccctgcctgctggcccccagccccagccccagccccagccccccctgcccagccagccccaggcccagaagaggcgcttcacagaggagctgcctgatgagcgggagagcggcctgctgggctaccagcacggccccatccacatgaccaacctgggcaccggcttcagcagccagaatgaaattgaaggagctggcagcaagccagccagcagcagcggcaaggagcgggagcgggaccggcagctgatgcctcctccagccttccctgtgacaggcatcaagacagaaagtgatgaaagaaatggaagtggcaccctgaccggcagccatgactacccagccaagaagatgaagaccacagagaagggcttcggcctggtggcctatgctgctgacagcagtgatgaggaggaggagcacggcggccacaagaatgccagcagcttcccccagggctggagcctgggctaccagtaccccagcagccagccccgggccaagcagcagatgcccttctggatggccccctag

SEQ ID NO: 41185 - DNA, 1581 bp, Artificial Sequence
  Description of Artificial Sequence: Synthetic coding sequence
atgatccagagccagatcagctttgaagatgtggccgtggacttcaccctggaggagtggcagctgctgaaccccacccagaagaacctgtacagagatgtgatgctggagaactacagcaacctggtgttcctggaggtgtggctggacaaccccaagatgtggctgcgggacaaccaggacaacctgaagtccatggagcggggccacaagtatgatgtgtttgggaagatcttcaacagcagcatcaacatcgtgcacgtgggcctgcggagccacaagtgtggcactggagagaagagcctgaagtgcccctttgacctgctgatccccaagaacaactgtgagaggaagaagattgatgagctgaacaagaagctgctcttctgcatcaagccaggccgcacccatggaggcatcaagtactgtgactgcagcacctgcaggaagagcagcaatgaggagccctggctgacagccaaccacatcacccacactggagtgtacctgtgcatggagtgtggccgcttcttcaacaagaagagccagctggtgatccaccagaggacccacactggagagaagccctaccagtgcagtgaatgtgggaaggccttcagccagaagagcctgctgactgtgcaccagaggacccacagcggggagaagccccacggctgcagcgagtgccagaaggccttcagcaggaagagcctgctgatcctgcaccagaggatccacactggagagaagccctacggctgcagtgaatgtgggaaggccttcagcaggaagagccagctgaagaggcaccagatcacccacaccatcgagaagccctacagctgcagtgaatgtgggaaggccttcagccagaagctgaagctgatcacccaccagagggcccacactggagagaagccctacccctgcagccactgtgggaaggccttcttctggaagagccagctgatcacccaccagaggacccacacaggcaagaagccctacggctgtggggagtgccagaaggccttcagcaggaacagcctgctgatccgccaccagaggatccacactggagagaagccctatgagtgcaatgaatgtggggaggccttcatcaggaagccccagctgatcaagcaccagatcacccacactggagagaagaactaccgctgcagcgactgtgaggaggccttcttcaagaagtctgagctgatccgccaccagaagatccacctgggggagaagccctacggctgcatccagtgtgggaagaccttcttcggcaagagccagctgctgacccaccacaggacccacactggagagaagccctatgagtgcagtgaatgtgggaaggccttcacccagaagagcagcctcatcagccaccagaggacccacactggagagaagccctatgagtgcagtgaatgtaggaagaccttcagcgagaagagcagcctcatccaccaccagaggacccacactggagagaagccctttgagtgcagtgaatgtaggaaggcctttgcctggaagccccagctgctgcggcaccagaggatctag

SEQ ID NO: 41186 - DNA, 4065 bp, Artificial Sequence
  Description of Artificial Sequence: Synthetic coding sequence
atgagcagcacagctgacctgctggacaccatcctgaaggccatcgaggagaacatcaccacagagaacagctgcagcctgctgatggccctggacaccctgctgaacagcgacagcaccaaggagatgggcttcacctgcaagatccaggccctgcgggacaagctgtggatcttcctggtgcagagcttctatgctgtgcgccacacagagagctggaagctgatgagcacagatgaccagcagaagatccaggccgccgcctttgataaaggagatgaccggcggctgggcaagaagcccatcttcagcagcagccagcagaggaagcaggtgtctgattctggggacatcaagatcaagtcctggaggggcaacaacaagaaggagtgctggagctacctgagcaccaacaagaagatgaagagtgatggcctgggcgccagcggccacagcagcagcaccaacagaaattccatcaacaagaccctgaagcaggatgatgtgaaggagaaggatggcaccaagatcgccagcaagatcaccaaggagctgaagacaggaggcaagaatgtgtctgggaagcccaagacagtgaccaagagcaagacagaaaatggagacaaggcccggctggagaacatgagcccccggcaggtggtggagaggtctgccacagctgctgctgctgccaccggccagaagaacctgctgaatggaaaaggagtgaggaaccaggagggccagatcagcggggcccggcccaaggtgctgactggaaacctgaatgtgcaggccaaggccaagcccctgaagaaggccaccgggaaggacagcccctgcctgagcattgctggccccagcagccgcagcacagacagctccatggagttcagcatcagcacagaatgtctggatgagcccaaggaaaatggcagcacagaggaggagaagcccagcggccacaagctgtccttctgtgacagccctggccagatgatgaagaacagcgtggacagcgtgaagaacagcacagtggccatcaagagcaggcctgtgtcccgggtgaccaacggcaccagcaacaagaagagcatccacgagcaggacaccaacgtgaacaacagcgtgctgaagaaggtgtctgggaagggctgcagcgagcctgtgccccaggccatcctgaagaagaggggcaccagcaatggctgcacagctgcccagcagaggaccaagagcacccccagcaacctgaccaagacccagggcagccagggcgagagccccaacagcgtgaagagctctgtgagcagccggcagagtgatgaaaatgtggccaagctggaccacaacaccaccacagagaagcaggcccccaagaggaagatggtgaagcaggtgcacacagccctgcccaaggtgaatgccaagatcgtggccatgcccaagaacctgaaccagagcaagaagggggagaccctgaacaacaaggacagcaagcagaagatgcctcctggccaggtgatcagcaagacccagcccagcagccagaggcccctgaagcatgagaccagcacagtgcagaagtccatgtttcatgatgtgcgggacaacaacaacaaggacagcgtgtctgagcagaagccccacaagcccctcatcaacctggccagcgagatcagtgatgctgaggccctgcagagcagctgcaggccagacccccagaagcccctgaatgaccaggagaaggagaagctggccctggagtgccagaacatcagcaagctggacaagagcctgaagcatgagctggagagcaagcagatctgcctggacaagtctgagaccaagttccccaaccacaaggagacagatgactgtgatgctgccaacatctgctgccacagcgtgggcagtgacaacgtgaacagcaagttctacagcaccacagccctgaagtacatggtgagcaaccccaatgaaaacagcctgaacagcaaccctgtgtgtgacctggacagcaccagcgctggccagatccacctgatcagtgaccgggagaaccaggtgggcaggaaggacaccaacaagcagagcagcatcaagtgtgtggaggatgtgtccctgtgcaaccctgagaggaccaacggcaccctgaacagcgcccaggaggacaagaagagcaaggtgcctgtggagggcctgaccatccccagcaagctgagtgatgaaagtgccatggatgaggacaagcacgccacagctgacagtgatgtgagcagcaagtgcttcagcggccagctgtctgagaagaacagccccaagaacatggagaccagcgagagccctgagagccatgagaccccagagaccccatttgtgggccactggaacctgagcactggagtgctgcaccagcgggagagccctgagagtgacaccggcagcgccaccaccagcagtgatgacatcaagcccaggagtgaagattatgatgctgggggcagccaggatgatgatggcagcaatgaccggggcatcagcaaatgtggcaccatgctgtgccacgacttcctgggccgcagcagcagtgacaccagcaccccagaggagctgaagatctatgacagcaacctgagaattgaggtgaagatgaagaagcagagcaacaatgacctcttccaggtgaacagcaccagtgatgatgagatccccaggaagaggcctgagatctggagccgcagcgccatcgtgcacagccgggagcgggagaacatcccccggggctctgtgcagtttgcccaggagattgaccaggtgagcagcagcgcagatgaaacagaagatgagaggtctgaggctgaaaatgtggccgagaacttcagcatcagcaacccagccccccagcagttccagggcatcatcaacctggcctttgaagatgccacagaaaatgaatgtcgggagttcagcgccaccaagaagttcaagaggtctgtgctgctgtctgtggatgaatgtgaggagctgggcagtgatgaaggagaggtgcacacccccttccaggcctctgtggacagcttcagccccagtgatgtgtttgatggcatcagccatgagcaccacggccgcacctgctacagccgcttcagccgggagagcgaggacaacatcctggagtgcaagcagaacaagggcaacagcgtgtgcaagaatgaaagcacagtgctggacctgagcagcattgacagcagcaggaagaacaagcagagcgtgtctgccacagagaagaagaacaccattgatgtgctgagcagccgcagccggcagctgctgcgggaggacaagaaggtgaacaacggcagcaatgtggagaatgacatccagcagaggagcaagttcctggacagtgatgtgaagagccaggagcggccctgccacctggacctgcaccagcgggagcccaacagcgacatccccaagaacagcagcaccaagagcctggacagcttccgcagccaggtgctgccccaggagggccctgtgaaggagagccacagcaccaccacagagaaggccaacatcgccctgtctgctggggacattgatgactgtgacaccctggcccagaccaggatgtatgaccaccggcccagcaagaccctgagccccatctatgagatggatgtgattgaggcctttgagcagaaggtggagagcgagacccacgtgacagacatggactttgaagatgaccagcactttgccaagcaggactggaccctgctgaagcagctgctgtctgagcaggacagcaacctggatgtgaccaacagcgtgcctgaggacctgagcctggcccagtacctgatcaaccagaccctgctgctggcccgggacagcagcaagccccagggcatcacccacatcgacaccctgaaccgctggagcgagctgaccagccccctggacagcagcgccagcatcaccatggccagcttcagcagcgaggactgcagcccccagggcgagtggaccatcctggagctggagacccagcactag

SEQ ID NO: 41187 - DNA, 2364 bp, Artificial Sequence
  Description of Artificial Sequence: Synthetic coding sequence
atgggagaccccggcagcgagatcattgaatctgtgcccccagctggccctgaggccagcgagagcaccacagatgaaaatgaagatgacatccagtttgtgtctgagggccccagcaggcctgtgctggagtacatcgacctggtgtgtggagatgatgagaaccccagcgcctactacagcgacatcctcttccccaagatgcccaagaggcagggcgacttcctgcacttcctgaatgtgaagaaggtgaagacagacacagaaaataatgaggtgtccaagaaccactgccgcctgagcaaggccaaggagccccactttgagtacatcgagcagcccatcatcgaggagaagcccagcctgagcagcaagaaggagattgacaacctggtgctgcctgactgctggaatgagaagcaggccttcatgttcacagagcagtacaagtggctggagatcaaggagggcaagctgggctgcaaggactgcagcgctgtgcgccacctgggcagcaaggccgagaagcacgtgcacgtgtccaaggagtggatcgcctacctggtgacccccaacggcagcaacaagaccacccggcaggccagcctgaggaagaagatccgggagcatgatgtgtccaaggcccacggcaagatccaggacctgctgaaggagagcaccaatgacagcatctgcaacctggtgcacaagcagaacaacaagaacattgatgccaccgtgaaggtgttcaacacagtgtacagcctggtgaagcacaaccggcccctgagtgacatcgagggcgcccgggagctgcaggagaagaatggagaggtgaactgcctgaacacccgctacagcgccaccagaattgctgagcacatcgccaaggagatgaagatgaagatcttcaagaacatcatcgaggagaatgccaagatctgcatcatcattgatgaggccagcacagtgtccaagaagaccaccctggtgatctacctgcagtgcaccatccagagcgccccagcccctgtgatgctgtttgtggccctgaaggagctggtgtccaccatcgccgagtgcatcgtgaacaccctgctgaccaccctgaatgactgtggcttcaccaatgagtacctgaaggccaacctgattgccttctgcagtgatggagccaacaccatcctgggcaggaagagcggcgtggccaccaagctgctggagaacttccctgagatcatcatctggaactgcctgaaccaccggctgcagctgagcctggatgacagcatcagcgagatcaagcagatcaaccacctgaagatcttcatcgacaagatctacagcatctaccaccagcccaacaagaaccagaccaagctgctgggcaccgtggccaaggagctggagacagagatcatcaagattggccgggtgatgggcccccgctgggccgcctgcagcctgcaggccgccacagctgtgtggcacgcctaccccatcctgtacatgcacttcagccacagctacagcggcctggccaagaggctggccaacatcaacttcctgcaggacctggccctgatgattgacatcctggaggagttctctgtgctgagcacagccctgcagagccgcagcaccaacatcaagaaggcccagaagctgatcaagaggaccatccgggccctggagaacctgaagattggaacaggcaagtatgagagccagattgaagatctcatcaagagtgacaagttcaaggacatccccttcaacaagaacaacaagttcaatgccctgcccaggagcatcctgctggacaacatcatccagcacatgaacctgcggctgctgagtgacaggaaccacgaggacatcttcaactactttgacctgctggagcccagcacctggccctatgaggagatcaccagcccctggattgctggggagaagaccctcttccacctgtgcaagatcctgaagtatgaggtggacctgaatgacttccgggagtttgtgaacaacaacatcaagagcaacaacgtgtccatccccaccaccatctacaaggccaagaagatcgtgtccaccatcgccatcaacagcgctgaggccgagcggggcttcaacctgatgaacatcatctgcaccagggtgaggaacagcctgaccatcgaccacgtgtctgacctgatgaccatcaacctgctgggcaaggagctggccgactgggatgccaccccatttgtgaagtcctggagcaactgcaaccaccggctggccacagacaccagggtgcggcagaagagcaccaaggtgttccacgagaaccagctggccatctggaacctgaagtag

SEQ ID NO: 41188 - DNA, 636 bp, Artificial Sequence
  Description of Artificial Sequence: Synthetic coding sequence
atgcagctgggggagcacacccacccccagaagaaccccaagagcctggccggctgcctgctgcccaacccccacccccagctgcagctgcggggcaagagagctgctggcctgctgctgcggaggaacccctggaggcacccccaggcccctgggggcagcagcacctgggcccccagcctgccccccatcctggccccccaggcctacctgaactttgccccacccacccctgtgcctgggggcagccctggaacagaggcccagcctgtggccccagccaatgccctgggcagccgcagcaagctgaacctgacccagcccagctgcctgagcagcggcagccacctgcccctgcccttccctgctggcatgtgcccccacccagccaaccccacctgggccctgaggaaaggagctgaggtgccccagggcccccccctgagccacaccaggaaggccctgtgcctggccgccagcggcgtgggcgccctgctgctggaggtgcccaggcaccctggctggggccagcagagcgctgctggcttccagcaggtgttccaggagggcgccggcacccacttccccagcgtgcgggtgcagcccggccggggcaagctgcagggccagaggtag

SEQ ID NO: 41189 - DNA, 1488 bp, Artificial Sequence
  Description of Artificial Sequence: Synthetic coding sequence
atgaagaagaggaaggagctgaatgccctgattggcctggccggggacagcaggaggaagaagcccaagaagggccccagcagccaccggctgctgaggacagagcccccagacagcgacagcgagagcagcagcgaggaggaggaggagtttggagtggtgggcaacagaagcagatttgccaagggggactacctgcgctgctgcaagatctgctaccccctgtgtggcttcgtcatcctggccgcctgtgtggtggcctgtgtgggcctggtgtggatgcaggtggccctgaaggaggacctggatgccctgaaggagaagttccgcaccatggagagcaaccagaagagcagcttccaggagatccccaagctgaatgaggagctgctgagcaagcagaagcagctggagaagattgagagcggggagatgggcctgaacaaggtgtggatcaacatcacagagatgaacaagcagatcagcctgctgaccagcgctgtgaaccacctgaaggccaacgtgaagtctgctgctgacctgatcagcctgcccaccaccgtggagggcctgcagaagtctgtggccagcatcggcaacaccctgaacagcgtgcacctggccgtggaggccctgcagaagacagtggatgagcacaagaagaccatggagctgctgcagagcgacatgaaccagcacttcctgaaggagaccccaggcagcaaccagatcatccccagccccagcgccaccagcgagctggacaacaagacccacagcgagaacctgaagcaggacatcctgtacctgcacaacagcctggaggaggtgaacagcgccctggtgggctaccagaggcagaatgacctgaagctggagggcatgaatgagaccgtgagcaacctgacccagagggtgaacctgattgaaagtgatgtggtggccatgagcaaggtggagaagaaggccaacctgtccttctccatgatgggagacagaagtgccaccctgaagaggcagagcctggaccaggtgaccaacagaacagacacagtgaagatccagagcatcaagaaggaggacagcagcaacagccaggtgtccaagctgcgggagaagctgcagctgatcagcgccctgaccaacaagccagagagcaacagacctcctgagacagcagatgaggagcaggtggagagcttcaccagcaagcccagcgccctgcccaagttcagccagttcctgggggaccctgtggagaaggccgcccagctgcggcccatcagcctgcccggggtgagcagcacagaggacctgcaggacctcttcaggaagacaggccaggatgtggatggcaagctgacctaccaggagatctggaccagcctgggcagcgccatgcctgagcctgagagcctgcgggcctttgacagtgatggagatggccgctacagcttcctggagctgcgggtggccctgggcatctag

SEQ ID NO: 41190 - DNA, 345 bp, Artificial Sequence
  Description of Artificial Sequence: Synthetic coding sequence
atgtgtggctgggaggacagccagaagcccagcgtgcccagccacggccccaagacccccagctgcaagggcgtgaaggccccccacagcagccggccccgggcctggaagcaggacctggagcagagcctggccgccgcctacgtgcctgtggtggtggacagcaagggccagaacccagacaagctgcgcttcaacttctacaccagccagtacagcaacagcctgaaccccttctacaccctgcagaagcccacctgtggctacctgtaccgccgggacacagaccacaccaggaagagatttgatgtgcccccagccaacctggtgctgtggaggagctag

SEQ ID NO: 41191 - DNA, 324 bp, Artificial Sequence
  Description of Artificial Sequence: Synthetic coding sequence
atgtggctgagcccctggagcacctgccccccccaccccctgcccagctgcctgacagcctgctgcagccctgcccaccagcctgtgcggggcagcgcccagcccccagccagtgacctgtgcacctgtgtgacctgctgcagcggcccccaccccaactaccccccagcccacctgctgcccaccagcagcctgcccatctgccccggcctcatctgctgcctgctgacctgcctgctggtggactgcttcagcgccctgctgagcgcctgtgagacccgggacctgagcccctggaaggcccggcgggtgctgctgaggtag

SEQ ID NO: 41192 - DNA, 2499 bp, Artificial Sequence
  Description of Artificial Sequence: Synthetic coding sequence
atgggcaccacagccagcacagcccagcagacagtgtctgctggcaccccatttgagggcctgcagggcagcggcaccatggacagccgccacagcgtgtccatccacagcttccagagcaccagcctgcacaacagcaaggccaagagcatcatccccaacaaggtggcccctgtggtgatcacctacaactgcaaggaggagttccagatccatgatgagctgctgaaggcccactacaccctgggccgcctgagtgacaacaccccagagcactacctggtgcagggccgctacttcctggtgagagatgtgacagagaagatggatgtgctgggcaccgtgggcagctgtggggcccccaacttccggcaggtgcagggcggcctgactgtgtttggcatgggccagcccagcctgagcggcttccggcgggtgctgcagaagctgcagaaggatggccacagagaatgtgtgatcttctgtgtgcgggaggagcctgtgctcttcctgcgggcagatgaagattttgtgtcctacaccccccgggacaagcagaacctgcacgagaacctgcagggcctgggccctggggtgcgggtggagagcctggagctggccatcaggaaggagatccatgactttgcccagctgtctgagaacacctaccacgtgtaccacaacacagaggacctgtggggcgagccccatgctgtggccatccacggggaggatgacctgcacgtgacagaggaggtgtacaagaggcccctcttcctgcagcccacctaccgctaccaccggctgcccctgcctgagcagggcagccccctggaggcccagctggatgcctttgtgtctgtgctgcgggagacccccagcctgctgcagctgagagatgcccacggccccccaccagccctggtgttcagctgccagatgggcgtgggccgcaccaacctgggcatggtgctgggcaccctcatcctgctgcacaggagcggcaccaccagccagcctgaggccgcccccacccaggccaagcccctgcccatggagcagttccaggtgatccagagcttcctgaggatggtgccccagggccgcaggatggtggaggaggtggaccgggccatcacagcctgtgccgagctgcatgacctgaaggaggtggtgctggagaaccagaagaagctggagggcatccggcctgagagccctgcccagggcagcggcagccgccacagcgtgtggcagagggccctgtggagcctggagcgctacttctacctgatcctcttcaactactacctgcacgagcagtaccccctggcctttgccctgtccttcagccgctggctgtgtgcccaccctgagctgtaccgcctgcctgtgaccctgagcagcgctggccctgtggccccccgggacctgattgcccggggcagcctgcgggaggatgacctggtgtccccagatgccctgagcacagtgcgggagatggatgtggccaacttcagaagagtgcccaggatgcccatctatggaacagcccagcccagcgccaaggccctgggcagcatcctggcctacctgacagatgccaagaggcggctgaggaaggtggtgtgggtgtccctgcgggaggaggccgtgctggagtgtgatggccacacctacagcctgcgctggccaggcccccctgtggccccagaccagctggagaccctggaggcccagctgaaggcccacctgtctgagcccccacctgggaaggagggccccctgacctaccgcttccagacctgcctgaccatgcaggaggtgttcagccagcaccggcgggcctgccccggcctgacctaccaccgcatccccatgccagacttctgtgccccccgggaggaggactttgaccagctgctggaggccctgcgggccgccctgagcaaggaccccggcactggatttgtgttcagctgcctgagcggccagggccgcaccaccacagccatggtggtggccgtgctggccttctggcacatccaggtggtgatgaaggtggtgcagctgctgcctgatggccaccgggtgaagaaggaggtggatgctgccctggacacagtgtctgagaccatgacccccatgcactaccacctgcgggagatcatcatctgcacctaccggcaggccaaggccgccaaggaggcccaggagatgaggcggctgcagctgcggagcctgcagtacctggagcgctacgtgtgcctgatcctcttcaatgcctacctgcacctggagaaggctgacagctggcagaggcccttcagcacctggatgcaggaggtggccagcaaggccggcatctatgagatcctgaatgagctgggcttccctgagctggagagcggggaggaccagcccttcagccggctgcgctaccgctggcaggagcagagctgcagcctggagcccagcgcccctgaggacctgctgtag

SEQ ID NO: 41193 - DNA, 1428 bp, Artificial Sequence
  Description of Artificial Sequence: Synthetic coding sequence
atgccctgccccagcaggaacaccagcagccctgagccccccaccccaggcctgaagttctccttcctgcggggccagaggcagcccagcgtgaccccagagaaggccagcctgcagcacaacggcccctggaaggtgctgtgcagcctgtacagccccaagcccaacagagccaagagcctgggcaaggccggcaccacccagaccaagaccagcggccctgccacagcccccagccccctgacagaggagaaggccgccctgcctgaggccagcgctggcagccctgagcggggccccaccctggaggaggagcccccaggccctgagcccagaattggagccctgggcgtgaaggtgttccgcagcagaattgcctgcctgcccggcggccgggacagagctggccggcccctgctgctggtgtccaccacagaaggagcctgggaggccccctggtgcaccgtgtctgaggtgaccaagctgctgagctacctgtgcaccatccccaggcctgaggacaaggccaagggcctggccgtgctgattgatgcccggcggcagcccccccagcccggcctggtgtctgccctgcaggccacccaggcccaggtgcctgccagcatccgggccatcctcttcctgggggagaaggaggccgccctgcagctgcagaccctgcctgatgtgcagaagctggaccccttcctggccgacctgcaccaggccagcagcctgctgcaggccagcattgaggagtttgagaaggctgaccccccaggcggcatgcaggaggccacccgctgcctgagcaagagcaaggagctgatggaggccgtgctgcgggaccccggcctgctgggcctgcagcgggagggcggggccaccctggcccggctgcagcatgatgccagccggctggacttctccccagatgtgcgcagccacctggccgccgccacagccctgtacagcctggtggatgagcagctgcacgtgctggtgacagccagcaacagcctgctgggcaagctggagctgcgggtgcggctgggccgcctggaggccgccatccaccaggtgtctgactggatggagcaggagggccgccgctgcctgcagagcctgacccccaaggatggcagcctggagaccgtggagaaggcccatgctgagtttgagaacttcttcctgcaggccgccgcccagtacagaagaggcctggagctgagcaagcaggccgcccagctgggcgccacagcccggggggccggggaggccgagcgggcagagttccctgagctggccgcctttgccagcacccagagggccttccaggccgagctgacccacttctacatggctgctgagcggcagaggacagacctggagaccctgctgcacctgcaccgcttctgcaagaggtag

SEQ ID NO: 41194 - DNA, 480 bp, Artificial Sequence
  Description of Artificial Sequence: Synthetic coding sequence
atgcaccagacccacgccatccagaggctggaggtgctgcccagcttcagcaatgaaagccccaccagccgggagaccagcgagagctggaccaaccaggatgacatcttctacgcctatgcctccatgagccctggagctgagcaccggggcaccacccagctgctgcgcttccagctggcccccatcaagaagctggagggcagcctgcagacccacttcctgctgagcagcctgcaccccaggatgaccttccctggccgggccggcggcggggaggccggcagccggcccccccggcggccctgggccggcatcctgatcctgcagctgcccagcacccggggcggccgccgcagcggccacggggctgtgcgctcctggggcccctggaaggtggtggccgagcagcctgtgggcggcacagaccccccagcccatggaggccggggccggcccagccccaatgaaaacacctag

SEQ ID NO: 41195 - DNA, 3108 bp, Artificial Sequence
  Description of Artificial Sequence: Synthetic coding sequence
atggtggtgtttgtgggccgccgcctgcctgccctgctgggcctcttcaagaagaagggcagcgccaaggcagaaaatgacaagcacctgtctgtgggccctggccagggccctggcagcgctgtggatgagcaccaggacaacgtgttcttccccagcggccggcccccccacctggaggagctgcacacccaggcccaggagggcctgcggagcctgcagcaccaggagaagcagaagctgaacaagggcggctgggaccacggggacacccagagcatccagagcagcaggactggaccagatgaggacaacatctccttctgcagccagaccaccagctatgtggccgagagcagcacagcagaagatgccctgagcatccgctctgagatgatccagaggaagggcagcaccttccggccccatgacagcttccccaagagcggcaagagcggcagaagaagaagagaaagaagaagcacagtgctgggcctgccccagcacgtgcagaaggagctgggcctgagaaatgaaagagaggcccctggcaccccccgggcccctggggccagagatgctgtgcgcatccccaccgtggatggccggccccggggcaccagcggcatgggcgcccgggtgtccctgcaggccctggaggccgaggccgaggccggggctgagacagaggccatgctgcagaggcacatcgacagagtgtacagagatgacacctttgtgggccgcagcacaggcacccgggccccacccctgacccggcccatgagcctggccgtgcccggcctgaccggcggggccggccctgctgagcccctgagccctgccatgagcatcagcccccaggccacctacctgagcaagctgatcccccatgctgtgctgccccccaccgtggatgtggtggccctgggccgctgcagcctgcggaccctgagccgctgcagcctgcacagcgccagccctgcctctgtgcgcagcctgggccgcttcagctctgtgagcagcccccagcccaggagccgccaccccagcagcagcagtgacacctggagccacagccagagcagtgacaccatcgtgtctgatggcagcaccctgagcagcaagggcggcagcgagggccagcctgagagcagcacagccagcaacagcgtggtgcccccaccccagggcggcagcggccggggcagccccagcggcggcagcacagctgaggccagtgacaccctgagcatccgcagcagcggccagctgagcggccgctctgtgtccctgaggaagctgaagaggcctcctcctccacccaggaggacccacagcctgcaccagaggggcctggccgtgcctgatggccccctgggcctgccccccaagccagagaggaagcagcagccccagctgcccaggcctcccaccaccggcggcagcgagggcgctggggccgccccctgcccccccaacccagccaacagctgggtgcccggcctgagccctgggggcagcagaagaccacccaggagccctgagaggaccctgagccccagcagcggctacagcagccagagcggcacccccaccctgccccccaagggcctggccggccccccagccagccctgggaaggcccagccccccaagccagagcgggtgaccagcctgcggagccctggggcctctgtgagcagcagcctgaccagcctgtgcagcagcagcagtgaccctgcccccagcgacagaagtggcccccagatcctgacccccctgggggacagatttgtgatccccccccaccccaaggtgcctgcccccttcagccccccacccagcaagcccaggagccccaacccagctgccccagccctggccgccccagctgtggtgcccggccctgtgtccaccacagatgccagcccccagagcccccccaccccccagaccaccctgacccccctgcaggagagccctgtgatcagcaaggaccagagccccccacccagccccccacccagctaccaccccccacctccacccaccaagaagccagaggtggtggtggaggcccccagcgccagcgagacagctgaggagcccctgcaggaccccaactggcccccacctcctcctccagcccctgaggagcaggacctgtccatggctgacttccccccacctgaggaggccttcttctctgtggccagccctgagcccgccggccccagcggcagccctgagctggtgagcagccctgctgccagcagcagcagcgccacagccctgcagatccagcccccaggcagcccagaccccccaccagcccccccagccccagccccagccagcagcgcccctggccacgtggccaagctgccccagaaggagcctgtgggctgcagcaagggcggcggccccccaagagaagatgtgggcgcccccctggtgacccccagcctgctgcagatggtgcggctgcggtctgtgggcgcccctgggggcgcccccaccccagccctgggccccagcgccccccagaagcccctgcggcgggccctgagcggccgggccagccctgtgcctgcccccagcagcggcctgcatgctgctgtgcggctgaaggcctgcagcctggccgccagcgagggcctgagcagcgcccagcccaacggccccccagaggccgagcccaggcctccccagagccctgccagcacagccagcttcatcttcagcaagggcagcaggaagctgcagctggagaggcctgtgtccccagagacccaggccgacctgcagaggaacctggtggccgagctgcggagcatcagcgagcagaggcctccccaggcccccaagaagagccccaaggcccctcctcctgtggccaggaagcccagcgtgggcgtgcccccaccagccagccccagctaccccagggctgagcccctgacagccccacccaccaacggcctgccccacacccaggacaggaccaagcgggagctggctgaaaatggaggagtgctgcagctggtgggccctgaggagaagatgggcctgcccggcagtgacagccagaaggagctggcctag

SEQ ID NO: 41196 - DNA, 240 bp, Artificial Sequence
  Description of Artificial Sequence: Synthetic coding sequence
atgatcttcacccccttcctgcccccagctgacctgtctgtgttccagaatgtgaagggcctgcagaatgaccctgaggagtgggtggccgtgtctgatgccacagaggaccccagcggcggcaccggcctgccccgggagcccgccctgctgcggggctcctggaggagccgcttccagagggccctggcctgcttcaccaagtgcttccggggcggctaccgggccctgggcatctag

SEQ ID NO: 41197 - DNA, 228 bp, Artificial Sequence
  Description of Artificial Sequence: Synthetic coding sequence
atgatcttcacccccttcctgcccccagctgacctgaatgtgaagggcctgcagaatgaccctgaggagtgggtggccgtgtctgatgccacagaggaccccagcggcggcaccggcctgccccgggagcccgccctgctgcggggctcctggaggagccgcttccagagggccctggcctgcttcaccaagtgcttccggggcggctaccgggccctgggcatctag

SEQ ID NO: 41198 - DNA, 2217 bp, Artificial Sequence
  Description of Artificial Sequence: Synthetic coding sequence
atggaggactgcctgcacaccagcagcgagaacctgagcaagctggtgtcctgggcccacagccacggcaccatctgcagcctcatccccaacctgaagcacctgctgtctgagggcagccacggcaacctgacagccatgtggggctgcagcgctggccacgcctaccactggcccctgacagccacctgccgggccggcagccaggagcgggtgtgcttccaggacaacagaagcttcaacagcgacagccccagcatcatcggcgtgcccagcgagacccagaccagccctgtggagcgctacccaggccggcctgtgaaggccaagctggactgcaacagaacccgggacagctgtgacttctcctactgcagcgagcccagcgagctggatgagaccgtggaggagtatgaagatgagaacaccctgtttgacatggtgtgtgagagctctgtgacagatgaggacagcgactttgagccccagacccagaggccccagagcatcgccaggaagaggcctggggtggtgcccagcagcctgcacagcagcagccagacccagatggtggatgaatgtagcaatgatgtgatcatcaagaagatcaagcaggagatccctgaggactactacatcgtggccaatgctgagctgaccggcggcgtggatggccctgccctgagcctgacccagatggccaagcccaagccccagacccacgccggccccagctgtgtgggcagcgccaagctgatcccccacgtgaccagcgccatcagcacagagctggacccccacggcatgtctgccagccccagcgtcatcagccggcccatcgtgcagaagacagcccgggtgtccctggccagccccaacagaggccccccaggcacccacggcaccaaccagcaggtggccatgcagatgcctgtgtccaccagccaccccaacaagcagatcagcatccccctgagcgccctgcagctgcccggccaggatgagcaggtggccagcgaggagttcctgagccacctgcccagccaggtgagcagctgtgaggtggccctgagccccagcgtgaacacagagcctgaggtgagcagcagccagcagcagccccctgtggccccagccatcaccacagaggccacagcccagtgcatcccagaccaggatgaaagagctgctgagctgagccgggagcagaatgagaagaccatccgcagcacccagacagccctgaggaacttccgggagttcctgatcagcaagtaccccagcgagacccgggagatctacgtgatcccctgcaaggagctggatgcctacctggccagcttctttgtggatgcccggcagaaggatggctctgaatatgagcccaacagcctggccaactaccagtgtggcctggagcgctacctgaaggagcacagatatggctacagcatcacccgggacaaggagttcaagaggagccaggaggccctgaagcagaagcagatcgagctgcgctgcaagggcaagggcaacaagccccacaagtccatgaagctgacctttgctgatgagctgatcctgaggaagaggggcctgctgagccgctacaaccctgagggcctgctgaacctggtgtggctgaacaacaccaaggccttcggccactgcaccggcttccacggcagcaccctgaagtggggagacatccggctgcgggtgacagaaacaggcctggagtacctggagtggatgggccaggacacaggagacctgaatgccaagaccaagagaggaggaacagacagccgggtgtatgccacccagcacgccccccagacctgccctgtgcaggactacaaggagtatgcccagaggcggcccccagccatgagatatgaagatgcccccttctacctgagcatcaagcctgtggtgaacctggccgccctgcactggtacaactgccaggccctgggcaagaacaagctggccaagatggtgaagaccatgtgtgagaagggcaacatccctggcaggaagaccaacttctctgtgtaccagagctgcagcaccctgtctgaggcccagagcaaccagctggtgctgatctgcaacaacctgagccagcaggccgcccagagcgtggccggccacagcaacaacggcaacttcatcgtgtctgccagctatgacagcagcagtgacacagcctag

SEQ ID NO: 41199 - DNA, 390 bp, Artificial Sequence
  Description of Artificial Sequence: Synthetic coding sequence
atgaaggcccagggcgccatcgccatggccagcatcgccaagcagaccagcagcctggtgcccccctacctgggcatgatcctgacagccctgctgcagggcctggccggccgcacctgggccggcaaggaggagctgctgaaggccatcgcctgtgtggtgacagcctgcagcgctgagctggagaagtctgtgcccaaccagcccagcaccaatgagatcctgcaggccgtgctgaaggaatgttccaaagaaaatgtgaagtacaagatcgtggccatcagctgtgccgctgacatcctgaaggccaccaaggaggaccgcttccaggagttcagcaacatcgtcatccccctcatcaagaagaagaccctggagaacctggagtag

SEQ ID NO: 41200 - DNA, 390 bp, Artificial Sequence; identical to SEQ ID NO: 41199
  Description of Artificial Sequence: Synthetic coding sequence

SEQ ID NO: 41201 - DNA, 465 bp, Artificial Sequence
  Description of Artificial Sequence: Synthetic coding sequence
atgtgcaccgtggcccacacctgcatcgagcacatgtgcacctacatgaggctgcaccccctggcccacccccacacctgtgccctggcccccatctgcacccacgtgcacaccctggcccacatgtgcatctgcagaaatgcccccctgcacctgtgtgacaccccagcccacctgcacacccccatctgcatccaggcccagacccacagccacacctttgcccacacagccaccaacctgcacaagcagcacctgtacacagacacctacccctttgtgcccatccagtgcaccctgacccacctgcacacagctgtgctggcccacacctttgcccacacccacctgcacacctgcacccacaccacccacctgtctgtgcagcacacctacctgtgtgcctacatgcacatctgcacctgcacccagcagtggcacaccctgctgtaccacagcccctag

SEQ ID NO: 41202 - DNA, 126 bp, Artificial Sequence
  Description of Artificial Sequence: Synthetic coding sequence
aggaagaatggccagcagcagccccggggccggcccggcagcgcccggcccccagcccagcccccagaatgtggggctgaccagagggtgaccctgctgaccggggaccctgtgtctgctgcctag

SEQ ID NO: 41203 - DNA, 372 bp, Artificial Sequence
  Description of Artificial Sequence: Synthetic coding sequence
atggtggatggccgcaccaggaccatcatcaatgacatcttcttcacagagcccaccccagagatgagcagcctgcctgtgcgcagccacagcagcctgagcctgaacctggtgtccctgatggtgatctgccggggcatcatcaagctggtgatccacttcaggatgtactgccccccccggctgaaggccaagcacatcgagcccaccctgcggcctgtgcccctgaaggagctgcgcatcagccactggcccaatgaatgcatccgccacagcgcctctgtgcccatggccactggagccaacggcctggagaccaaggatgagaccaagagaaatgctgagaagtgtgcctgcagcgtcttcctgtag

SEQ ID NO: 41204 - DNA, 372 bp, Artificial Sequence; identical to SEQ ID NO: 41203
  Description of Artificial Sequence: Synthetic coding sequence

SEQ ID NO: 41205 - DNA, 423 bp, Artificial Sequence
  Description of Artificial Sequence: Synthetic coding sequence
atggactgcaagagccccaagagggccaacatctgcccccacctgcccggcggcggcctcttcagcaccccacccagccaggccgcctggaggaccctgctgacagccctgtgcttccctggccccacctgcaccggccccatgagggagggccccagggctgtgtacaaccccccccgggcccacaggaacagcagtgacaactgtgtgatgaagcacctgctgtgtgccggggacaagaatggcaccaggagacatgccctgcccagccccctggagggcagcttccagcccggccggcagatccccccaccccagacccccagcacagacccccagaccctgcccctgtccttccgcagcctgctgcgctgccaccagctgtgtgccgccagcctgccccccagcctgaagctgccctag

SEQ ID NO: 41206 - DNA, 423 bp, Artificial Sequence; identical to SEQ ID NO: 41205
  Description of Artificial Sequence: Synthetic coding sequence

SEQ ID NO: 41207 - DNA, 651 bp, Artificial Sequence
  Description of Artificial Sequence: Synthetic coding sequence
gcctggacagtgtctggcctgctgtctgctgcctttgagcctgaggtgcctgccagcctgagccagaagagtgaccacaggagcagcctgcccagcagccccagcctgcccctgagcaagaccctggccgtggcctatgaccctgaggacagcagcgctgccaactggtgcttcggcctgtgtgctgtgcccggccctgccagcctggacctgggccggccctggcctgtggaggaggcccaggtgaaggccggcggctgctgctggctgagcagcctgctgctggaggtgtctgccagcctgaggatgggccgcacagaccccctgaccggcctgcagagcctggagggcagcatcggccagggcaatggaggccacgtgaccagctgccgggccccctgccaccggcccaaggagcagctgtgccccctgtctgtgggcggccctggaggagaggtggacagacacctgccccccaccggcatctggcagcaggagcccggcctgctgtgcaagaagggccggcccaagggggagcagtggcccatcaagaccctggagaacaagcaccccttcccccgctggctgcagatcatcaccagctgcaagagcaccccaggagagcagctgaccttcatcagcctgtcctag

SEQ ID NO: 41208 - DNA, 720 bp, Artificial Sequence
  Description of Artificial Sequence: Synthetic coding sequence
ccccagatgtctgctgtgtacaccccaccttctgtgtccacccaccagatgcccaggaaccccaacccccagcagaggccccagatgtctgctgtgtacacccccaggtctgcccccacccgctgcccccagatgtctgctgtgtacaccccaccttctgcccccacagaccagatgcccaggaaccccaatgcccagcagaggccccagatgtctgctgtgtacaccccaccttctgcccccacagaccagatgcccaggaaccccaacccccagcagaggccccagatgtctgctgtgtacaccccaccttctgcccccacagaccagatgcccaggaaccccaacccccagcagaggccccagatgtctgctgtgtacaccccaccttctgcccccacagaccagatgcccaggaaccccaacccccagcagaggccccagatgtctgctgtgtatgcccctccttctgcccccacagaccagatgcccaggaaccccaacccccagcagaggccccagatgtctgctgtgtatgcccctccttctgcccccacagaccagatgcccaggaaccccaacccccagcagaggctgcagatgtctgctgtgtatgcccctccttctgcccccacagaccagatgcccaggaaccccaacccccagcagaggccccagatcagcgccccccgctgccagctgagcatccgccacaggtag

SEQ ID NO: 41209 - DNA, 240 bp, Artificial Sequence
  Description of Artificial Sequence: Synthetic coding sequence
atgaagctggccaagacagctgtgctggaccctgccacctacaccagcttcagccctggcctgagcacctgcagcagcagccagcccccaggggacaggaggaagggcctgctgggctgtgtgggcagcggccactgccccctgcccaccccagcccagttccccaaggtgcagaggcctcccaccctgctgggcggcaagaacaccagcacccagaccaccctgcaccctgtgatctag

SEQ ID NO: 41210 - DNA, 369 bp, Artificial Sequence
  Description of Artificial Sequence: Synthetic coding sequence
gaccccggcagcctgcgctgccctgtgtgcctgtccatggagggctgcctggagggcaccacagaggagatctgccccaagggcaccacccactgctatgatggcctgctgcggctgcggggcggcggcatcttcagcaacctgcgggtgcagggctgcatgccccagcctgtgtgcaacctgctgaatggcacccaggagatcggccctgtgggcatgacagagaactgtgacatgaaggacttcctgcagctgaagcctgtgggcctgctggaggagcacaacgtgggggagaaggagcggggccagggccagcaccagtgtgtgcagctggactggcagaagagagctgccactggagtgtcctag

SEQ ID NO: 41211 - DNA, 456 bp, Artificial Sequence
  Description of Artificial Sequence: Synthetic coding sequence
atgcatgctgggaagaggagccccctgacccagagcatcagctgtgtgtgcctgcctgagctgggcgccctgtgggagattgaaagtgcccgggtgaacctgcgggtgtctggccgggaggccagccgggagatggagagcagcccccggccccacagaattgctggggtgaagcgcttcctgaagcacgccggcaagtggagcctgcgctggttcctgagcccccgctggatcctgcagttccgccgctgggccaggaagtggagccgcttcaccaggagcagcttccaggtgcgctgggccgctgtgcctgctgggaagtgcagccagcaccagggcctgtctgctgtggccacagccagccctggggtcttctgggagatggagtttgatgtgagcagccccctgacagaaggagctggcagccccatgagcagcaagcatgctggggagtag

SEQ ID NO: 41212 - DNA, 366 bp, Artificial Sequence
  Description of Artificial Sequence: Synthetic coding sequence
atgattgacagccccaggaaggagggcgccctgagcccccccctgggcggctggaggctgggggacagaagatgtgccggcggcaagaggacagaaagaaggaccccagagaagctgtggggcatccggggggagaaggagggcgtgaagcgggagggccgcctgagccggggcggcggggccggggccggggccggggccggcggcgtgacagcccccaggcctcccctgcctgccctgcacagcgctgcccctggcctgcccccacctcctcctcctcctcctcctcctccacccctgcccccacctcctggggtggccggctgcggccagaacagaagccccaacagagctgctggggagtag

SEQ ID NO: 41213 - DNA, 726 bp, Artificial Sequence
  Description of Artificial Sequence: Synthetic coding sequence
atggccccagccacagacacagcctggctgcccccccaccctgagatccagctgcggctgctgtgccctggagagacctacggcaagctgatgggcggcagccccagcgctggccccaccacccagagccagccccacgccctgcggcccggcctgcggggccggggcggctggtggccccagcccttctggatccacagcccccccctgacccacagcgtgggcaccttcatctgcctggatggcctggtgtgtgccctgacagcccctggcctgggcgtgggcctgaccccagccccctggaggcctcctggccagagcaggatgctggagggccacggcccctggcccaccccaggcagcaggcctggccccacctgtgtgtgcctgctgaccccagccagcagcagcctgcggccctgcctgagtgaccggggcacctgccctggggccccccagggcgctgtgggcacctgccgggccagcccccagagcccctgccaccgccaccccagcctgcggagcggcctggagtggacccagcccccagaccaggaccagggcctgctgaccccaggcagcccccccctggtgtctggagtgacccagaccccctggaccagccccttctgccccccccggcccaccccctgggtgggcgccgccttcaccgctgccaacccctgccccccagcccccacagccagctctgtgacaggcctgtag

SEQ ID NO: 41214 - DNA, 714 bp, Artificial Sequence
  Description of Artificial Sequence: Synthetic coding sequence
atgcctgtgcacccagcctggctgggcagcgcctgcctgccccacgccagccacggccctgccccccagagctctgtgggcggcctgctggtgtctgtgaagagccccccaggagatgtgcacgccgcccgggcctgtgcccctggccgccacagcggggagggccccccccagggcaacctgagccccagctgcccagctgaggccggccacggctgtgccagcacaggccggcaggtgggcgtgtctggagctggcagcagccccagcggccctgccccctgtgtgaagtgcagcgcctgggtgggcacctgcttccccctgagcctgctgcaggccgccggcggccctgctggcagccccaacggcttctgcccagagccctgggccccagaccacgcccccaccctgcacggcctgaacaagagcctgtgccagggccccaggtctgggggcgcccagaggaagccccgggcccacactggagagggcgtgtctggcctgggcctgacccagccccggctgagcagcagcctgcgcatctcctggcacctgctggcctgtgtggccacccaggtgggctgtgcctgccgcctgcgggagaagaccctgggggaggactatgtgtctgccttcctgcccagcacaggccccagctgggcccactgtgaccagaccatgtgcaagagcacccgggagagcggccgctcctag

SEQ ID NO: 41215 - DNA, 966 bp, Artificial Sequence
  Description of Artificial Sequence: Synthetic coding sequence
atggtgtcccagagcacagtgcggcaggacagccctgtggagccctgggagggcatcagtgaccacagcggcatcattgatggcagcccccggctgctgaacacagaccaccccccctgccagctggacatccggctgatgaggcacaaggctgtgtggatcaacccccaggatgtgcagcagcagccccaggacctgcagagccaggtgcctgctgctggcaacagcggcacccactttgtgacagatgctgccagccccagcggccccagccccagctgcctgggggacagcctggccgagaccaccctgtctgaggacaccacagattctgtgggcagcgccagcccccacggcagcagcgagaagagcagcagcttcagcctgagcagcacagaggtgcacatggtgcggcccggctacagccaccgggtgtccctgcccaccagccctggcatcctggccaccagcccctacccagagacagacagcgccttctttgagcccagccacctgaccagcgctgctgatgaaggagctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagcctgacagcgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggtgtccctgatgagccagaccagcatcctgcagaactactag

SEQ ID NO: 41216 - DNA, 1788 bp, Artificial Sequence
  Description of Artificial Sequence: Synthetic coding sequence
atggtgagcaaccactacttcctgctgtgtgtgaacctgcccctgcgggagatccacaccccaggccccagccccagctgcctgggggacagcctggccgagaccaccctgtctgaggacaccacagacagcgtgggcagcgccagcccccacggcagcagcgagaagagcagcagcttcagcctgagcagcacagaggtgcacatggtgcggcccggctacagccaccgggtgtccctgcccaccagccctggcatcctggccaccagcccctacccagagacagattctgccttctttgagcccagccacctgaccagcgctgctgatgagggcgctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagccagattctgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggagctgggggacttcaatgacatcacagagacctgcagctgcagctgcagcagcagcaagtctgtgacctatgagccagacttcaacagcgctgagctgctggccaaggagctgtacagagtcttccagaagtgctggatcctgtctgtggtgaacagccagctggccggcagcctgtctgctgctggcagcatcgtggtgaatgaagaatgtgtgaggaaggactttgagagctccatgaatgtggtgcaggagatcaagttcaagagccgcatccggggcacagaggactgggccccaccccgcttccagatcatcttcaacatccacccccccctgaagagggacctggtggtggccgcccagaacttcttctgtgccggctgcggcacccctgtggagcccaagtttgtgaagaggctgcgctactgtgagtacctgggcaagtacttctgtgactgctgccacagctatgcagagagctgcatcccagcccgcatcctgatgatgtgggacttcaagaagtactacgtgagcaacttcagcaagcagctgctggacagcatctggcaccagcccatcttcaacctgctgagcatcggccagagcctgtatgccaaggccaaggagctggacagagtgaaggagatccaggagcagctgttccacatcaagaagctgctgaagacctgccgctttgccaacagcgccctgaaggagtttgagcaggtgcccggccacctgacagatgagctgcacctgttcagcctggaggacctggtgcgcatcaagaagggcctgctggcccccctgctgaaggacatcctgaaggccagcctggcccacgtggccggctgtgagctgtgccagggcaagggcttcatctgtgagttctgccagaacaccaccgtcatcttccccttccagacagccacctgccgccgctgcagcgcctgccgggcctgcttccacaagcagtgcttccagagcagtgaatgtccccgctgtgcccgcatcacagcccggaggaagctgctggagagcgtggccagcgctgccacctag

SEQ ID NO: 41217 - DNA, 1908 bp, Artificial Sequence
  Description of Artificial Sequence: Synthetic coding sequence
atggtgtcccagagcacagtgcggcaggacagccctgtggagccctgggagggcatcagtgaccacagcggcatcattgatggcagcccccggctgctgaacacagaccaccccccctgccagctggacatccggctgatgaggcacaaggctgtgtggatcaacccccaggatgtgcagcagcagccccaggacctgcagagccaggtgcctgctgctggcaacagcggcacccactttgtgacagatgctgccagccccagcggccccagccccagctgcctgggggacagcctggccgagaccaccctgtctgaggacaccacagattctgtgggcagcgccagcccccacggcagcagcgagaagagcagcagcttcagcctgagcagcacagaggtgcacatggtgcggcccggctacagccaccgggtgtccctgcccaccagccctggcatcctggccaccagcccctacccagagacagacagcgccttctttgagcccagccacctgaccagcgctgctgatgaaggagctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagcctgacagcgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggagctgggggacttcaatgacatcacagagacctgcagctgcagctgcagcagcagcaagtctgtgacctatgagccagacttcaacagcgctgagctgctggccaaggagctgtacagagtcttccagaagtgctggatcctgtctgtggtgaacagccagctggccggcagcctgtctgctgctggcagcatcgtggtgaatgaggagtgtgtgaggaaggactttgagagctccatgaatgtggtgcaggagatcaagttcaagagccgcatccggggcacagaggactgggccccaccccgcttccagatcatcttcaacatccacccccccctgaagagggacctggtggtggccgcccagaacttcttctgtgccggctgcggcacccctgtggagcccaagtttgtgaagaggctgcgctactgtgagtacctgggcaagtacttctgtgactgctgccacagctatgcagagagctgcatcccagcccgcatcctgatgatgtgggacttcaagaagtactacgtgagcaacttcagcaagcagctgctggacagcatctggcaccagcccatcttcaacctgctgagcatcggccagagcctgtatgccaaggccaaggagctggacagagtgaaggagatccaggagcagctgttccacatcaagaagctgctgaagacctgccgctttgccaacagctgtgtgaaggagcgggccctgtttgtgaactttgcccgcatccggctgagcagcagccacttccggcagcagcacgtggaggatgtgcagagagctggcctggccttcaccaacagcgccagcagccccccatctgcccctggggtgcggggcagccagagaggagagaacttctggaaggtgtggcccctgcagcagcatgatgcccctgagtactgtgagaaggactgcagcacctgcctgatgatcacccccatctgtgtgtactactggtag

SEQ ID NO: 41218 - DNA, 1908 bp, Artificial Sequence; identical to SEQ ID NO: 41217
  Description of Artificial Sequence: Synthetic coding sequence

SEQ ID NO: 41219 - DNA, 396 bp, Artificial Sequence
  Description of Artificial Sequence: Synthetic coding sequence
atggacagcacccacccccagcactgtgcctgcaacagccagatccggccccgctgggactgtgtggcccactgcttcctgtgggcccctggcctgcccagcagagatgaccccggggctgacaagggggaggccagcggcggcgtgggcaccgtgtccctgaccctgagccagccccgggagaggagcctgcaggtgaagaaggtgtttgtgaagggcatgaagaaggagcgggccctgggggagggcgccgcctggtggcagagccagaggctggtgtccccaggcaagcatgacagagtgtccacccacaggaagagccagagcgtcttcaccggggtgtctgctggggacaagcagttcaccaccaccttcagcatcgtgttcaccatctag

SEQ ID NO: 41220 - DNA, 1023 bp, Artificial Sequence; identical to SEQ ID NO: 41170
  Description of Artificial Sequence: Synthetic coding sequence

SEQ ID NO: 41221 - DNA, 423 bp, Artificial Sequence
  Description of Artificial Sequence: Synthetic coding sequence
atgtggcccttccggctgcgctgccccatctacttcaagacccggctgctgtacagcagcagccaggacggcttcctgagcagcagcaccaactactacaaccacaggacctacccaggcctggtgaactggctgtttgtgctgacagagcctgagctgaccggggagctgggagatgatgacaggaagggcatgcacactggaggcatcatccgctggctgggccggcccagcagccagctgaagcccatcttccacgccgaggagcggcgggtgcccccacctcctgagcggctggtgggccgggccagcccccgggagcaggccaccgtcttcaagaggatctgtgcccccctgcatgctgaggtgttctgcagagctggcctgtgtgcctgccacccagactgcacagctgctggatag

SEQ ID NO: 41222 - DNA, 408 bp, Artificial Sequence
  Description of Artificial Sequence: Synthetic coding sequence
atggtggccacctggggcggccggcagctgctgccccagtgcagcggcccccccctgaccccaggcagccctgcccccagcgtggcccaggccagcaggcctgccccacccagccccaggaagaccagccctggccccccccagcccagcgccagccccagcctgcccttcagccccctgctggccggctgcagccggctgctgcctgtgctggcccccagcctgagctctgtgcaccgctgccccctgggcgcccgggccagccggctgccctggaagctggaggccggcaccagcagcagcggggaccggcccctgtgcctgcacagcggccagagaggagcctgcctgacagatgagcagggcagcaccctgagcccccggcagaggcggggccctgggaagtag

SEQ ID NO: 41223 - DNA, 474 bp, Artificial Sequence
  Description of Artificial Sequence: Synthetic coding sequence
atgctgtctgtgtcccggccctgcttcagccagggcgccttcctgggccgcaccctgggctctgtgtgggcccagggcggcagccggctgcccctgtgcttctggtaccgcatccgctgtggccggcctgctgtggtgcacatcggcggggagggcgcccgctgggagaagggggcccggggcaggaaggagcaccggctgcggcggagtgacctgggcagcaggcctgtgcccttcctggcccagggcatcccagacatcgtcatccggctgctgtgcctgtctgctggcagcgccagcagccaccaggccagtgaccccctgagcagcgctgctgccaccctggccgctgagctggactgggccctggtgtcccagaagagcagcgaggacctggccccacccagcctgctgctgaactgcatctccttcctgatcacccagtgcccccacccccgctggctgcccggctag

SEQ ID NO: 41224 - DNA, 627 bp, Artificial Sequence
  Description of Artificial Sequence: Synthetic coding sequence
atgagccccaccaaggacagccaccccagcccccacttcccccgggacagcggcatccacgcccccaccccaccagattctggggccctgaccctgagcccccctgtgtcccagggccctggggtgggccccaggacaggccggggcaaccggctgtgcaggcctcctggccgctctgctgcccgctccttctgcctgctgcccggcccccccctgggcaccggggccctgggcagcccccgggccgcccagggcctgggcttccggggcagcggccagagggcccggcacaacagcttcaccagccccagccccccaggggcccaccaccccctgggcacccacacccgggccctgcccccacccctggcccgctgcccctgtgccgccctgctggccggccgggagtgccacggcggccccagccctgctgccccccggcccctgcccggcaccagcctgacctggcccagccgggcccccctgccccggcccccaccccgggagcggcagggccctggggacaggagccccagccccagcgcccccagctgccctggggtgggcgccagcagccccaggaggaggaagccccgggaggccgccggcctgaccccagatggatag

SEQ ID NO: 41225 - DNA, 1248 bp, Artificial Sequence
  Description of Artificial Sequence: Synthetic coding sequence
tatgatgctgtgcccatccagagctctgtggtgctgtgcagctgccccagccccagcatggtgaggacccagacagagagcagcaccccacctggcatccctgggggcagccggcagggccctgccatggatggaacagctgctgagcccaggcctggggccggcagcctgcagcacgcccagcccccaccccagcccaggaagaagaggcctgaggacttcaagtttgggaagatcctgggggagggcagcttcagcacagtggtgctggcccgggagctggccaccagccgggagtatgccatcaagatcctggagaagaggcacatcatcaaggagaacaaggtgccctacgtgacccgggagagagatgtgatgagccggctggaccaccccttctttgtgaagctgtacttcaccttccaggatgatgagaagctgtacttcggcctgtcctatgccaagaatggagagctgctgaagtacatcaggaagattggcagctttgatgagacctgcacccgcttctacacagctgagatcgtgtctgccctggagtacctgcacggcaagggcatcatccaccgggacctgaagccagagaacatcctgctgaatgaagacatgcacatccagatcacagactttggaacagccaaggtgctgagccctgagagcaagcaggcccgggccaacagctttgtgggcacagcccagtatgtgtccccagagctgctgacagagaagagcgcctgcaagagcagtgacctgtgggccctgggctgcatcatctaccagctggtggccggcctgccccccttccgggctggaaatgagtacctgatcttccagaagatcatcaagctggagtatgacttccctgagaagttcttccccaaggcccgggacctggtggagaagctgctggtgctggatgccaccaagaggctgggctgtgaggagatggagggctacggccccctgaaggcccaccccttctttgagagcgtgacctgggagaacctgcaccagcagaccccacccaagctgacagcctacctgcctgccatgtctgaagatgatgaggactgctatggaaatgtgtcctggccaggctggagggcccggcaggtggccctgggccccccctgcaccggcctgcacgcccgggccccagaccccagggtcatctgcagcaggaagggccgggtgtctgtgcccctgcggcaggcctgctggtggctgtag

SEQ ID NO: 41226 - DNA, 1734 bp, Artificial Sequence
  Description of Artificial Sequence: Synthetic coding sequence
atggctgatgtggccggccccagccggcccagcgctgctgccttctggagccgggacttcagtgatgaggagcagagcgtggtgtatgtgcccggcatctctgctgagggcaatgtgcgcagccgccacaagctgatgagccccaaggcagatgtgaagctgaagaccagccgggtgacagatgccagcatctccatggagagcctgaagggcaccggggacagcgtggatgagcagaacagctgccgcggggagatcaagagcgccagcctgaaggacctgtgcctggaggacaagaggcgcatcgccaacctgatcaaggagctggcccgggtgtctgaggagaaggaggtgacagaggagcggctgaaggccgagcaggagagctttgagaagaagatccggcagctggaggagcagaatgaactcatcatcaaggagcgggaggccatcaagctgcagtaccgggagtgccaggagctgctgagcctgtaccagaagtacctgtctgagcagcaggagaagctgaccatgagcctgtctgagctgggcgccgccaggatgcaggagcagcaggtgagcagcaggaagagcaccctgcagtgcagctctgtggagctggatggcagctacctgagcatcgcccggccccagacctactaccagaccaagcagaggcccaagtctgctgtgcaggacagcgccagcgagagcctcatcgccttcaggaacaacagcctgaagcctgtgaccctgcaccaccccaaggatgacctggacaagatccccagcgagaccaccacctgcaactgtgagagccctggcaggaagccagctgtgcccacagagaagatgccccaggaggagctgcacatgaaggagtgcccccacctgaagcccacccccagccagtgctgcggccaccggctggccgctgacagagtgcatgacagccaccccaccaacatgaccccccagcaccccaagacccaccctgagagctgcagctactgccgcctgtcctgggccagcctggtgcatggaggaggagccctgcagcccatcgagaccctgaagaagcagatcagcgaggacaggaagcagcagctgatgctgcagaagatggagctggagattgagaaggagcggctgcagcacctgctggcccagcaggagaccaagctgctgctgaagcagcagcagctgcaccagagccggctggactacaactgcctgctgaagagcaactgtgatggctggctgctgggcaccagcagcagcatcaagaagcaccaggacccccccaacagcggagaaaataggaaggagaggaagacagtgggcttccacagccacatgaaggatgatgcccagtggagctgccagaagaaggacacctgccggccccagaggggcaccgtgactggagtgaggaaggatgccagcaccagccccatgcccaccggcagcctgaaggactttgtgaccacagccagccccagcctgcagcacaccaccagccgctatgagaccagcctgctggacctggtgcagagcctgagccccaacagcgcccccaagccccagcgctaccccagccgggaggccggggcctggaaccacggcaccttccggctgagccccctgaagagcaccaggaagaagatgggcatgcacaggaccccagaggagctggaggagaaccagatcctggaggacatcttcttcatctag

SEQ ID NO: 41227 - DNA, 600 bp, Artificial Sequence
  Description of Artificial Sequence: Synthetic coding sequence
atgctgcctgtgcagaggaggaagctggaccccctgctgaagaagtaccgccaccacaagaaggccaccaggaccaagagaagaaggaaggagaagatggaggcccagtgcagccctgtgccccccacccccagcaccccaccccagagcgaggaggatgaagctgtggacaagaagcccaccctgctgagcgcccaggaggacaccccagacctgctgcatgaagatcggctgcagtacctgcaggaggagggcagcggcgtgatgcaccaggagtgccagatccagagctgtgagctgtctgtggcccagaagccccggcccagcagccctgctgtgaccagcctggccagcccccccctgtgcttcggcagcttcctgagctgtgtgtgccagaccttcagccgcagcaggaagcagaagccacccaggaggaagggcaacaaccaggccgaggccggaggagatgctgaggtgctgcggcccggccctgccaagccagagctgagcctgagcaagacctgcagccacctgaagagcattgagctgagctttgtgttctccttcatcgtgctgtctgtgtgccactgcagcagctag

SEQ ID NO: 41228 - DNA, 6618 bp, Artificial Sequence
  Description of Artificial Sequence: Synthetic coding sequence
atgcccctcttcttcagcgccctgctggtgctgctgctggtggccctgagcgccctcttcctgggccgctggctggtggtgcggctggccaccaagtggtgccagaggaagctgcaggccgagctgaagattggcagcttccgcttcttctggatccagaatgtgtccctgaagttccagcagcaccagcagacagtggagattgacaacctgtggatcagcagcaagctgctgagccatgacctgccccactacgtggccctgtgcttcggggaggtgcgcatcagaacagacctgcagaaggtgtctgacctgagcgcccccttcagccagagcgctggggtggaccagaaggagctgtccttcagccccagcctgctgaagatcttctgccagctgttcagcatccacgtggatgccatcaacatcatggtgctgaaggtggacaccagcgagagcctgtggcacatccagatcagccgcagccgcttcctgctggacagtgatggcaagaggctcatctgtgaggtgtccctgtgcaagatcaacagcaaggtgctgaagagcggccagctggaggacacctgcctggtggagctgagcctggccctggacctgtgcctgaaggtgggcatcagcagccgccacctgacagccatcaccgtggatgtgtggaccctgcatgctgagctgcacgagggcctcttccagagccagctgctgtgccagggccccagcctggccagcaagcctgtgccctgcagcgaggtgacagagaacctggtggagcccaccctgcccggcctcttcctgctgcagcagctgcctgaccaggtgaaggtgaagatggagaacacctctgtggtgctgtccatgaacagccagaagaggcacctgacctggaccctgaagctgctgcagttcctgtaccacagagatgaggaccagctgcccctgcgctccttcaccgccaacagcgacatggcccagatgagcacagagctgctgctggaggatggcctgctgctgagccagagccggcagagaattgtgtgcctgaacagcctgaaggcctctgtgcaggtgaccaccatcgacctgagcgccagcctggtgctgaacacctgcatcatccactaccgccaccaggagttcagccactggctgcacctgctggccctggagacccagggcagcagcagccctgtgctgaagcagaggaagaagaggaccttcccccagatcctggcccccatcatcttcagcaccagcatcagcaatgtgaacatcagcatccagctgggggacaccccaccatttgccctgggcttcaacagcatcagcctggactaccagcacctgcggccccagagcatccaccagaggggcgtgctgactgtggaccacctgtgctggagggtgggcagtgacagccacatccagagggccccccacccccccaacatgcacgtgtggggcgaggccctggtgctggacagcttcaccctgcagggcagctacaaccagcccctgggcctgagcagcacccagagcgacaccctcttcctggactgcaccatccggggcctgcaggtggaggccagtgacacctgtgcccagtgcctgagccgcatcctgagcctgatgggcccccagagcggcaagtctgctgtgagccgccacagcagctttggagagagcgtgtccctgctgtggaaggtggacctgaaggtggaggacatgaacctcttcaccctgagcgccctggtgggcgccagcgaggtgcggctggacaccctgaccatcctgggcagcgctgagaccagcacagtgggcatccagggcctggtgctggccctggtgaagtctgtgacagagaagatgcagccctgctgcaaggccccagacatccccacccctgtgctgagcctgtccatgctgagcatcacctaccacagcagcatccgcagcctggaggtgcagtgtggggccggcctgaccctgctgtggagccccccagaccacatgtacctgtaccagcacgtgctggccaccctgcagtgccgggacctgctgcgggccaccgtcttccctgagaccgtgcccagcctggccctggagaccagcggcaccaccagcgagctggagggccgggcccctgagcccctgccccccaagaggctgctgaacctgaccctggaggtgtccacagccaagctgacagcctttgtggccgaggacaagttcatcaccctggccgctgagagcgtgtccctgagccgccacggcggcagcctgcaggcctactgcccagagctggccgccggctttgatggcaacagcatcttcaacttcaaggaggtggaggtgcagctgctgcctgaggtggagttcccctaccagtatgacttcagcaggaccctggatgaagctgtgggcgtgcagaagtggctgaagggcctgcaccagggcacccgggcctgggccagccccagccctgtgcccctgcccccagacctgctgctgaaggtggagcacttctcctgggtgttcctggatgatgtgtttgaggtgaagctgcatgacaactatgagctgatgaaggatgagagcaaggagagcgccaagaggctgcagctgctggatgccaaggtggccgccctgaggaagcagcacggggagctgctgcctgccaggaagattgaggagctgtatgccagcctggagaggaagaacatcgagatctacatccagaggagccggcggctgtatggcaacacccccatgaggcgggccctgctgacctggagcctggccggcctggagctggtggccctggctgatgccagcttccacggccctgagcacgtggtggagcaggtgcaggagctggaccccggcagccccttccccccagagggcctggacctggtgatccagtggtgcaggatgctgaagtgcaatgtgaagagcttcctggtgcgcatccgggactacccccgctacctgtttgagatccgggactggaggctgatgggccgcctggtgggcacagagcagagcggccagccctgcagcagaagacggcagatcctgcacctgggcctgccctggggcaatgtggccgtggagaggaacatgccacccctgaagttctaccatgacttccacagcgagatcttccagtacacagtggtgtggggcccctgctgggaccctgcctggaccctcatcggccagtgtgtggacctgctgaccaagcccagcgctgaccccagcccccccctgccctggtgggacaagagccggctgctcttccatggagactggcacatggacatcgagcaggccaacctgcaccagctggccacagaggacccctacaacaccacagagaacatgcactgggagtggagccacctgtccttccactggaagccaggccagtttgtgttcaagggggacctggacatcaacgtgaggacagccagcaaatatgatgactgctgcttcctgcacctgcctgacctgtgcatgaccctggacctgcagtggctgtgccacggcaacccccatgaccaccacagcgtgaccctgcgggcccctgagttcctgcctgaggtgcccctgggccagctgcatgacagctaccgggccttccgctctgagaacctgaacctgagcatcaagatggacctgaccaggcacagcggcaccatcagccagccccgcatcctgctgtacagcagcaccctgcgctggatgcagaacttctgggccacctggacctctgtgacccggcccatctgccggggcaagctgttcaacaacctgaagcccagcaagaagaagctgggccagcactacaagcagctgagctacacagccctcttcccccagctgcaggtgcactactgggccagctttgcccagcagaggggcatccagatcgagtgcagccagggccacgtgttcacccggggcacccagaggctcatcccccaggccggcaccgtgatgagaagactcatcagtgactggagcgtgacccagatggtgtctgacctgagccaggtgacagtgcacctgatggccagccccacagaggagaatgctgaccactgcctggaccccctggtgaccaagacccacctgctgagcctgagcagcctgacctaccagaggcacagcaacagaacagctgaggaggagctgagcgccagagatggagaccccaccttccacacccaccagctgcacctggtggacctgcgcatctcctggaccaccaccaacagagacatcgccttcggcctgtatgatggctacaagaaggctgctgtgctgaagaggaacctgagcacagaggccctgaagggcctgaagattgacccccagatgcctgccaagaagcccaagaggggcgtgcccaccagcgccagcgccccaccccgggtgaacacccccagcttcagcggccagcctgacaagggcagcagcggcggggcctacatgctgcagaagctgattgaggagacagacagatttgtggtgttcacagaggaggagagcggcatgtctgaccagctgtgtggcattgctgcctgccagacagatgacatctacaacagaaactgcctgattgagctggtgaactgccagatggtgctgcggggagctgagacagagggctgtgtgattgtgtctgctgccaaggcccagctgctgcagtgccagcaccacccagcctggtatggagacaccctgaagcagaagacctcctggacctgcctgctggatggcatgcagtactttgccaccacagagagcagccccacagagcaggacggccggcagctgtggctggaggtgaagaacatcgaggagcaccggcagaggagcctggacagcgtgcaggagctgatggagagcggccaggccgtgggcggcatggtgaccaccaccacagactggaaccagcctgctgaggcccagcaggcccagcaggtgcagaggatcatcagccgctgcaactgcaggatgtactacatctcctacagccatgacatcgaccctgagctggccacccagatcaagcccccagaggtgctggagaaccaggagaaggaggacctgctgaagaagcaggagggcgctgtggacaccttcaccctcatccaccacgagctggagatcagcaccaacccagcccagtatgccatgatcctggacatcgtgaacaacctgctgctgcacgtggagcccaagaggaaggagcacagcgagaagaagcagagggtgcgcttccagctggagatcagcagcaaccctgaggagcagaggagcagcatcctgcacctgcaggaggccgtgcggcagcacgtggcccagatccggcagctggagaagcagatgtacagcatcatgaagagcctgcaggatgacagcaagaatgaaaacctgctggacctgaaccagaagctgcagctgcagctgaaccaggagaaggccaacctgcagctggagagcgaggagctgaacatcctgatccgctgcttcaaggacttccagctgcagagggccaacaagatggagctgaggaagcagcaggaggatgtgtctgtggtgagaagaacagagttctactttgcccaggcccgctggaggctgacagaagaagatggccagctgggcattgctgagctggagctgcagcgcttcctgtacagcaaggtgaacaagagtgatgacacagctgagcacctgctggagctgggctggttcaccatgaacaacctgctgcccaatgctgtgtacaaggtggtgctgcggccccagagcagctgccagagcggccggcagctggccctgcggctcttcagcaaggtgcggccccctgtgggcggcatctctgtgaaggagcactttgaggtgaatgtggtgcccctgaccatccagctgacccaccagttcttccacaggatgatgggcttcttcttccctggccgctctgtggaggatgatgaggtgggagatgaggaggacaagagcaagctggtgaccaccggcatccctgtggtgaagccccggcagctgattgccacagatgatgctgtgcccctgggccctggaaaaggagtggcccagggcctgaccaggagcagtggagtgcggcgctccttcaggaagagccctgagcaccctgtggatgacatcgacaagatgaaggagagagctgccatgaacaacagcttcatctacatcaagatcccccaggtgcccctgtgtgtgtcctacaagggggagaagaacagcgtggactggggagacctgaacctggtgctgccctgcctggagtaccacaacaacacctggacctggctggactttgccatggctgtgaagagggacagcaggaaggccctggtggcccaggtgatcaaggagaagctgcggctgaagagcgccactggaagtgaggtgcggggcaagctggagaccaagagtgacctgaacatgcagcagcaggaggaggaggagaaggcccggctgctgattggcctgtctgtgggggacaagaaccctgggaagaagagcatctttggaagaaggaagtag

SEQ ID NO: 41229 - DNA, 2130 bp, Artificial Sequence
  Description of Artificial Sequence: Synthetic coding sequence
atggaccagaagctgagcaagctggtggaggagctgaccaccagcggggagccccggctgaaccctgagaagatgaaggagctgaagaagatctgcaagagcagcgaggagcagctgagccgggcctaccgcctgctgattgcccagctgacccaggagcacgccgagatccggctgagcgccttccagatcgtggaggagctgtttgtgcgcagccaccagttcaggatgctggtggtgagcaacttccaggagttcctggagctgaccctgggcacagatcctgcccagcccctgcccccaccccgggaggccgcccagaggctgcggcaggccaccaccagggctgtggagggctggaatgagaagtttggagaggcctacaagaagctggccctgggctaccacttcctgcggcacaacaagaaggtggacttccaggacaccaatgcccggagcctggccgagaggaagcgggaggaggagaagcagaagcacctggacaagatctaccaggagcgggccagccaggccgagcgggagatgcaggagatgtctggagaaattgagagctgcctgacagaggtggagagctgcttccggctgctggtgccctttgattttgaccccaaccctgagacagagagcctgggcatggccagcggcatgtctgatgccctgcggagcagctgtgccggccaggtgggcccctgccgcagcggcaccccagaccccagagatggagagcagccctgctgcagccgggacctgcctgccagcgctggccacccccgggccggcggcggggcccagcccagccagacagccactggagaccccagtgatgaagatgaagattctgacctggaggagtttgtgcgcagccacggcctgggcagccacaagtacaccctggatgtggagctgtgcagcgagggcctgaaggtgcaggagaatgaagacaacctggccctgattcatgctgcccgggacaccctgaagctgatccggaacaagttcctgcctgctgtgtgctcctggatccagcgcttcaccagggtgggcacccatggaggctgcctgaagagggccatcgacctgaaggccgagctggagctggtgctgaggaagtacaaggagctggacatcgagcctgagggcggggagaggagaagaacagaggccctgggagatgctgaagaagatgaagatgatgaggactttgtggaggtgcctgagaaggagggctatgagccccacatcccagaccacctgcggccagaatatggcctggaggccgcccctgagaaggacacagtggtgcgctgcctgcggaccaggaccaggatggatgaggaggtgtctgaccccaccagcgctgctgcccagctgcggcagctgcgggaccacctgcccccacccagcagcgccagccccagccgggccctgcctgagccccaggaggcccagaagctggccgctgagcgggcccgggcccctgtggtgccctacggcgtggacctgcactactggggccaggagctgcccacagctgggaagatcgtgaagagtgacagccagcaccgcttctggaagcccagcgaggtggaggaggaggtggtgaatgctgacatcagcgagatgctgcggagccgccacatcacctttgctgggaagtttgagcctgtgcagcactggtgccgggcccccaggccagatggccgcctgtgtgagcggcaggaccggctgaagtgccccttccacggcaagatcgtgcccagagatgatgagggccggcccctggaccctgaggaccgggcccgggagcagaggcggcagctgcagaagcaggagaggcctgagtggcaggaccctgagctgatgagagatgtggaggccgccaccggccaggacctgggcagcagccgctacagcggcaagggccggggcaagaagaggcgctaccccagcctgaccaacctgaaggcccaggccgacacagcccgggcccgcatcggcaggaaggtgtttgccaaggctgctgtgagaagagtggtggccgccatgaacaggatggaccagaagaagcatgagaagttcagcaaccagttcaactatgccctgaactag

SEQ ID NO: 41230 - DNA, 1989 bp, Artificial Sequence
  Description of Artificial Sequence: Synthetic coding sequence
atggtgtcccagagcacagtgcggcaggacagccctgtggagccctgggagggcatcagtgaccacagcggcatcattgatggcagcccccggctgctgaacacagaccaccccccctgccagctggacatccggctgatgaggcacaaggctgtgtggatcaacccccaggatgtgcagcagcagccccaggacctgcagagccaggtgcctgctgctggcaacagcggcacccactttgtgacagatgctgccagccccagcggccccagccccagctgcctgggggacagcctggccgagaccaccctgtctgaggacaccacagattctgtgggcagcgccagcccccacggcagcagcgagaagagcagcagcttcagcctgagcagcacagaggtgcacatggtgcggcccggctacagccaccgggtgtccctgcccaccagccctggcatcctggccaccagcccctacccagagacagacagcgccttctttgagcccagccacctgaccagcgctgctgatgaaggagctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagcctgacagcgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggagctgggggacttcaatgacatcacagagacctgcagctgcagctgcagcagcagcaagtctgtgacctatgagccagacttcaacagcgctgagctgctggccaaggagctgtacagagtcttccagaagtgctggatcctgtctgtggtgaacagccagctggccggcagcctgtctgctgctggcagcatcgtggtgaatgaggagtgtgtgaggaaggactttgagagctccatgaatgtggtgcaggagatcaagttcaagagccgcatccggggcacagaggactgggccccaccccgcttccagatcatcttcaacatccacccccccctgaagagggacctggtggtggccgcccagaacttcttctgtgccggctgcggcacccctgtggagcccaagtttgtgaagaggctgcgctactgtgagtacctgggcaagtacttctgtgactgctgccacagctatgcagagagctgcatcccagcccgcatcctgatgatgtgggacttcaagaagtactacgtgagcaacttcagcaagcagctgctggacagcatctggcaccagcccatcttcaacctgctgagcatcggccagagcctgtatgccaaggccaaggagctggacagagtgaaggagatccaggagcagctgttccacatcaagaagctgctgaagacctgccgctttgccaacagcgccctgaaggagtttgagcaggtgcccggccacctgacagatgagctgcacctgttcagcctggaggacctggtgcgcatcaagaagggcctgctggcccccctgctgaaggacatcctgaaggccagcctggcccacgtggccggctgtgagctgtgccagggcaagggcttcatctgtgagttctgccagaacaccaccgtcatcttccccttccagacagccacctgccgccgctgcagcgcctgccgggcctgcttccacaagcagtgcttccagagcagcgagtgcccccgctgtgcccgcatcacagcccggaggaagctgctggagagcgtggccagcgctgccacctag

SEQ ID NO: 41231 - DNA, 552 bp, Artificial Sequence
  Description of Artificial Sequence: Synthetic coding sequence
aacatgaaccgctacagcttcatgctgagcggcaaccacctgctcttccacctgctgctgtggccagcccagacagcccggctgctgaagcacatcttccccaccggcagctgcaagctgagagatgtggccgagcacctgctgcagtgcccccagacaggccacgagtgctgcaaggcccagaacagagccaacctggtggagggctggttcagccagaacacccagaggggccccagccatgatggagtggccgagttccacatgagcctgactgtgtcctgcccagaccccacccccagcacagacccccagggccgccacaaccgggagcccatcctgggcagagatgatgacttcatgtgcaagcaggtgaagttcaggatgtgtgtggtgggcagagatggaaatgcccagagctctgtgcgctacacaggccccctgtacagaaggaagatcagaacagagttcctgtttgtggtgttcctgctggagacccgggagctgaagccccaggtgaacaagaatgtgcagggcacccggcccagctag

SEQ ID NO: 41232 - DNA, 171 bp, Artificial Sequence; identical to SEQ ID NO: 23700
  Description of Artificial Sequence: Synthetic coding sequence

SEQ ID NO: 41233 - DNA, 600 bp, Artificial Sequence
  Description of Artificial Sequence: Synthetic coding sequence
ggccgggccgcccggcggcaccacgacagctgtgaagatgctgccctgcccggccgcagtgacctgtgccgggccctgcacccagcccggcctgctgcccggggcggccgcccagcagatggcggctgcccagctgtgcctgctgagggcctgtggaggcacctgcagcaggtgggcgccgccacccacccccacctgatgaggggccccagcctgtcctgggccatcccagccacccaccccctgggcgccgcccccctgggcaaccctggccctggagagcccatctggctgccctgtgtgggcggcgctgaggtgcgggcccagctgggcagcttctacagctgggagagcaagagcagcctgcccagcacccccctgagcctgctggtgtcctgtggcggcagcgccctgaccacccacgccttcccccccatcggcggccccatccccagccgcttccctgctgccaacaagtacctgcccagcagcgcccgggtgcagggctctgtgggcatcagcatctacccagccacagacaaggccacctacctgagcacctggagcgcccacagcggccggcgggagcggcccaagtag

SEQ ID NO: 41234 - DNA, 216 bp, Artificial Sequence
  Description of Artificial Sequence: Synthetic coding sequence
atgaagatcgtgcacgtgaatgtgatgggcgtgggcggctggggcgctgtgttcctggacatgtggcacgtgacccaggagagcaagaggcccatcatcagcaagatgcctgcctggatcttcccctgccaccccctggatgagcagacctaccacatggccctgaatgctgccaccttccccaagaatgccacctggattggccccctgtggtag

SEQ ID NO: 41235 - DNA, 147 bp, Artificial Sequence
  Description of Artificial Sequence: Synthetic coding sequence
atgtctgacttccctgtgcacagcaagtacttcctgatcagcagcctgcaggtgctgaagatgcacaagaaggacttcaccagccaggtgctgctgcgcatctactttgacctgatctgcatgctggtgaagctgcacgtgctgtag

SEQ ID NO: 41236 - DNA, 861 bp, Artificial Sequence
  Description of Artificial Sequence: Synthetic coding sequence
atgagcctgcccatcggcatctacagaagagctgtgtcctatgatgacaccctggaggaccctgcccccatgaccccacctccaagtgacatgggctctgtgccctggaagcctgtgattcctgagaggaagtaccagcacctggccaaggtggaggagggggaggccagcctgcccagccctgccatgaccctgagcagcgccattgattctgtggacaaggtgcctgtggtgaaggccaaggccacccacgtgatcatgaacagcctcatcaccaagcagacccaggagagcatccagcactttgagcggcaggccggcctgagagatgctggctacaccccccacaagggcctgaccacagaggagaccaagtacctgcgggtggccgaggccctgcacaagctgaagctgcagagcggggaggtgaccaaggaggagcggcagcctgccagcgcccagagcacccccagcaccaccccccacagcagccccaagcagaggccccggggctggttcaccagcggcagcagcacagccctgcccggccccaaccccagcaccatggattctggcagcggggacaaggacaggaacctgagtgacaagtggagcctgtttggccccaggagcctgcagaagtatgattctggcagctttgccacccaggcctacagaggagcccagaagcccagccccctggagctgatccgggcccaggccaacaggatggccgaggaccctgctgccctgaagccacccaagatggacatccctgtgatggagggcaagaagcagcccccccgggcccacaacctgaagccccgggacctgaatgtgctgacccccaccggcttctag

SEQ ID NO: 41237 - DNA, 3240 bp, Artificial Sequence; identical to SEQ ID NO: 41130
  Description of Artificial Sequence: Synthetic coding sequence

SEQ ID NO: 41238 - DNA, 3240 bp, Artificial Sequence; identical to SEQ ID NO: 41130
  Description of Artificial Sequence: Synthetic coding sequence

SEQ ID NO: 41239 - DNA, 792 bp, Artificial Sequence
  Description of Artificial Sequence: Synthetic coding sequence
atgtggccccagccctgcctgcccccccaccccaccatgctggaggagacccagcagagcaagctggccgccgccaagaagaagctgaaggagtaccagcagaggaacagccctggggtgcctgctggggtgaagatgaagaagaagaacacaggcagcagccctgagacagccaccttcggcggctgccacagccctggggccagccgctaccaggagctggagctggccctggacagcagcagcgccatcatcaaccagctgaatgaaaacatcgagagcctgaagcagcagaagaagcaggtggagcaccagctggaggaggagaagaagaccaacagcgagatccacaaggcccagatggagcagctggaggccatcgacatcctgaccctggagaaggctgacctgaagaccaccctgtaccacaccaagagagctgcccggcactttgaggaggagagcaaggacctggccggccgcctgcagtacagcctgcagaggatccaggagctggagcgggccctgtctgctgtgtccacccagcagcaggaggaggacaggagcagcagctgccgggaggccgtgctgcagtggaggctgcagcagaccatcaaggagcaggccctgctgaatgcccacgtgacccaggtgacagagagcctgaagcaggtgcagctggagagagatgaatatgcccagcacatcaaggaggagcgggcccgctggcaggagaggatgtggaagatgtctgtgggcctgagcccccaccccaggcacccccagcagtag

SEQ ID NO: 41240 - DNA, 60 bp, Artificial Sequence
  Description of Artificial Sequence: Synthetic coding sequence
tggatcttcatcttcaagtgcagcgtgatgtatgtgcacttcttctttgccttcttctag

SEQ ID NO: 41241 - DNA, 618 bp, Artificial Sequence
  Description of Artificial Sequence: Synthetic coding sequence
atgaacagctggccctggctgtttgacagcaacttctgcagcgctgtggagatcatcctggagcctgagaagaagatccccaacagcaccctgcacttctgtgaggagctggtgcccaacagcggcagcctgtttgggaagaacatctgctgcggcaagcagtgctgcatctgtgacctgaagagcctgctggagctggacagagatggagagttccagcctgagcggcccaagaacagctgcccagccctgctgaatgccatcagcaggaggaccagcatcttccccccacccaccagcctgctgctgcctgtgaccctggccagcagccagtgctgctgggccaccagcggcagcgctgggggccggggcatcgcccccaccccaggcggccagccctgtggcagcagcaggaagagcggcagcagctgtgcctggcgctggagccccagcggcggcagcccctggccctgcagcagagctggaggagcctggaggcggctgggcaccagcctggacacccaccctgctggcagccgggcctgcagagctgtgcaccagctggccggggagagccccaccccccggcaggcccggcggccccccttccccacctag

SEQ ID NO: 41242 - DNA, 219 bp, Artificial Sequence
  Description of Artificial Sequence: Synthetic coding sequence
atggagaagtggaagctgggccggcagatccagcccccctggcccctggcccacgcccggggctcctggatggccctgcccaggtctgagcagctgggcaccggcggggaccaggactggcagctgcagggccacacccgggccacagagaccaaggagaacttccagaaggagagcatggtgaagagcctgaggatgcagaggcggcagggcgagtag

SEQ ID NO: 41243 - DNA, 312 bp, Artificial Sequence
  Description of Artificial Sequence: Synthetic coding sequence
atgaagctgaagagcctgtttggagagatcaccttcaccttcggcatcagcaaggagaagctgaagatcctggatgacctgaccctgctgcccctgctggtgaagcagtacaagatgctgtggagctacaagctgcccggcagcggcatcgtcatctggagcaccttccacgctgtgatggacagcgagtggaggcggcagaatgctgagctgaacctgatcaccaacaagcacttcctgaagaacctgcagagcaagcacctggatgtgaagatcctgaagaccaagaacaagctggtggagggcatctag

SEQ ID NO: 41244 - DNA, 69 bp, Artificial Sequence
  Description of Artificial Sequence: Synthetic coding sequence
gatggcaagatcatgctgcacgtgtgctgcatcagcctgtgcagcgtgctggtgtggaagttcccctag

SEQ ID NO: 41245 - DNA, 237 bp, Artificial Sequence
  Description of Artificial Sequence: Synthetic coding sequence
gtgctgctcttcatcttctacctgctgatcttcatgttctccttctttgagaccaggagccacagcgtgacccaggccggcgtgcagtggcatgaccacagcagcctgcagccccagctgcccggcctgaagcagagccccaccagcgccagccagagctcctgggaccacggctgtgcccccaggcaccccatccacctgccccagacccccaaggtgctgggcctgcaggtgtag

SEQ ID NO: 41246 - DNA, 297 bp, Artificial Sequence
  Description of Artificial Sequence: Synthetic coding sequence
ctggagtgcagcggcaccgtgctggcccactgcaacctgtgcctgctggccagccaggccgccggcatcaccggcaccagccaccacgcccagctgatctttgtgttcctggtggagacctggttccaccacgtgggccaggccggcctggagctgctgaccagcggggaccccccagcctctgtgtctgaaaatgccggcatcactggagtgagccaccgggcctggccaggcccccagttcttcaacctggagcagggcttctccatgctggtgcggctggtgagcaacagctag

SEQ ID NO: 41247 - DNA, 453 bp, Artificial Sequence
  Description of Artificial Sequence: Synthetic coding sequence
agaaaccgcatccagtacaaccagagccagaaggacatcctgcagagctggttccagcacgaccccttcccagacaaggccgcccgggagcagctggccaaggagattggagtgcctgagagcaacatccaggtgtggttcaagaactacagagtgaagcagaggaagctggactacaagtgcttcagcgagaaggaccagacccagggccatgaccagagccagcacctgacccaggagtacctgcccaaggaggcccggcagaagcagaccttcatcacctggacccagaagaaccggctggtgcaggcctttgaaagaaaccccttcccagacatcgccaccaggaagaagctggccgagcagacaggcctgcaggagagccgcatccagatgtggttccagaagcagaggagcctgtacctgaagaagagcaggatggagcccatgtag

SEQ ID NO: 41248 - DNA, 3651 bp, Artificial Sequence
  Description of Artificial Sequence: Synthetic coding sequence
atggccgccatggcccctgggggcagcggcagcggcggcggcgtgaaccccttcctgagtgacagtgatgaagatgatgatgaggtggccgccacagaggagaggagagctgtgctgcggctgggcgccggcagcggcctggaccccggcagcgctggcagcctgagcccccaggaccctgtggccctgggcagcagcgcccggcccggcctgcccggggaggccagcgctgctgctgtggccctgggcggcactggagagaccccagcccggctgagcattgatgccatcgccgcccagctgctgcgggaccagtacctgctgacagccctggagctgcacacagagctgctggagagcggccgggagctgccccggctgcgggactacttcagcaaccctggcaactttgagcggcagagcggcaccccacctggcatgggcgcccctggggtgcctggagctgctggggtgggcggggccggcggccgggagcccagcacagccagcggcggcggccagctgaacagagctggcagcatcagcaccctggacagcctggactttgcccgctacagtgatgatggcaaccgggagacagatgagaaggtggccgtgctggagtttgagctgaggaaggccaaggagaccatccaggccctgcgggccaacctgaccaaggctgctgagcacgaggtgcccctgcaggagaggaagaactacaagagcagccctgagatccaggagcccatcaagcccctggagaagagggccctgaacttcctggtgaatgagttcctgctgaagaacaactacaagctgaccagcatcaccttcagtgatgaaaatgatgaccaggactttgagctgtgggatgatgtgggcctgaacatccccaagcccccagacctgctgcagctgtacagagactttggaaaccaccaggtgacaggcaaggacctggtggatgtggccagcggcgtggaggaggatgagctggaggccctgacccccatcatcagcaacctgccccccaccctggagaccccccagcctgctgagaacagcatgctggtgcagaagctggaggacaagatcagcctgctgaacagcgagaagtggagcctgatggagcagatccggcggctgaagtctgagatggacttcctgaagaatgagcactttgccatcccagctgtgtgtgacagcgtgcagccccccctggaccagctgccccacaaggacagtgaagattctggccagcacccagatgtgaacagcagtgacaagggcaagaacacagacatccacctgagcatcagtgatgaggccgacagcaccatccccaaggagaacagccccaacagcttcccccggcgggagcgggagggcatgccacccagcagcctgagcagcaagaagacagtgcactttgacaagcccaacaggaagctgagccctgccttccaccaggccctgctgtccttctgcaggatgtctgctgacagccggctgggctatgaggtgtccagaattgctgacagcgagaagtctgtgatgctgatgctgggccgctgcctgccccacatcgtgcccaacgtgctgctggccaagcgggaggagctgatccccctcatcctgtgcacagcctgcctgcaccctgagcccaaggagcgggaccagctgctgcacatcctcttcaacctgatcaagaggccagatgatgagcagaggcagatgatcctgaccggctgtgtggcctttgcccggcacgtgggccccaccagggtggaggccgagctgctgccccagtgctgggagcagatcaaccacaagtacccagagcggcggctgctggtggccgagagctgtggggccctggccccctacctgcccaaggagatccgcagcagcctggtgctgtccatgctgcagcagatgctgatggaggacaaggctgacctggtgcgggaggccgtcatcaagagcctgggcatcatcatgggctacattgatgatcctgacaagtaccaccagggctttgagctgctgctgagcgccctgggggaccccagcgagcgggtggtgtctgccacccaccaggtgttcctgcctgcctatgctgcctggaccacagagctgggcaacctgcagagccacctgatcctgaccctgctgaacaagattgagaagctgctgcgggagggggagcacggcctggatgagcacaagctgcacatgtacctgagcgccctgcagagcctcatccccagcctgtttgccctggtgctgcagaatgcccccttcagcagcaaggccaagctgcacggggaggtgccccagatcgaggtgacccgcttcccccggcccatgagccccctgcaggatgtgtccaccatcatcggcagccgggagcagctggccgtgctgctgcagctgtatgactaccagctggagcaggagggcaccaccggctgggagagcctgctgtgggtggtgaaccagctgctgccccagctgattgaaattgtgggcaagatcaacgtgaccagcacagcctgtgtgcatgagttcagccgcttcttctggaggctgtgcaggaccttcggcaagatcttcaccaacaccaaggtgaagccccagttccaggagatcctgcggctgtctgaagaaaatattgacagcagcgctggaaatggagtgctgaccaaggccaccgtgcccatctatgccaccggggtgctgacctgctacatccaggaggaggacaggaagctgctggtgggcttcctggaggatgtgatgaccctgctgagcctgagccacgcccccctggacagcctgaaggccagctttgtggagctgggcgccaacccagcctaccacgagctgctgctgactgtgctgtggtatggagtggtgcacaccagcgccctggtgcgctgcacagctgccaggatgtttgagctgaccctgcggggcatgtctgaggccctggtggacaagagggtggccccagccctggtgaccctgagcagtgaccctgagttctctgtgagaattgccaccatcccagccttcggcaccatcatggagaccgtcatccagcgggagctgctggagcgggtgaagatgcagctggccagcttcctggaggacccccagtaccaggaccagcacagcctgcacacagagatcatcaagaccttcggccgggtgggccccaatgctgagccccgcttcagagatgaatttgtgatcccccacctgcacaagctggccctggtgaacaacctgcagatcgtggacagcaagaggctggacatcgccacccacctgtttgaggcctacagcgccctgagctgctgcttcatcagcgaggacctgatggtgaaccacttcctgcccggcctgcgctgcctgaggacagacatggagcacctgagccctgagcacgaggtgatcctgagctccatgatcaaggaatgtgagcagaaggtggagaacaagacagtgcaggagccccagggctccatgagcattgctgccagcctggtgtctgaggacaccaagaccaagttcctgaacaagatgggccagctgaccaccagcggggccatgctggccaacgtgttccagaggaagaagtag

SEQ ID NO: 41249 - DNA, 435 bp, Artificial Sequence
  Description of Artificial Sequence: Synthetic coding sequence
atggagcgggccagcggcctgagccctgggggcggcctgggcgccaccagccggcagatgagccctggcacccagctggccaaccccccagaccacggggacaaggactgcctgggccgcatcagccctggcagcggcaagcagatccaggccgccggccagctgcccggcccccccaccagcctggccccagcccagggccgcctgcggagcctgaccccctggggcctgcagaccccagagcacagcgagcctgagggcatcggccacctgcaggccgccacagaagctgtgctgccccacagcacccagaacctgatcaccaagaggaacctgatggtgcaggcccgggtgcagtggagggacctgggcagcctgaagcccccaccaccccgcttcaagcagttcagctgcttcagcctgcccagcagctag

SEQ ID NO: 41250 - DNA, 177 bp, Artificial Sequence
  Description of Artificial Sequence: Synthetic coding sequence
cctggaggagctgctgctgctgcctctgtgatggccccccggcggggccgctgcttctgcaccagcatctgtggcggccgcggggcccggccccagctgcccaggacctgtggagatggcacccagcactgcggccggggcaagccagccctggccgctgctgaggagtggccctag

SEQ ID NO: 41251 - DNA, 294 bp, Artificial Sequence
  Description of Artificial Sequence: Synthetic coding sequence
atgggcagcatccccagcaagccctgcaacaaccctgagggccccctgctgcagggcatggaggccgctgactggacaggcatcggcgtgtgcctgcccccaggaggagcccggggccacatctactgctgcacccggctgtgccaccagagagctgccagcgcccacaggagcctgctgctgcccaggacagtgcagacaggaggaacagagcgggagaagccaggccctggccagaggaagagaggagcccactgcagcgcctgcaagaggagcagcacccggcccagctag

SEQ ID NO: 41252 - DNA, 504 bp, Artificial Sequence
  Description of Artificial Sequence: Synthetic coding sequence
atggacctgatcaaggtgctgtatgtgaagaagcccctcatcttccccatgtacctgatctacaagcatgagaacctgatcctggagaggaaccccctggatgtgcgctctgtggtgatggtgtctgtcatccccctgacctttgacatcatgagggagctgaccctggagaagaaccccatgaatgtgaagaatgtggtgaagcccagcgacatcgtggtgccctatgagaacatgacagagctgatcctggagaggaaccccatgtctgtgcgcatcatcggcaagtgcctggtgatgcccatcatctttgtggccatcaaggagctgaccccagagaggaaccccatcagcaaggactgtgggaaggccttccgcagcagcagcttctgccagcagcacaagagcacccacactggagagaagccctatgagtgcaagaagtgtgggaagaccttccgcttctacagcagcctgcccaagcacaagaggacccacacctag

SEQ ID NO: 41253 - DNA, 408 bp, Artificial Sequence; identical to SEQ ID NO: 41222
  Description of Artificial Sequence: Synthetic coding sequence

SEQ ID NO: 41254 - DNA, 5529 bp, Artificial Sequence
  Description of Artificial Sequence: Synthetic coding sequence
atggagctgatgtttgctgagtgggaggatggagagcgcttctcctttgaagattctgacagatttgaggaggacagcctgtgcagcttcatcagcgaggccgagagcctgtgccagaactggaggggctggaggaagcagagcgctggccccaacagccccactggaggcggcggcggcggcggcagcggcggcaccaggatgagagatggcctggtgatccccctggtggagctgagcgccaagcaggtggccttccacatcccctttgaggtggtggagaaggtgtacccacctgtgcctgagcagctgcagctgcgcatcgccttctggagcttcccagaaaatgaggaggacatccggctgtacagctgcctggccaacggcagcgcagatgagttccagagaggagaccagctgttcaggatgagagctgtgaaggaccccctgcagatcggcttccacctgagcgccaccgtggtgcccccccagatggtgccccccaagggggcctacaacgtggccgtgatgtttgaccgctgccgggtgaccagctgcagctgcacctgtggggccggggccaagtggtgcacccacgtggtggccctgtgcctcttccgcatccacaatgccagcgctgtgtgcctgcgggcccctgtgtctgagagcctgagccggctgcagagggaccagctgcagaagtttgcccagtacctgatcagcgagctgccccagcagatcctgcccacagcccagaggctgctggatgagctgctgagcagccagagcacagccatcaacacagtgtgtggggccccagaccccacagctggccccagcgccagtgaccagagcacctggtacctggatgagagcaccctgacagacaacatcaagaagaccctgcacaagttctgtggccccagccctgtggtgttcagtgatgtgaacagcatgtacctgagcagcacagagcccccagctgctgctgagtgggcctgcctgctgcggcccctgcggggccgggagcctgagggcgtgtggaacctgctgagcatcgtgcgggagatgttcaagaggcgggacagcaatgctgcccccctgctggagatcctgacagaccagtgcctgacctatgagcagatcaccggctggtggtacagcgtgaggaccagcgccagccacagcagcgccagcggccacacaggccgcagcaatggccagagcgaggtggccgcccacgcctgtgcctccatgtgtgatgagatggtgaccctgtggaggctggccgtgctggaccctgccctgagcccccagaggagaagagagctgtgcacccagctgcggcagtggcagctgaaggtgattgaaaatgtgaagaggggccagcacaagaagaccctggagcggctcttccctggcttccggcctgctgtggaggcctgctacttcaactgggaggaggcctaccccctgcccggggtgacctacagcggcacagacaggaagctggccctgtgctgggcccgggccctgcccagcaggcctggggccagccgcagcggcggcctggaggagagccgggaccggccccggcccctgcccacagagcctgctgtgcggcccaaggagcccggcaccaagaggaagggcctgggggagggcgtgcccagcagccagaggggcccccggcggctgtctgctgagggcggggacaaggccctgcacaagatgggccctgggggcggcaaggccaaggccctgggcggggccggcagcggcagcaagggcagcgctgggggcggcagcaagaggcggctgagcagcgaggacagcagcctggagccagacctggccgagatgagcctggatgacagcagcctggccctgggcgctgaggccagcacctttggaggcttccctgagagccccccaccctgccccctgcacggcggcagccggggccccagcaccttcctgcctgagcccccagacacctatgaagaagatggcggcgtgtacttcagcgagggccctgagcccccaacagcctctgtgggccccccaggcctgctgcctggagatgtgtgcacccaggatgacctgcccagcacagatgagagcggaaatggcctgcccaagaccaaggaggccgccccagctgtgggggaggaggatgatgactaccaggcctactacctgaatgcccaggatggagctggaggagaggaggagaaggccgagggcggggccggggaggagcatgacctgtttgctggcctgaagcccctggagcaggagagcaggatggaggtgctgtttgcctgtgccgaggccctgcacgcccacggctacagcagcgaggccagccggctgactgtggagctggcccaggacctgctggccaaccccccagacctgaaggtggagcccccaccagccaagggcaagaagaacaaggtgtccaccagccggcagacctgggtggccaccaacaccctgagcaaggccgccttcctgctgactgtgctgtctgagaggcctgagcaccacaacctggccttccgggtgggcatgtttgccctggagctgcagaggcccccagccagcaccaaggccctggaggtgaagctggcctaccaggagagcgaggtggccgccctgctgaagaagatccccctgggccccagcgagatgagcaccatgcgctgcagagctgaggagctgcgggagggcaccctgtgtgactacagacctgtgctgcccctgatgctggccagcttcatctttgatgtgctgtgtgcccctgtggtgagccccaccggcagcaggcctcccagcaggaactggaacagcgagaccccaggagatgaggagctgggctttgaggccgctgtggccgccctgggcatgaagaccaccgtgtctgaggccgagcaccccctgctgtgtgagggcacccggcgggagaagggggacctggccctggccctgatgatcacctacaaggatgaccaggccaagctgaagaagatcctggacaagctgctggaccgggagagccagacccacaagccccagaccctgagcagcttctacagcagcagccggcccaccacagccagccagaggagccccagcaagcatggaggccccagcgcccctggggccctgcagcccctgaccagcggcagcgctggccctgcccagcccggctctgtggccggggccggccctggccccacagagggcttcacagagaagaatgtgcctgagagcagcccccacagcccctgtgagggcctgcccagcgaggccgccctgacccccaggcctgagggcaaggtgcccagccggctggccctgggcagccggggcggctacaacggccggggctggggcagccctggccggcccaagaagaagcacacaggcatggccagcattgacagcagcgcccctgagaccaccagtgacagcagccccaccctgagccggcggcccctgcggggcggctgggcccccacctcctggggccggggccaggacagcgacagcatcagcagcagcagcagtgacagcctgggcagcagcagcagcagcggcagccggcgggccagcgccagcggcggggcccgggccaagacagtggaggtgggccgctacaagggcagaagacctgagagccacgcccctcatgtgcccaaccagcccagcgaggccgccgcccacttctactttgagctggccaagacagtgctgatcaaggccggcggcaacagcagcaccagcatcttcacccaccccagcagcagcggcggccaccagggcccccacaggaacctgcacctgtgtgcctttgaaattggcctgtatgccctgggcctgcacaactttgtgagccccaactggctgagcaggacctacagcagccacgtgtcctggatcaccggccaggccatggagatcggcagcgctgccctgaccatcctggtggagtgctgggatggccacctgaccccacctgaggtggccagcctggccgaccgggccagccgggcccgggacagcaacatggtgcgggctgctgctgagctggccctgagctgcctgccccacgcccacgccctgaaccccaatgagatccagagggccctggtgcagtgcaaggagcaggacaacctgatgctggagaaggcctgcatggctgtggaggaggccgccaagggcggcggcgtgtacccagaggtgctgtttgaggtggcccaccagtggttctggctgtatgagcagacagctgggggcagcagcacagcccgggagggcgccaccagctgcagcgccagcggcatccgggccggcggggaggccggccggggcatgcctgagggccggggcggccctggaacagagcctgtgacagtggccgctgctgctgtgacagctgctgccaccgtggtgcctgtgatctctgtgggcagcagcctgtacccaggccctggcctgggccacggccacagccctggcctgcacccctacacagccctgcagccccacctgccctgcagcccccagtacctgacccacccagcccacccagcccaccccatgccccacatgcccaggcctgctgtgtttcctgtgcccagcagcgcctacccccagggcgtgcacccagccttcctgggcgcccagtacccctacagcgtgaccccacccagcctggccgccacagctgtgtccttccctgtgcccagcatggcccccatcaccgtgcacccctaccacacagagcccggcctgcccctgcccacctctgtggcctgtgagctgtggggccagggcaccgtgtcctctgtgcacccagccagcaccttccctgccatccagggcgccagcctgcctgccctgaccacccagcccagccccctggtgtctgggggcttccccccacctgaggaggagacccacagccagcctgtgaacccccacagcctgcaccacctgcatgctgcctacagagtgggcatgctggccctggagatgctgggcagaagagcccacaatgaccaccccaacaacttcagccgcagccccccctacacagatgatgtgaagtggctgctgggcctggccgccaagctgggcgtgaactacgtgcaccagttctgtgtgggcgccgccaagggcgtgctgagcccctttgtgctgcaggagatcgtgatggagaccctgcagaggctgagccctgcccacgcccacaaccacctgcgggccccagccttccaccagctggtgcagcgctgccagcaggcctacatgcagtacatccaccacaggctcatccacctgaccccagctgactatgatgactttgtgaatgccatccgcagcgcccggagcgccttctgcctgacccccatgggcatgatgcagttcaatgacatcctgcagaacctgaagaggagcaagcagaccaaggagctgtggcagagggtgtccctggagatggccaccttcagcccctag

SEQ ID NO: 41255 - DNA, 87 bp, Artificial Sequence
  Description of Artificial Sequence: Synthetic coding sequence
gatgctgtgatcctcttctctgtgtggaggctgaagaagaagagccgggtgctcttcttcatctacatcatcgccatctctgtgtag

SEQ ID NO: 41256 - DNA, 111 bp, Artificial Sequence
  Description of Artificial Sequence: Synthetic coding sequence
atggaggagacagagagcggcagcggcaggaaggagcggcgctggctgggcgctgtggcccacgtgtgcaaccccagcaccctgggcggccaggtgggccgcatcatctag

SEQ ID NO: 41257 - DNA, 495 bp, Artificial Sequence
  Description of Artificial Sequence: Synthetic coding sequence
atgggccagaagaagaccatgggcacagagaggagccggggcggcaagaggggcccccagcctggagctgagaggcctgaggagcccggggccaccttcagcaagaagcccccagagggcgcccgggccccccgctgcctgagccggcccacagcccccaagagcggggcctgcctggcccggcggcggcccccaggcagcccctgcagcatcagagatgcccccttccacactggagatgaccgcttcctggcccgggagaacttccccaacgtgctgcagcccctgcccaggatgtttgctgtgcagcaggccgctgactttgagagccagtgcccccggcgctgggacagcaggaagaggccttctgagggcctgcccagcgctggctggggccgctggaggggccggcccatccacctgggcctgtgggtgtctggctctgtgcggaggaaggtgtctggcagccacgtgagccgcagcctgcacctgtag

SEQ ID NO: 41258 - DNA, 1143 bp, Artificial Sequence
  Description of Artificial Sequence: Synthetic coding sequence
gtgcaccaggagatccacaccatcgagaagacctttgaatgtagccacggcaagaagagcttctgccaggagagccacttcacagagcaccacaggacctgcacccgggagaagccctgtgagagcagtgactgcaagaagcgcttctgccacagctctgtgctgcgggtgcaccagaggacccacactggagagaagccctatgagtgcaaggagtgcaggaagagcttccacgtgaagcccaacctgaccaagcaccagaagacccacatcggggagaagcccttcaagtgcacagcctgtggccgcaccttcttccagcagagcaccctgaatgtgcaccagaggacccacactggagagaagccctgtggctgcaatgaatgtgagaagagcttctacaacaaggatgccctgatcatccaccagaggacccacactggagagaagccctacaagtgcaatgaatgtgagaagagctacctgaagaagagccacctgaacatccacctgaggaaccacacaggcaagaggccccacgtgtgcaatgaatgtgggaaggccttctccatgaagagcaccctgactgtgcaccagaggacccacggggagaagccctacaagtgcaatgaatgtaggaagagcttctacatgaagagcgccctgagccagcaccagaggatccacatctgggaggagcactgtgagtgcaaggaatgtgggaagacctaccagaggagccacctggccaagcaccacaggaagtacaccaagaagccctatgagtgcaagcagtgtgggaagaccttccagaagagccacctgattgagcaccagaggacccaccctggagagatcccccatgagtgcaacaagtgtgggaagagcttctgctacaagagccccctgaccatccaccagaggacccacatcgaggagaagccctacaagtgcagcaagtctgtgacctacttctgcatgaagagccacctgactgtgcaccagaggccccacaccaggaagaacccctttgaatgtaatgaatgtaggaagatgttctacgtgaagagcaacctgatcaaccaccagaggacccacactggagagaagccctatgagggcaacacctgtgggaagagctag

SEQ ID NO: 41259 - DNA, 585 bp, Artificial Sequence
  Description of Artificial Sequence: Synthetic coding sequence
atgcctgccccccgcttcctgtacagcctgagaaattatgagcccatgaagcccctcttcttcatcaactaccctgtgtctgacatggagctgcctgtgcgcagcagcacagtgaccctgctgcctgcccccctgccccggcggggctctgtgaagaccttcctggcccccagcaagagctacttccctgaggaggagcgggccctgctgaagagcagccacgccttctgcaccggcctgtggccctggaggcgggacttccagctgccccagtgccacctggccctgggcctgctgcccggggagaggtctgtgcggctgccccgcttcctggccgtgctgaaggagctgagcgccacagccagcttcaccctggccagcgaggccatccccttcctgagcagcttccccttcccctggaacctgctgctgcccagcgtcttccaggccctgccccagaagtggcagttcaaggctgacttcctgctggagtgcaccctgtctgtgaaggaggccttccaccaggagtgtggggccggcgtgtccctggccaacggcctgaacaagggcctgaggactggatag

SEQ ID NO: 41260 - DNA, 6312 bp, Artificial Sequence
  Description of Artificial Sequence: Synthetic coding sequence
atgtctgtgcccggcacccctggggccatggagcctgctggggaggaggagaggcctcctcctgctgctgagggggaggatgatgaggaggaggtggccgctgctgcccagaccagcggccctgcccacggccgcagcgccagcagcctggaggatgctgatgaccaggaggaggagatggaggccatggtgattggaggcggctgctgcaaggagcaggagctgacctatgagctgcagcagggctaccgcatcctgggggagttcctgcaggagaagcaccggggcctgacagcccccttcctgcagcccctgggcggcgtggccacagctgaggaggaggtggccgagggccccaggtctgggggccggggcggccgggccttcccccagcagcccggccagggcatgtgcctgctgcagatggaggagaagtttgccagcggccagtatggaggcatcacagaatttgtggccgacttccggctgatgctggagacctgctaccgcctgcacggcgtggaccactggatcagcaagcagggccagaagctggagatgatgctggagcagaagctggccctgctgagccgccacctgcgggagaagaccaccatcgctgtgaccagccggggctactacggcctggaggatgagaagggcacagcctgcaccagcaccaggagaagaagcacccccaggagcctggccggcctgaccagcggcgtgtttgagagcatcatggtgcaggtgctgcggcaggaggagcagctgcgggccaaggaggagaagaggctgcgggagcaggagaggaaggaggccgaggaggccagccagaaggagattgaggagtgggagaggaagctgctggcccaggccgcccccacctgcatggagaccatgtgggagatcccagccatcggccacttcctgtgcctggcccagcagatcctgaacctgcctgagatcgtgttctatgagctggagcgctgcctgctgatgccccagtgcaatgccttcctgagcaagatcatgaccagcctgctgagccccccccaccggcggcccaccctgcaccggcggcccaccctgccctaccgcacctgggaggccgccctgcggcagaaggtgcagcagtggtacacagctgtgggccagacagagaacccagacaactgtgccgagaagctgggcctgtgcccccagttcttcaaggtgctgggggaggtgaaccccctggaggagaagcccttccacgagctgcccttctaccagaaggtgtggctgctgaagggcctgtgtgactttgtgtatgagacccagaaggaggtgcaggatgctgtgctgggccagcccatccatgaatgtcgggaggtgatcctgggctatgactacctggagaatgcctacgtgcacttcccccagttctgtggggctgatgtgcgcatctacaagcagaggcccttccaggcccctgagttccccatcccccccatcaagatccagagggtgccccgcatcaagctggagaagctgaagtgtgactatgtgtccaccagcaatggagagcaccgctgcagccgggacagcctgcccagcagcttcaagaaggagcaggagaacaactttgatcctgcctgctgcccagccaagatgatcctggacaaccacgacatctctgtggagatgggcgtgaagagcaactatgagatccgcatccggcggccctgtgagatcaagaagacagactgctgcaaggagaacctggagaagcccaggagccctggagaggtgactggatttggagagcccctgagccctggagagatccgcttcatcgagaaccaggagaagtatggagaggccagccgcatcaagattgagcccagccccctgaaggagaacaccctgaagagctgccagatccacgtgaatggcagccacagcgaccaccctgagatcaactgccacaaggtggtgcgggacatcctgctggagcagagcctgcagagccacaagaagctgaagctgaccaagatgagggccaagaagaagaagaagaagaagaagaagctgaaggatgtgctgaatgaaaacctgcagaggaagcgggagggcctgcacagcctggccttcaagagctacaagccagagatccagaacaagctgctgatcatcaagaagaaggccaagcacaagaagcacaagagcggcaagaagtctgtgtccaagaaggccatcaccaagaagaggaagacagtcatcaagagccccaccgtgcctgagttccagctgatctgcaccaacctggatgagctgcgggagctgatcaccaagattgaaaatgagctgaaggacctggagaacagcaggaagaagagcggcaagtggtaccaccggcggcaggccgtgaaggagctgcacagcaccctcatccggctgctgaatgagctgctgccctgggagcccaagctgatgaaggccttccagaggaacagaagccggctgaagaaggactatgatgacttccggcggcagcctgaccatgacaccttcaaccgggagctgtggaccacagatgaaggagagggggacctgggcaaggacagccccaagggggagatcagcaagagcattgacagcacagagcccctggacatcctggagaaggaccactttgacagtgatgacatgaagctgtctgaaattgacttccccatggcccggagcaagctgctgaagaaggagctgcccagcaaggacctgcccaagaccctgctgaagaccctgaagaggcagagcaagcagacagattatgtggatgacagcaccaaggagctgagccccaggaagaaggccaagctgagcaccaatgagaccaccgtggagaacctggagagtgatgtgcagattgactgcttcagcgagagcaagcacacagagcccagcttccctgagagctttgccagcctggacagcgtgcctgtgtccaccctgcagaagggcaccaagcccatccaggccctgctggccaagaacatcggcaacaaggtgaccctgaccaaccagctgccccccagcactggaagaaatgccctggccgtggagaagcctgtgctgagccccccagaggccagccccatcaagccagccctgacctgccacaccaacaccaagggccccctgcagatggtgtacaagatgccctgtggccagtggctgcccatcgacctgcagaacagctctgtgaagatccaggtgcagcccatggtggaccccaagacaggagagaagatcatgcagcaggtgctgatcctgcccaagaacttcgtcatccagcacaaggagggcaaggctgtggccaaggaggtgccccccctgcagcagaagggcacagagcagcactgcagcagcttcccccagaccaccaacatcaacagcagcctggcctctgtgtttgtgaacagccctggcaccgtgtccacccagctgcccaacacagccttcaacaagaccatcacccccctgagcaacatcagcagcgcccggccccagcccctgagccctgtgacctctgtgagcaacctgctgacccccagcgtgaagaccagccagagcgaggccggcaaggccaagaatgctgtgtctgctgccaccttcagcctgcccagcgccagccccaccatcagcagcacaggccagcccctgagcagcaccaccaccctgaatggcagcaccaaccctggcagcagcttcaactgctttgcccagcagacagctgacagcagcgaggccaagcaggagctgaagacagtgtgcatccgggacagccagagcatcctggtgaggacccggggcggcaacacaggagtggtgaaggtgcagaccaacccagaccagaacagccccaacacagtgagcagcagcagcgtcttcacctttgccccccagctgcaggccttcctggtgcccaagagcaccaccagcagcagcgccttcagccctgtggccggcaccaccaccaccagcagcctgagccccttcagccagacccccacctctgtgtccatcccagccagctttgcccccagcatgggcaagaacctgaagctgaccctgggccacaccactggaagtggggacctgggccacgtgattgacaagaccagccacatgcccagcagccccctgaagagcagcatctgcagcagcaccctgctgcccagcaccaccagcagctctgtgtctgtcatcagcatctctgctgccaactttggccagaacaatgccaacatcatccacacccccaccaagcagcagcaggtggactacatcaccaagagctaccctgtgaccaggtctgaggccacagctgccaccaatggagatgtgatcagcggcacccctgtgcagaagctgatgctggtgtctgcccccagcatcctgagcagtggaaatggaacagccatcaacatgaccccagccctgaccagcactggagtgtctgcccagaagctggtgttcatcaatgcccctgtgcccagcggcaccagcacccccaccctggtggccgagagcctgaagcagaccctgcccccacccctgcacaaggcctacgtgaagaccccagagcagccccagatcgtgctgatccccagcacagtgggcacccccatcaagatcaacagcagccctgctgtgtcccagatcaaggatgtgaagattggcctgaacatcggccaggccatcgtgaacaccagcggcaccgtgcctgccatccccagcatcaacatcctgcagaatgtgacccccaagggggaggacaagagcagcaagggctacatcctgcccctgagcaccagcggcaacagcgtgcctgtgagcagcaactttgtgtcccagaacatcacccctgtgaatgaatctgtggtgagcagcgcccgggctgtgaatgtgctgtctgtgactggagccaacctgagcctgggcagcttccctgtgaccagcgccagcgccagcgctggggcccagccccctgtgctggtgtctggaaatgacaccagcagccgcatcatgcccatcctgagcaaccggctgtgcagcagcagcctgggcaacacagtggccatcagcacagtgaagacaggccacctggccagctctgtgctgatcagcaccacccagcctgtggtgagccccaagtgcctgaccagcgccctgcagatccctgtgacagtggccctgcccaccccagccaccaccagccccaagatcatcaacacagtgccccacagcgctgctgtgcctggggccaccaggtctgtgtccatcagcaagaggcagagcaggaccagcctgcagttccacagccctggcatcagcaccaccgtgcccaccaacgtgaacaccaacaagccccagacagagctgagcagcctgagcaccagccctgggaagatcaccaacaccagcaactttgccagcctgcccaaccagcaggccctggtgaagacccccagctacagcagcgcccctgggggcaccaccatccacacagccagcgcccccagcaatgtgaccagcctggtgggcagccagttcagcgagccctgcatccagcagaagatcgtcatcaacaccagcacccccctggcccctggcacccagatcatgatcaatggcacccgcttcatcgtgcccccccagggcctgggcgccggcagccacgtgctgctgatcagcaccaaccccaagtatggagcccccctggtgctgaacagcggccagggcatccagagcacccccatcgacaacagcgcccagaagatcaccctggccagcaacaacagcctgagcggccagcccctgcagcaccccctgcggagccccaccaagttcatcaacagctttggaaatgccagcagcatccccaccgtgcacaccagcccccagctgatcaacaccacagccaaggtgcctgtgcccccacctgtgcccaccgtgtccctgaccagcgtcatcaagagccctgccaccctgctggccaagaccagcctggtgtctgccatctgccccagcaacccccccctgcccagcagcacctctgtgttccacctggacccccctgtgaagaagctgctggtgtccccagagggcgccatcctgaacaccatcaacaccccagccagcaaggtgagcagcctgagccccagcctgagccagatcgtggtgtctgccagccgcagccctgcctctgtgtttcctgccttccagagcagcggcctggagaagccagacagagctgccagctag

SEQ ID NO: 41261 - DNA, 342 bp, Artificial Sequence
  Description of Artificial Sequence: Synthetic coding sequence
atgcacacagtgccctggggcgtggactttgccctgattgccatgaagaacttcatcagccagtggagcagcttcttccgcagcggcatgggcaagagccagacaggctacctgccccgggtgccccgggagcagccctttgctgctggcctgtggggcctggccgccgccctgagccacctggccgtgaatgccttcagcctgctgtgcccccccctgcccaagaccagctgcagcctgaacccccatggagatgtggagagcaggaaggtgcacgccaccgtggagaatgtgtacatcagcgccctgaacctgccctgggtgcgggtgaagtggtgctag

SEQ ID NO: 41262 - DNA, 66 bp, Artificial Sequence
  Description of Artificial Sequence: Synthetic coding sequence
cggggagctgaccgggagagatttgcccgctgtgtgatcctggtgacccaggaggctgatgcctag

SEQ ID NO: 41263 - DNA, 243 bp, Artificial Sequence
  Description of Artificial Sequence: Synthetic coding sequence
atgtgcctgatcagcctgtgtgtgtccttcacctctgtgaacaagcgggagcagaacaagcccaagatcctgatcctgctgaagaagaggctgagcggctgcttcatcaaggaggcccggggcacccggctgaagggcaaccagctggccgtgaccaaggccagagatgatggcggcctggccgaggatggagacagcggcggcggcaaggtgatccgcttctggatctactttgagggctag

SEQ ID NO: 41264 - DNA, 417 bp, Artificial Sequence
  Description of Artificial Sequence: Synthetic coding sequence
gctgggggccggccccaccagcctgccagcctgcccccaggcaacccccagctggccgccctgagcctggagcagctgaagagccaggcccccatggacaccaagccagcctaccagaaccccaggaggaaggccgagcacagcgtgtctgtgcacctggatgagcaggactggaaccccaccatgcacaagagcctgctgggcaatgaccagacccagagcgaggtgcagagcggcaccctggaggccggcgtggacagagtcatcagccagacagtggaccccaagctgaaccacatcctgcggccccctgtggagggcgccatccacgagttcctggaggccaggaagaagagcagcagcgccagcagccccacccgggcccagagggcccggaccctgcagctgtacccctag

SEQ ID NO: 41265 - DNA, 84 bp, Artificial Sequence
  Description of Artificial Sequence: Synthetic coding sequence
tgctggggcttctactacatcctgtacctgctgtacatcatctacctgtacaacatctacatcctgaagaccaggagctactag

SEQ ID NO: 41266 - DNA, 108 bp, Artificial Sequence
  Description of Artificial Sequence: Synthetic coding sequence
attgtgctgctgctcttcatctgcttcctgagcaagctgaacttcaccgtgctggagaagttccccaagagcaccttcctgtgcaagatccagcacgagagcctgtag

SEQ ID NO: 41267 - DNA, 570 bp, Artificial Sequence
  Description of Artificial Sequence: Synthetic coding sequence
atgtgtgccaagaggctgcggggccccttccgcatcttcctgcccctgaggaagtacagcttcttccccagccaggtggcccagccctttgccagcgctgctgtggcccaggccctgctgagcagccctggcaccaacctgcagcagaccctggtgggcggcctgcggctgcggcacggctctgtgggcggggcccagtgggtggtgaaggccgcctgcccctgggagccccaggatgtggcctgctgcggcggcttcaccgtgacagccagaattgctgcctgtgtgctgctgtgcctgtgtgagcacatgtacacccccagcgcccacgccaggatgacctttggaacagagcacctgctgctgtggccagcccagaggagagctgaccccaggacagctgcccccatccggctgcaccagggccagctggaccccagccgggaccctgagaacctgcgggcctgggccgtgggcagctgcagagctggggtggagctgcacggcagccctgtgcacctgcacatgagagctggccagcacatctccatgtttgctggggtggcctag

SEQ ID NO: 41268 - DNA, 3285 bp, Artificial Sequence
  Description of Artificial Sequence: Synthetic coding sequence
atggccgcccgggcccccccagctgccccagctgctgaggagcccggcaaccctgggggcccccccaggaggaagaagagccgcagcggggccagcggcctgcggcgggccttctcctggctgcggggcaagaggaggaagaagaaggctgctggagctgagggcgctgagcctgctgccccccgggccaagaaggccgaggacaaggccaagagggccaagggcaagggccggggcagcgccaaggccgagaatgacaagcacctgtctgtgggccctggccagggccctggcagcgctgtggatgagcaccaggacaacgtgttcttccccagcggccggcccccccacctggaggagctgcacacccaggcccaggagggcctgcggagcctgcagcaccaggagaagcagaagctgaacaagggcggctgggaccatggagacacccagagcatccagagcagcaggacaggcccagatgaggacaacatctccttctgcagccagaccaccagctatgtggccgagagcagcacagcagaagatgccctgagcatccgctctgagatgatccagaggaagggcagcaccttccggccccatgacagcttccccaagagcggcaagtctggaagaagaagaagagagcggcgcagcacagtgctgggcctgccccagcacgtgcagaaggagctgggcctgagaaatgaaagagaggcccctggcaccccccgggcccctggggccagagatgctgtgcgcatccccaccgtggatggccggccccggggcaccagcggcatgggcgcccgggtgtccctgcaggccctggaggccgaggccgaggccggggctgagacagaggccatgctgcagaggcacatcgacagagtgtacagagatgacacctttgtgggccgcagcacaggcacccgggccccacccctgacccggcccatgagcctggccgtgcccggcctgactggaggagctggccctgctgagcccctgagccctgccatgagcatcagcccccaggccacctacctgagcaagctgatcccccatgctgtgctgcccccaacagtggatgtggtggccctgggccgctgcagcctgcggaccctgagccgctgcagcctgcacagcgccagccctgcctctgtgcgcagcctgggccgcttcagctctgtgagcagcccccagcccaggagccgccaccccagcagcagcagtgacacctggagccacagccagagcagtgacaccatcgtgtctgatggcagcaccctgagcagcaaaggaggcagcgagggccagcctgagagcagcacagccagcaacagcgtggtgcccccaccccagggcggcagcggccggggcagccccagcggcggcagcacagctgaggccagtgacaccctgagcatccgcagcagcggccagctgagcggccgctctgtgtccctgaggaagctgaagaggcctcctcctccacccaggaggacccacagcctgcaccagaggggcctggccgtgcctgatggccccctgggcctgccccccaagccagagaggaagcagcagccccagctgccccggccccccaccactggaggcagcgagggcgctggggccgccccctgcccccccaacccagccaacagctgggtgcccggcctgagccctgggggcagccggcggccccccaggagccctgagaggaccctgagccccagcagcggctacagcagccagagcggcacccccaccctgccccccaagggcctggccggccccccagccagccctgggaaggcccagccccccaagccagagcgggtgaccagcctgcggagccctggggcctctgtgagcagcagcctgaccagcctgtgcagcagcagcagtgaccctgcccccagcgacaggagcggcccccagatcctgacccccctgggggaccgcttcgtcatccccccccaccccaaggtgcctgcccccttcagccccccacccagcaagcccaggagccccaacccagctgccccagccctggccgccccagctgtggtgcccggccctgtgtccaccacagatgccagcccccagagcccccccaccccccagaccaccctgacccccctgcaggagagccctgtgatcagcaaggaccagagccccccacccagccccccacccagctaccaccccccacctccacccaccaagaagccagaggtggtggtggaggcccccagcgccagcgagacagctgaggagcccctgcaggaccccaactggcccccacctcctcctccagcccctgaggagcaggacctgtccatggctgacttccccccacctgaggaggccttcttctctgtggccagccctgagcctgctggccccagcggcagccctgagctggtgagcagccctgctgccagcagcagcagcgccacagccctgcagatccagcccccaggcagcccagaccccccaccagcccccccagccccagccccagccagcagcgcccctggccacgtggccaagctgccccagaaggagcctgtgggctgcagcaaaggaggcggccccccccgggaggatgtgggcgcccccctggtgacccccagcctgctgcagatggtgcggctgcggtctgtgggcgcccctggaggagcccccaccccagccctgggccccagcgccccccagaagcccctgcggcgggccctgagcggccgggccagccctgtgcctgcccccagcagcggcctgcacgccgctgtgcggctgaaggcctgcagcctggccgccagcgagggcctgagcagcgcccagcccaatggacctcctgaggccgagccccggcccccccagagccctgccagcacagccagcttcatcttcagcaagggcagcaggaagctgcagctggagaggcctgtgtccccagagacccaggccgacctgcagaggaacctggtggccgagctgcggagcatcagcgagcagaggcctccccaggcccccaagaagagccccaaggcccctcctcctgtggccaggaagcccagcgtgggcgtgcccccaccagccagccccagctaccccagggctgagcccctgacagccccacccaccaacggcctgccccacacccaggacaggaccaagcgggagctggccgagaatggaggagtgctgcagctggtgggccctgaggagaagatgggcctgcccggcagtgacagccagaaggagctggcctag

SEQ ID NO: 41269 - DNA, 942 bp, Artificial Sequence
  Description of Artificial Sequence: Synthetic coding sequence
atggagtactactactgccccagcctgctgaagctgctgcgctacctgtgggaccagctgaagcagtgcttcagccggcagcccacagagcccaaggacacagacaccctggtgcatgaagctggcagccagtatggcacctggacagagcagtgccagagcggggagagcctggccacagagagcccagacagcagcgccaccagcaccaggaagcagccccccagcagccggctgagcagcctgagcagccagacagagcccaccagcgctggggaccagtatgactgcagccgggaccagaggagcacctctgtggaccacagcagcacagacctggagagcacagatggcatggagggccccccacctccagatgcctgcccagagaagagggtggatgacttctccttcatcgaccagacctctgtgctggacagcagcgccctgaagaccagggtgcagctgagcaagaggagcagaagaagagcccccatcagccacagcctgcggcgcagccgcttcagcgagagcgagagccgcagccccctggaggatgaaacagacaacacctggatgttcaaggacagcacagaggagaagagccccaggaaggaggagagtgatgaggaggagacagccagcaaggccgagaggacccctgtgagccacccccagaggatgcctgccttccctggcatggaccctgctgtgctgaaggcccagctgcacaagaggcctgaggtggacagccctggagagacccccagctgggccccccagcccaagagccccaagagccccttccagcccggggtgctgggcagccgggtgctgcccagctccatggacaaggatgagaggagtgatgagcccagcccccagtggctgaaggagctgaagagcaagaagaggcagagcctgtatgagaaccaggtgtag

SEQ ID NO: 41270 - DNA, 1170 bp, Artificial Sequence
  Description of Artificial Sequence: Synthetic coding sequence
tgtgagaagagcaccttcttcaagcaccagaagaggacccacacagtggagaagacctttgaatgtagccacggcaagaagagcttctgccaggagagccacttcacagagcaccacaggacctgcacccgggagaagccctgtgagagcaacaagtatggcaagaccttccaccagaagaggagcttcatccaccaccagaggacccacactggagagaagccctatgagtgcaaggagtgcaggaagagcttccacgtgaagcccaacctgaccaagcaccagaagacccacatcggggagaagcccttcaagtgcacagcctgtggccgcaccttcttccagcagagcaccctgaatgtgcaccagggcaagcacacagaggagaagccctacaagtacacagaatgtgagaagagcttctacaagtctgtgctgatcatccacgagaggacccacactggagagaagccctgtggctgcaatgaatgtgagaagagctttgaggtgctgaccaccctggtgatccaccagaggacccacactggagagaagccctacaagtgcaatgaatgtgagaagagctacctgaacctgaagagccacctgaacatccacctgaggaaccacacaggcaagaggccccacgtgtgcaatgaatgtgggaaggccttctccatgaagagcaccctgactgtgcaccagaggacccacatgggcaagccctacaagtgcaatgaatgtaggaagagcttctacatgaagagcgccctgagccagcaccagaggatccacatctacaagaagccctatgagtgcaagcagtgtgggaagaccttccagaagagccacctgattgagcaccagaggacccaccctggagagatcccccatgagtgcaacaagtgtgggaagagcttctgctacaagagccccctgaccatccaccagaggacccacatcgaggagaagccctacaagtgcagcaagtctgtgacctacttctgcatgaagagccacctgactgtgcaccagaggccccacaccaggaagaacccctttgaatgtaatgaatgtaggaagatgttctacgtgaagagcaacctgatcaaccaccagaggacccacactggagagaagccctatgagggcaacacctgtgggaagtag

SEQ ID NO: 41271 - DNA, 96 bp, Artificial Sequence
  Description of Artificial Sequence: Synthetic coding sequence
atgtctgagaagacaggagagcctgctgctgaaaatagagacaaggaggcctctgtggccggggcccagatcaccctgcagacccagaccccctag

SEQ ID NO: 41272 - DNA, 2157 bp, Artificial Sequence; identical to SEQ ID NO: 41161
  Description of Artificial Sequence: Synthetic coding sequence

SEQ ID NO: 41273 - DNA, 5130 bp, Artificial Sequence
  Description of Artificial Sequence: Synthetic coding sequence
atgagagctggctggaccccccggggcttcagcgccttccacgccagcctgctgcccggccgccacccctacctggcccacctgggcccccgggacagaggagccagaattggcagccgggcctacagccagggctgctgcagctgcctgtggctgacctacaagggcaagaaggagggcagcaccaagggggagctgggccctgctgctgtgacagacctggagatccccagctacagccggggcttcctgccctgcaccccccgcttccccaccacctggtgccggggccctggctgcttctgtggcacagctgtgattgctggcaacctgggggacctggccagaattgtgggccccagccaccacgccagccagctgctgctgctgcaggagcaggacagcggcaaccaccccaccatggccgagagcctgtctgagatcagtgacagcctggatgtgctggaggccggagatgagggcaagaagaagtgcaagttcaaggccctgaagagcttctttgtgaagaagaaggagaaggaggccgaggacacccaggaggaggagatgctggagctgagcctgagcagcagcaacatcaacatcagcagcctgcagcctgtgcgggagaaccagcccaccaaggcccgggccaagagctccatgggcagcaaggccctgagccatgacagcatcttcatgctgggccctgagcctgagaggtctgccagcaagatgttccccagcatggacccccagaggggccggccccagcagaggagccacatcagcaggaccctgcccaagcccaggagcaaggtgcctggggtggtgtctggggccatgtctggagctgtgctgcagaatgtgcccaccagcgctgtgtgggtggccggccccaagatcacagagaacccccccagcagaagaagaaggctgagcatcatcccccctgtgatccagcctgagatcatcagcaagaacctggtggagatcagcctggatgatgagagccccaagaacccccagaagaaggccctgccccacaagagcctgacagccacccagagcttcagcgagctgagcagcggccctgactgcagccagagcctgacagcctttgccaccctggccagcaccagcagcacccagctgcccatcggcttcagcaccccagccaccacccagggctgcctggacagcagcgctgcccggcacaagatgaccctgaaccccaggaagcagaagaagaacctgcaggtgatcatccggggcctgcctgtgtggttcagccacttccagggcatcctggagggcagcctgcagtgtgtgacccagaccctggagacccccaacctggatgagcccctgcctgtggagcccaaggaggaggagcccaacctgcccctggtgtctgaggaggagaagagcatcaccaagcccaaggagatcaatgagaagaagctgggcatggattctgctgacagcagcagccagaagcagaacaacaagacagagatgtatgacaagaagaccacagaccaggcccccaacacagatgccagccgcagccagggctaccccatgtctgctgcctatggaagacgctggaggaggaagggggcctctgtgtctggcctgagcggctgtgagttcaagggccgcagcctgaagcagagcagcgagggctacggcctgggggaccgggccggcagcagccccaccaacaagacagccagaaatgtgcccttcagccacctgagcctggagaaggacaacatggagcagcccaccaccagccagcctgagaccaccaccccccagggcctgctgagtgacaaggatgacatgggcagaagaaatgccggcatcgactttggcagcaggaaggccagcgctgcccagcccatccctgagaacatggacaacagcatggtgtctgacccccagccctaccatgaagatgctgccagcggggctgagaagacagaggcccgggccagcctgagcctgatggtggagagcctgagcaccacccaggaggaggccatcctgtctgtggccgctgaggcccaggtgttcatgaaccccagccacatccagctggaggaccaggaggccttctcctttgacctgcagaaggcccagagcaagatggagagcgcccaggatgtgcagaccatctgcaaggagaagcccagcggaaatgtgcaccagaccttcaccgcctctgtgctgggcatgaccagcaccacagccaagggagatgtgtatgccaagaccctgcccccaagaagcctcttccagagcagcaggaagccagatgctgaggaggtgtccagtgacagcgagaacatccctgaggagggagatggcagcgaggagctggcccacggccacagcagccagagcctgggcaagtttgaagatgagcaggaggtgttcagcgagagcaagagctttgtggaggacctgagcagcagcgaggaggagctggacctgcgctgcctgagccaggccctggaggagccagaagatgctgaggtgttcacagagagcagcagctatgtggagaagtacaacaccagtgatgactgcagcagcagcgaggaggacctgcccctgcggcacccagcccaggccctgggcaagcccaagaaccagcaggaggtgtcctctgccagcaacaacaccccagaggagcagaatgacttcatgcagcagctgcccagccgctgccccagccagcccatcatgaaccccaccgtgcagcagcaggtgcccaccagctctgtgggcaccagcatcaagcagagcgacagcgtggagcccatcccccccaggcaccccttccagccctgggtgaaccccaaggtggagcaggaggtgagcagcagccccaagtccatggctgtggaggagagcatctccatgaagcccctgccccccaagctgctgtgccagcccctgatgaaccccaaggtgcagcagaacatgttttctggcagcgaggacattgctgtggagagggtcatctctgtggagcccctgctgccccgctacagcccccagagcctgacagacccccagatccggcagatcagcgagagcacagctgtggaggagggcacctacgtggagcccctgcccccacgctgcctgagccagcccagcgagcggcccaagttcctggacagcatgagcaccagcgctgagtggagcagccctgtggcccccacccccagcaagtacaccagccccccctgggtgacccccaagtttgaggagctgtaccagctgagcgcccaccctgagagcaccaccgtggaggaggacatcagcaaggagcagctgctgcccaggcacctgagccagctgactgtgggcaacaaggtgcagcagctgagcagcaactttgagcgggccgccatcgaggccgacatcagcggcagccccctgcccccccagtatgccacccagttcctgaagaggagcaaggtgcaggagatgaccagccggctggagaagatggctgtggagggcaccagcaacaagagccccatcccccggcggcccacccagagctttgtgaagttcatggcccagcagatcttcagcgagagcagcgccctgaagaggggcagtgatgtggcccccctgccccccaacctgcccagcaagagcctgagcaagccagaggtgaagcaccaggtgttcagtgacagcggcagcgccaaccccaagggcggcatcagcagcaagatgctgcccatgaagcaccccctgcagagcctgggccggcctgaggacccccagaaggtgttctcctacagcgagcgggcccctgggaagtgcagcagcttcaaggagcagctgagcccccggcagctgagccaggccctgaggaagccagaatatgagcagaaggtgtcccctgtgtctgccagcagccccaaggagtggaggaacagcaagaagcagctgccccccaagcacagcagccaggccagtgacaggagcaagttccagccccagatgagcagcaaaggacctgtgaatgtgcctgtgaagcagagcagcggggagaagcacctgcccagcagcagccccttccagcagcaggtgcacagcagctctgtgaatgctgctgccaggagatctgtgtttgagagcaacagcgacaactggttcctgggcagagatgaggcctttgccatcaagaccaagaagttcagccagggcagcaagaaccccatcaagagcatcccagccccagccaccaagccaggcaagttcaccatcgcccctgtgcggcagaccagcaccagcggcggcatctacagcaagaaggaggacctggagagcggagatggcaacaacaaccagcacgccaacctgagcaaccaggatgatgtggagaagctgtttggagtgcggctgaagagggccccacccagccagaagtacaagtctgagaagcaggacaacttcacccagctggcctctgtgcccagcggccccatcagcagctctgtgggccggggccacaagatccgcagcaccagccagggcctgctggatgctgctggcaacctgaccaagatctcctatgtggccgacaagcagcagagccggcccaagtctgagagcatggccaagaagcagcctgcctgcaagaccccaggcaagccagctggccagcagagcgactatgctgtgtctgagcctgtgtggatcaccatggccaagcagaagcagaagagcttcaaggcccacatctctgtgaaggagctgaagaccaagagcaatgctggagcagatgctgagaccaaggagcccaagtatgaaggagctggcagcgccaatgaaaaccagcccaagaagatgttcaccagctctgtgcacaagcaggagaagacagcccagatgaagccacccaagcccaccaagtctgtgggctttgaggcccagaagatcctgcaggtgcctgccatggagaaggagaccaagaggagcagcaccctgcctgccaagttccagaaccctgtggagcccatcgagcctgtgtggttcagcctggccaggaagaaggccaaggcctggagccacatggccgagatcacccagtag

SEQ ID NO: 41274 - DNA, 5421 bp, Artificial Sequence; identical to SEQ ID NO: 41165
  Description of Artificial Sequence: Synthetic coding sequence

SEQ ID NO: 41275 - DNA, 4230 bp, Artificial Sequence
  Description of Artificial Sequence: Synthetic coding sequence
atggagagtgacaggctcatcatcagcctgccccgggtgaagtggacagaggccgccctgaccatggccagccagctgcaggagaagtgcatcgccttcatcgtggacaacttcagcaagatcatccagagtgaaaattttgccctgctgctgcagagccaggccatgagcagcacagctgacctgctggacaccatcctgaaggccatcgaggagaacatcaccacagagaacagctgcagcctgctgatggccctggacaccctgctgaacagcgacagcaccaaggagatgggcttcacctgcaagatccaggccctgcgggacaagctgtggatcttcctggtgcagagcttctatgctgtgcgccacacagagagctggaagctgatgagcacagatgaccagcagaagatccaggccgccgcctttgacaagggagatgaccggcggctgggcaagaagcccatcttcagcagcagccagcagaggaagcaggtgtctgacagcggggacatcaagatcaagtcctggaggggcaacaacaagaaggagtgctggagctacctgagcaccaacaagaagatgaagagtgatggcctgggcgccagcggccacagcagcagcaccaacagaaacagcatcaacaagaccctgaagcaggatgatgtgaaggagaaggatggcaccaagatcgccagcaagatcaccaaggagctgaagacaggaggcaagaatgtgtctgggaagcccaagacagtgaccaagagcaagacagaaaatggagacaaggcccggctggagaacatgagcccccggcaggtggtggagaggtctgccacagctgctgctgctgccaccggccagaagaacctgctgaatggcaagggcgtgaggaaccaggagggccagatcagcggggcccggcccaaggtgctgaccggcaacctgaatgtgcaggccaaggccaagcccctgaagaaggccaccgggaaggacagcccctgcctgagcattgctggccccagcagccgcagcacagacagctccatggagttcagcatcagcacagagtgcctggatgagcccaaggaaaatggcagcacagaggaggagaagcccagcggccacaagctgtccttctgtgacagccctggccagatgatgaagaacagcgtggacagcgtgaagaacagcacagtggccatcaagagcaggcctgtgtcccgggtgaccaacggcaccagcaacaagaagagcatccacgagcaggacaccaacgtgaacaacagcgtgctgaagaaggtgtctgggaagggctgcagcgagcctgtgccccaggccatcctgaagaagaggggcaccagcaatggctgcacagctgcccagcagaggaccaagagcacccccagcaacctgaccaagacccagggcagccagggcgagagccccaacagcgtgaagagctctgtgagcagccggcagagtgatgaaaatgtggccaagctggaccacaacaccaccacagagaagcaggcccccaagaggaagatggtgaagcaggtgcacacagccctgcccaaggtgaatgccaagatcgtggccatgcccaagaacctgaaccagagcaagaagggggagaccctgaacaacaaggacagcaagcagaagatgcctcctggccaggtgatcagcaagacccagcccagcagccagaggcccctgaagcatgagaccagcacagtgcagaagtccatgtttcatgatgtgcgggacaacaacaacaaggacagcgtgtctgagcagaagccccacaagcccctcatcaacctggccagcgagatcagtgatgctgaggccctgcagagcagctgcaggccagacccccagaagcccctgaatgaccaggagaaggagaagctggccctggagtgccagaacatcagcaagctggacaagagcctgaagcatgagctggagagcaagcagatctgcctggacaagtctgagaccaagttccccaaccacaaggagacagatgactgtgatgctgccaacatctgctgccacagcgtgggcagtgacaacgtgaacagcaagttctacagcaccacagccctgaagtacatggtgagcaaccccaatgaaaacagcctgaacagcaaccctgtgtgtgacctggacagcaccagcgctggccagatccacctgatcagtgaccgggagaaccaggtgggcaggaaggacaccaacaagcagagcagcatcaagtgtgtggaggatgtgtccctgtgcaaccctgagaggaccaacggcaccctgaacagcgcccaggaggacaagaagagcaaggtgcctgtggagggcctgaccatccccagcaagctgagtgatgagagcgccatggatgaggacaagcacgccacagctgacagtgatgtgagcagcaagtgcttcagcggccagctgtctgagaagaacagccccaagaacatggagaccagcgagagccctgagagccatgagaccccagagaccccatttgtgggccactggaacctgagcactggagtgctgcaccagcgggagagccctgagagtgacaccggcagcgccaccaccagcagtgatgacatcaagcccaggtctgaggactatgatgctgggggcagccaggatgatgatggcagcaatgaccggggcatcagcaaatgtggcaccatgctgtgccacgacttcctgggccgcagcagcagtgacaccagcaccccagaggagctgaagatctatgacagcaacctgcgcatcgaggtgaagatgaagaagcagagcaacaatgacctcttccaggtgaacagcaccagtgatgatgagatccccaggaagaggcctgagatctggagccgcagcgccatcgtgcacagccgggagcgggagaacatcccccggggctctgtgcagtttgcccaggagattgaccaggtgagcagcagcgcagatgaaacagaagatgagaggtctgaggccgagaatgtggccgagaacttcagcatcagcaacccagccccccagcagttccagggcatcatcaacctggcctttgaagatgccacagaaaatgaatgtcgggagttcagcgccaccaagaagttcaagaggtctgtgctgctgtctgtggatgaatgtgaggagctgggcagtgatgaaggagaggtgcacacccccttccaggcctctgtggacagcttcagccccagtgatgtgtttgatggcatcagccatgagcaccacggccgcacctgctacagccgcttcagccgggagagcgaggacaacatcctggagtgcaagcagaacaagggcaacagcgtgtgcaagaatgaaagcacagtgctggacctgagcagcattgacagcagcaggaagaacaagcagagcgtgtctgccacagagaagaagaacaccattgatgtgctgagcagccgcagccggcagctgctgcgggaggacaagaaggtgaacaacggcagcaatgtggagaatgacatccagcagaggagcaagttcctggacagtgatgtgaagagccaggagcggccctgccacctggacctgcaccagcgggagcccaacagcgacatccccaagaacagcagcaccaagagcctggacagcttccgcagccaggtgctgccccaggagggccctgtgaaggagagccacagcaccaccacagagaaggccaacatcgccctgtctgctggggacattgatgactgtgacaccctggcccagaccaggatgtatgaccaccggcccagcaagaccctgagccccatctatgagatggatgtgattgaggcctttgagcagaaggtggagagcgagacccacgtgacagacatggactttgaagatgaccagcactttgccaagcaggactggaccctgctgaagcagctgctgtctgagcaggacagcaacctggatgtgaccaacagcgtgcctgaggacctgagcctggcccagtacctgatcaaccagaccctgctgctggcccgggacagcagcaagccccagggcatcacccacatcgacaccctgaaccgctggagcgagctgaccagccccctggacagcagcgccagcatcaccatggccagcttcagcagcgaggactgcagcccccagggcgagtggaccatcctggagctggagacccagcactag

SEQ ID NO: 41276 - DNA, 369 bp, Artificial Sequence
  Description of Artificial Sequence: Synthetic coding sequence
agccacatcatgctgaacaacggcaccaagacagacatgctgggcctgggcacctggaagagccccccaggccaggtggccgaggccgtgaaggtggccatcaacacagtgtaccgccacatcgactgcagccacgtgcaccagaacaaggaccaggagcagctgaaggagcaggtggtgagaagagagtggctgttcatcatcagcaagccctggggcatctgccacaggaagtgcctggtgcggggcagctgcaggaaggtgctgagcggcctggagctggactacctggacctgcacctgatccactggcccaccggctgccaccctgggaaggagttctccttcctggatgagagcggcaactag

SEQ ID NO: 41277 - DNA, 3339 bp, Artificial Sequence
  Description of Artificial Sequence: Synthetic coding sequence
tgatactacctgaatgcccaggatggagctggaggagaggaggagaaggccgagggcggggccggggaggagcatgacctgtttgctggcctgaagcccctggagcaggagagcaggatggaggtgctgtttgcctgtgccgaggccctgcacgcccacggctacagcagcgaggccagccggctgactgtggagctggcccaggacctgctggccaaccccccagacctgaaggtggagcccccaccagccaagggcaagaagaacaaggtgtccaccagccggcagacctgggtggccaccaacaccctgagcaaggccgccttcctgctgactgtgctgtctgagaggcctgagcaccacaacctggccttccgggtgggcatgtttgccctggagctgcagaggcccccagccagcaccaaggccctggaggtgaagctggcctaccaggagagcgaggtggccgccctgctgaagaagatccccctgggccccagcgagatgagcaccatgcgctgcagagctgaggagctgcgggagggcaccctgtgtgactacagacctgtgctgcccctgatgctggccagcttcatctttgatgtgctgtgtgcccctgtggtgagccccaccggcagcaggcctcccagcaggaactggaacagcgagaccccaggagatgaggagctgggctttgaggccgctgtggccgccctgggcatgaagaccaccgtgtctgaggccgagcaccccctgctgtgtgagggcacccggcgggagaagggggacctggccctggccctgatgatcacctacaaggatgaccaggccaagctgaagaagatcctggacaagctgctggaccgggagagccagacccacaagccccagaccctgagcagcttctacagcagcagccggcccaccacagccagccagaggagccccagcaagcatggaggccccagcgcccctggggccctgcagcccctgaccagcggcagcgctggccctgcccagcccggctctgtggccggggccggccctggccccacagagggcttcacagagaagaatgtgcctgagagcagcccccacagcccctgtgagggcctgcccagcgaggccgccctgacccccaggcctgagggcaaggtgcccagccggctggccctgggcagccggggcggctacaacggccggggctggggcagccctggccggcccaagaagaagcacacaggcatggccagcattgacagcagcgcccctgagaccaccagtgacagcagccccaccctgagccggcggcccctgcggggcggctgggcccccacctcctggggccggggccaggacagcgacagcatcagcagcagcagcagtgacagcctgggcagcagcagcagcagcggcagccggcgggccagcgccagcggcggggcccgggccaagacagtggaggtgggccgctacaagggcagaagacctgagagccacgcccctcatgtgcccaaccagcccagcgaggccgccgcccacttctactttgagctggccaagacagtgctgatcaaggccggcggcaacagcagcaccagcatcttcacccaccccagcagcagcggcggccaccagggcccccacaggaacctgcacctgtgtgcctttgaaattggcctgtatgccctgggcctgcacaactttgtgagccccaactggctgagcaggacctacagcagccacgtgtcctggatcaccggccaggccatggagatcggcagcgctgccctgaccatcctggtggagtgctgggatggccacctgaccccacctgaggtggccagcctggccgaccgggccagccgggcccgggacagcaacatggtgcgggctgctgctgagctggccctgagctgcctgccccacgcccacgccctgaaccccaatgagatccagagggccctggtgcagtgcaaggagcaggacaacctgatgctggagaaggcctgcatggctgtggaggaggccgccaagggcggcggcgtgtacccagaggtgctgtttgaggtggcccaccagtggttctggctgtatgagcagacagctgggggcagcagcacagcccgggagggcgccaccagctgcagcgccagcggcatccgggccggcggggaggccggccggggcatgcctgagggccggggcggccctggaacagagcctgtgacagtggccgctgctgctgtgacagctgctgccaccgtggtgcctgtgatctctgtgggcagcagcctgtacccaggccctggcctgggccacggccacagccctggcctgcacccctacacagccctgcagccccacctgccctgcagcccccagtacctgacccacccagcccacccagcccaccccatgccccacatgcccaggcctgctgtgtttcctgtgcccagcagcgcctacccccagggcgtgcacccagccttcctgggcgcccagtacccctacagcgtgaccccacccagcctggccgccacagctgtgtccttccctgtgcccagcatggcccccatcaccgtgcacccctaccacacagagcccggcctgcccctgcccacctctgtggcctgtgagctgtggggccagggcaccgtgtcctctgtgcacccagccagcaccttccctgccatccagggcgccagcctgcctgccctgaccacccagcccagccccctggtgtctgggggcttccccccacctgaggaggagacccacagccagcctgtgaacccccacagcctgcaccacctgcatgctgcctacagagtgggcatgctggccctggagatgctgggcagaagagcccacaatgaccaccccaacaacttcagccgcagccccccctacacagatgatgtgaagtggctgctgggcctggccgccaagctgggcgtgaactacgtgcaccagttctgtgtgggcgccgccaagggcgtgctgagcccctttgtgctgcaggagatcgtgatggagaccctgcagaggctgagccctgcccacgcccacaaccacctgcgggccccagccttccaccagctggtgcagcgctgccagcaggcctacatgcagtacatccaccacaggctcatccacctgaccccagctgactatgatgactttgtgaatgccatccgcagcgcccggagcgccttctgcctgacccccatgggcatgatgcagttcaatgacatcctgcagaacctgaagaggagcaagcagaccaaggagctgtggcagagggtgtccctggagatggccaccttcagcccctag

SEQ ID NO: 41278 - DNA, 660 bp, Artificial Sequence
  Description of Artificial Sequence: Synthetic coding sequence
ctggagaaggaggagaagaaccccaacacagagttctacctgaagaacctggtgctgaccaccctgaacctgtttgtgggcggcacagaaacagtgtccaccaccctgcactacggcttcctgctgctgatgaagcaccctgaggtggaggccaaggtgcatgaaattgacagagtcatcggcaagaaccagcagcccaagtttgaagatcgggccaagaccctgtacacagaagctgtgatccacgagatccagagatttggagacctgctgcccatgggcgtgtccagaagagtgaagaaggacaccaagttccgggacttcttcctgagcaagggcatcgaggtgttccccatgctgggctctgtgctgcgggacctgcgcttcttcagcaacccccgggacttcaacccccagcacttcctgggggagaagggccagttcaagaagagagatgcctttgtgcccttcagcatcagaagaagaaactgcttccgggagggcctggccaggatggagctgttcctgtacctgaccaccatcatgcagaacttccgcttcaagagccggcagagccccaaggacatcgtggtgagccccaagcacgtgggctttgtgaccatccccaggaactacaccaagtgctacctgccctgctag

SEQ ID NO: 41279 - DNA, 132 bp, Artificial Sequence
  Description of Artificial Sequence: Synthetic coding sequence
acagacttcctgcggacccagcccaccaggaccagggtgaacaagcagcccctgctgctgaccctgagcctcttcaagctgagcctgcagctggatgcccgcatcacctttggagctgagagccctggatag

SEQ ID NO: 41280 - DNA, 375 bp, Artificial Sequence
  Description of Artificial Sequence: Synthetic coding sequence
atgaccctgaatgagcacgccgccttcaagcacctgttcaacaaggcccacctggccccacccctcatccacctgaccctgagcggccacagcacctgcttccgggagcaccgggtgggcggcaaggtgacagaccagcaggaccccaaggccgaggagttcttcctggtgcagaacaagatgaagagcctgccctgcctgcccctgagcacccagacccagcagcccagcgacttcagcatcttcagcccccccttcccccccttctacagcaccaagccacccctgagctcctggcctgtgctgaatgagctgctgggcaccccaccccgctggggcggcggccgggcagagggcctgctgaccagccagtag

SEQ ID NO: 41281 - DNA, 621 bp, Artificial Sequence
  Description of Artificial Sequence: Synthetic coding sequence
ctgggcatcagcctgggcatcgaccaggacagcgctgccttcctgctgagcaccatggccatcgccgaggtgttccgccgcatcggggccggctttgtgctgaaccgggagcccatccgggtcatctacatcgagctgatctgtgtgatcctgctgactgtgtccctgtttgccttcacctttgcccgggagttctggggcctgatgagctgcagcgtcttcttcggcttcatggtgggcaccaccggcggcacccacatccccctgctggccgaggatgatgtggtgggcatcgagaagatgagcagcgctgctggggtgtacatcttcatccagagcattgctggcctggccggcccccccctggccggcctgctggtggaccagagcaagatctacagccgggccttctacagctgtgccgccggcatggccctggccgctgtgtgcctggccctggtgcggccctgcaagatgggcctgtgccagcaccaccacagcggggagaccaaggtggtgagccaccggggcaagaccctgcaggacatccctgaggacttcctggagatggacctggccaagaatgagcaccgggtgcacgtgcagatggagcctgtgtag

SEQ ID NO: 41282 - DNA, 582 bp, Artificial Sequence
  Description of Artificial Sequence: Synthetic coding sequence
atgaacatcttcatgacctttgtgatcaacgtgctgaggaagaacctcttccacggcttcatggtgatcacccaggcccctgtgcgcatcctgcccagccaggagcgcatccgcaccccctgccacagccctgccatcctgctgagcagctgccgggtgctgagcggcaacaactgcatcatggccgccctgaccagcgtcatcaagaggaacctgctcttcttccggctggacctcttccccctgtggctgatcttcctgtacatcgtgaagatgggagacttccccagcgcccccacccacctgaacacagctgccatctgcacctgcctgctgcccatccccctgggcacccacagcgacctgctgtctgtgtcctgctcctggttccacctgtttgagaagggcccccccctgagctacaagcacctggtgcggcaggtgcaccccctgatgaatgctgacacagctgctgggggctttgtgtacacctgcaaggacaagctgcggagcctgctgtttggagaggtgaaggaggatggaaatggctgcttcatctgcatgagcctggagcagtgctag

SEQ ID NO: 41283 - DNA, 99 bp, Artificial Sequence
  Description of Artificial Sequence: Synthetic coding sequence
gacacagagaacagccctggagagctgagcctgagcaggaagacagaggcccagagaggagaggccatccacccccagagccacagcagagatggatag

SEQ ID NO: 41284 - DNA, 915 bp, Artificial Sequence
  Description of Artificial Sequence: Synthetic coding sequence
atggtggccaccggctgggcccggcgcagcggcctgcacccagccccccggcccctgcggggggcccaggaggccctggccaagaacctgtggagggaggagaggaaccggcccctcatcctgagcagcctcatcatcaagaagctgcactggccagagcaggagctggccaagaagagcatcctgaatgctgaggacagcctcatcatcgacaacaagaggagcatcagccacctgagcagtggagtgctgaaggacatcttcaccaccggcaccagcagctacaacgtgctgctgcagagcaaggaggagaagaagtaccacagccagaagcagagcagcagcacctacagcaagcgctgcaggaagcccagcaagagccccaacaccagccgcagcaaggaccccaggaggatgaaggccctggtgcctgtgaccagcagcggcacctggtactgcctggagcggcggcctgctgtgtttgtgaccagctctgtgagcagccctgtgaagttcacccatgacatctctgtgactggaaatggaattgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcaggtgaagtgccacttcaacagcggcagcagcttcctgtgcaccaagaccatcatctgtgacctgatcagcaagaacaaggacatctag

SEQ ID NO: 41285 - DNA, 402 bp, Artificial Sequence
  Description of Artificial Sequence: Synthetic coding sequence
atgggccaggatgctggccgcctgcagaggaggagccgggtgggctttggagaaaatggagcctgcaggaaggagcggcagaagctggccctggagggcagcaagaagggcccctggaagggccgcagcggggacagaaaaggaaacagcaagggccaggaggagctgggccgcggggcccgggtgaacacagagtggcccatgcccaggatgagggactggaaggagcggcggggccccagccgggaggaggcccacaagagcctgggccggcagggcatgggcctgcagagaggagaaggagtgcgggctgtggccgcccgggtgctgtgccacccctgccccctgagccggggcctgcagcacaacagaggagacagatttgtgtggggccaggtgtag

SEQ ID NO: 41286 - DNA, 255 bp, Artificial Sequence
  Description of Artificial Sequence: Synthetic coding sequence
atggtgctggccagcttcacccagaacatgaacatcaagtgctgtgaatttgtgtgccaggtggtgcagaagtacatcatcaacaacctggtgaagaagaggaactgtgagcccagctggagcgtgtacagcatcctgtgcctgtatgtgatcttcagcagcaaccgcttcatcatcatcggcttcaccaagaggagcaggaagaagtctgagggggagatcgccagcacagccctgcaggccaccagcggctag

SEQ ID NO: 41287 - DNA, 156 bp, Artificial Sequence
  Description of Artificial Sequence: Synthetic coding sequence
ctgaagccaggcttcttcctgtccttcttcatctccatgacctacctgttctccttcttcttcttcggcaagagcttccgcagcctgctgggggagggcttcagcctgtgcctgagcctgagcctgacccacacccacacccacacccacagctag

SEQ ID NO: 41288 - DNA, 438 bp, Artificial Sequence; identical to SEQ ID NO: 41157
  Description of Artificial Sequence: Synthetic coding sequence

SEQ ID NO: 41289 - DNA, 3144 bp, Artificial Sequence
  Description of Artificial Sequence: Synthetic coding sequence
atggcccactgcggccagctgaccaactggctgtgcctggcctgggagaggaaggagagcccagacttcctgagcatcttcctgcgctacatcgacctgacccccaagctgcacaagatctgcagcgacaagaccatcacccagaagacccactgcctgctgcccctcatcagcagcgccctgagcagcatcgtgctgatccagggctggtggcagaagacagcccacaagtatgcctacaagggggccaagcacatcgagcagcagaacccccagagccgccaccggcccaggcctgctggggccctgccccagatcagccgggacagccggcagcgctgcctgctgctgcgcttcctggtgcggccccggggcttctccttctcctttgctgagcctgctgctgccttccctggggccacagccatggccgccagcctgtctgagcggctcttcagcctggagctgctggtggactgggtgcggctggaggcccggctgctgcccagccctgctgctgctgtggagcaggaggaggaggaggaggagaaggagcagggcgaggccagcagcccccggggcctgtgcccagctgtggccttccggctgctggacttccccaccctgctggtgtaccccccagatggccctggggccccagctgctgagccctggccaggagtcatccgcttcggccggggcaagagctgcctcttccggctgcagcctgccaccctgcactgccgcctgctgcggacccccctggccaccctgctgctgcagctgcccccaggccggcccacccccaccccccagctgctgggcgcctgtgacatcagcctggccacagctgcccaccgggtggtgggccctgctgccagcggctgcagccaccgccaccggggccgcttccccctgcacaacagagtgggggagaggactggagacatcgccctggcctaccgcctgacagacctgggcagccggctgctgagccagctggagcggcccctgaccttcaccaggactggaggcggcgctgaggtgagcccccagacccagcaggagcggcagcagctgcagcagcctgccagccagcccagccccaaggaggccgacaagcccctgggggagctggagatccctgaggcccagaaggacctgaaggagatggtgaagagcaaggcagaatgtgacaacgtgggctctgtggagaatggcaagaccaacagcgtggtgacctgcagcggggctggaaatggaagaaatgtgagcagcctgaatgaggaggtgacagagctggacatggagaccaacatcttctgccccccacccctgtactacaccaacctgacccaggagaagcccccaccagcccaggccaagatcaccatcgagccccagatgaatgcccctgaggagatggatgatgccagccctgagaagaagagggtgaaccccccagcccacaggagctgcctgaagcaccccagcagcgctgcccacgagcacccccccatgctggtgaaccccccccacatccagaacattggagccaccaaccagacctgccagacagagcagaaccgcatcaacaccatccggcagctgcccctgctgaatgccctgctggtggagctgagcctgctgtatgaccagcctgtgaccagccctgcccacatccacccccacctggcctggctgtacagaacagaggacaagaagagccctgagagcagcgccaagagcacctgccgctctgaggccaagaaggacaagaggtctgtgggcggctgtgagaagtctgtgtccctgcagtacaagaagaaccagatcgagaactacaaggaggacaagtacagcgagaagagcagcggggccctgcacaagagggtgcccaagggccgcctgctgtatggcctgaccaacaccctgcggctgcggctgaagctgaccaacccagacatgctggtggtgcatgagaagcgggagctgtacaggaagaggcagagccagatgctgggcaccaagttccgcatccccagcagcaaggtgaagctgctgagcagcgctgagcagagccagaagccccagctgcctgaggacaagtacctggacagtgatgccagcttcacagaaaattctgacaccagccggcagatcagcggcgtgtttgatgagcccagcaccagcaaggagaccaagctgaagtatgccacagagaagaagacagtggactgcagcaagaaccgcatcaacaacgtgtccctggaggaggtggtgtccccagccaacagcatcatccctgagcggctgacccccaccaacatcctgggcggcaatgtggagatgaagatccagagcccctgtgtgttccagcaggatgctgtggtggacagaattgtggacaaggagattgacatccggcaggtgaagaccacagacaatgacatcctgatggctgacatcagtgacaagaggacaggcaagaacagctgctatgagaacatcagcgagctgaagtacagtgatgacctgagcagcccctgctacagcgaggacttctgcaccagcgaggacaccagccgctccttcaaggcccatgacagcagcagcaggacagagaaccccaagcacagccagtacaccagcaagagcagtgacacaggagtgtccaagaagaagaacagcagtgacaggagcagcatcctgagcccccccttctctgctggcagccctgtgcacagctacaggaagttccacatcagcaagacccaggacaagagcctggaggaggccagcagcatcagcgccagtgacctgagcagcacccactggacagagcagaaggagaaccagattgaccagaacagcatgcacaacagcgagatcaccaagagggcccaggacatctctgtgaagaccaggagctcctggaagagcctggagaagagccagagcccccagaccagccaggtgtcctcctacctgcccagcaatgtgtctgagctgaatgtgctggacagcagcaccagtgaccactttgaggagggcaatgatgatgtgggcagcctgaacatcagcaagcagtgcaaggacatctgtgagctggtgatcaacaagctgcccggctacaccatgtag

SEQ ID NO: 41290 - DNA, 561 bp, Artificial Sequence
  Description of Artificial Sequence: Synthetic coding sequence
cgcagcctgctgaaggagctggagaacaccaaggaccacaccctgctgctggagaagaggctgaagaagctgagccgggagggcagcagccaccacctgccccggcaggtgcggcccggccctgtgtacaagccagccccagccaggaaccaccggccccggggcggccggggcaaggccagccccaccagcttccacgtgagcccccgggcccccctggcccccctggcctccatgcccagctctgtgcccaagaccagcattgagagcctgggcagccccagcagcctgagcagcagccaggccagcgagcccctgtgccccctgaagcaccccagccaccggcccccagccagcaccctgagccccaacctgaccagcagcacagagagcctgggcctgctgagccgggagacccctcatgctggaagaagacggcagggcagccgcttcccccagcccggctgtgccaatgctgctggccgcaccaggcaccagaaccccaggcacagccacggccaccgcatcagtgacatccacgagcagctgggcatctcctag

SEQ ID NO: 41291 - DNA, 405 bp, Artificial Sequence
  Description of Artificial Sequence: Synthetic coding sequence
atgagggagcccatctacatccacagcaccatggtgttcctgccctgggagctgcacaccaagaagggcaagatggccctgctggccagcaatggctgcttcatccgctgcaatgaggccggggacatcgaggccaagagcaagacagctggggaggaggagatgatcaagatccgcagctgtgccgagcgggagaccaagaagaaggatgacatcccagaagaagataaaggaaatgtgaagcagtgtgagatcaactacgtgaagaagttccagagcttccaggagcacaagctgaagatcagcaaggaggacagcaagatcctgaagaaggcccagaaggatggcttcctgcaggagaccctgctggacagagtggccgtgattgcctgcctgcacctgtag

SEQ ID NO: 41292 - DNA, 447 bp, Artificial Sequence
  Description of Artificial Sequence: Synthetic coding sequence
atggagcacatgctgctggccaaccacacagacaaggccaccttcaccggcacccagaggcagaggagctgcagcggggcctctgtgtcccagccccggcccctgcggggcaagctggtgggctactgggacccccacagccggctgctgagccggggccgggccctgggctctgtgtctgcccccagcaccccccggggccggggctggaaggccacctttgatggctgcatcctgcatgatgacctgctgaccaaggtgcacggcttccagagcctcatcggcctgcagcagcacctggcctgtggggacagcggcagcctgatgaagaactgccatgatgtgaggaagagcctgtctgagcggggctggggcgccgcctgctggggcggcggcggcgtggccagccgggagaagctgcaccccctggccgagagcggcacctag

SEQ ID NO: 41293 - DNA, 1296 bp, Artificial Sequence
  Description of Artificial Sequence: Synthetic coding sequence
atgtggccccagccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcacaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagcgggaggagaagatccaggagcaggaggagaagatccgggagcaggaggagaagatccgggagcaggaggagatgatgcaggagcaggaggagaagatgggagagcaggaggagaagatgcaggagcaggagaagatgaggcggcaggaggagaagatccgggagcaggaggagaagatccgggagcagaaggagaagatccgggagcaggaggagaagatctgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgagggagcaggaggtgcggctgcggcagcaggaggagaagatgcaggagcactag

SEQ ID NO: 41294 - DNA, 1701 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagtgagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagtgaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgagagcagcacccccagcagcggggccggcacagccaccaacagcgagagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgacagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 41295 - DNA, 183 bp, Artificial Sequence
  Description of Artificial Sequence: Synthetic coding sequence
aaaggctgggtgagccacctgttcctggcccccaccaactttgaggagttcaccgccccagccaccccaccccactgcagccagtgcctgcggagcaactgcagcacctgggccacagctgccatcatcgagaggagcctgcaggtgcccttcctgtacctgagcaccccaggcggccactag

SEQ ID NO: 41296 - DNA, 399 bp, Artificial Sequence
  Description of Artificial Sequence: Synthetic coding sequence
atgagccagccctggctgtacagccagtgcatcatcagcggcaagcccagcgaggaggccgctggagaaaatggcagcatctctgctgccctgcggcccctgctgctggtggctgatgtgcctgtgctgggctacctgtgccccagctctgtgtcctctggagtgtgtgaggccaagctgctgggctggggcctgggcggcgtgtctgctgcccctgaggccaagaccaaggccgaggccgaggccgaggccgaggccaccctggtgcggaggaagctgcaggtggagaagctggtggaccgggacctggacctgaccgtcatcctgatggtgcccatgcccagcgcccggcggcccccagccctggccaccaccggcagctgcagccccccaggatag

SEQ ID NO: 41297 - DNA, 1395 bp, Artificial Sequence
  Description of Artificial Sequence: Synthetic coding sequence
atgaggaggcacagcgagacagatgtggaggagcagacccaggagctgaagaccatcacccagctgcaggagcagtgccgggccctgcagatccagggcgtgaaggagaacatggaccagaacaaggccaccctggccctgctgcggagcaacatcagaagaggagcccaggactgggccctggccaagaagtatgaccagtggaccatcagcaaggcctgtgggaagaacctgcccctgcggctggcccactgccgcagcaccatggaggtggtgcgggagaagctgaggaaatatgtgtttgacagagtgaacatgcacaacctgctgatccacctggtgagaagaagaggccagaagctggagagcatgcagctggagctggacagcctgcggagccagccagatgccagcaaggaggagctgcggctgctgcagatcatccggcagctggagaacaacatcgagaagaccatgatcaagatcatcaccagccagaacatccacctgctgtacctggacctgctggactacctgaagacagtgctggccggctaccccatcgagctggacaagctgcagaacctggtggtgaactactgcagcgagctgagtgacatgaagatcatgagccaggatgccatgatgatcacagatgaggtgaagaggaacatgaggcagcgggaggccagcttcatcgaggagcggcgggcccgggagaaccggctgaaccagcagaagaagctgattgacaagatccacaccaaggagaccagcgagaagtacagaagaggccagatggacctggacttccccagcaacctgatgagcacagagaccctgaagctgcggaggaaggagaccagcacagctgagatggagtaccagagcggcgtgacagctgtggtggagaaggtgaagtctgctgtgcgctgcagccacgtgtgggacatcaccagccgcttcctggcccagaggaacacagaggagaacctggagctgcagatggaggactgtgaggagtggagggtgcagctgaaggccctggtgaagcagctggagctggaggaggccgtgctgaagttccggcagaagcccagcagcatctccttcaagtctgtggagaagaagatgacagacatgctgaaggaggaggaggagcggctgcagctggcccacagcaacatgaccaagggccaggagctgctgctgaccatccagatgggcatcgacaacctgtatgtgcggctgatgggcatcaacctgcctgccacccaggtgcctggggtgcggctgagctgccacaccccaggcccctgggccggccctgagggccggcaggcccagaggctcatcgagggcaagctgaaggccgccaagaagaagaagaagtag

SEQ ID NO: 41298 - DNA, 381 bp, Artificial Sequence
  Description of Artificial Sequence: Synthetic coding sequence
tctggcagccctgctggcctgctgaagggggacagcaagaagcccagccagaggagagtgaagaggcagccctacagcaccaccaaggtgaccagcggcagcaccttcaatgaaaacaccaggagatatgctgtgcacaccaaccagtgcagaagaccccacggcagccgggtgaagaagaagcgctacccccaggaggatgacttccaccacacagtgttcagcaacctggagcggctggacaagctgcagcccaccctggaggccagcgaggagagcctggtgcacaaggacagaggagatggagagaggcctgtgaatgcccgggtggtgcaggtggcccccctgcggctggagagccgcatcagcatcggggagtag

SEQ ID NO: 41299 - DNA, 1314 bp, Artificial Sequence
  Description of Artificial Sequence: Synthetic coding sequence
atgtggccccagccccacctgcccacccacccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcagaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagcgggaggagaagatccaggagcaggaggagaagatccgggagcaggaggagaagatccgggagcaggaggagatgatgcaggagcaggaggagaagatgggagagcaggaggagaagatgcaggagcaggagaagatgaggcggcaggaggagaagatccgggagcaggaggagaagatccgggagcagaaggagaagatccgggagcaggaggagaagatctgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgagggagcaggaggtgcggctgcggcagcaggaggagaagatgcaggagcactag

SEQ ID NO: 41300 - DNA, 597 bp, Artificial Sequence
  Description of Artificial Sequence: Synthetic coding sequence
tgaaccagccggcagacctgggtggccaccaacaccctgagcaaggccgccttcctgctgactgtgctgtctgagaggcctgagcaccacaacctggccttccgggtgggcatgtttgccctggagctgcagaggcccccagccagcaccaaggccctggaggtgaagctggcctaccaggagagcgaggtggccgccctgctgaagaagatccccctgggccccagcgagatgagcaccatgcgctgcagagctgaggagctgcgggagggcaccctgtgtgactacagacctgtgctgcccctgatgctggccagcttcatctttgatgtgctgtgtgcccctggcagcaggcctcccagcaggaactggaacagcgagaccccaggagatgaggagctgggctttgaggccgctgtggccgccctgggcatgaagaccaccgtgtctgaggccgagcaccccctgctgtgtgagggcacccggcgggagaagggggacctggccctggccctgatgatcacctacaaggatgaccaggccaagctgaagaagccaggccagcagagcgagaccctgagcctgaagaagaagtag

SEQ ID NO: 41301 - DNA, 4188 bp, Artificial Sequence; identical to SEQ ID NO: 41124
  Description of Artificial Sequence: Synthetic coding sequence

SEQ ID NO: 41302 - DNA, 366 bp, Artificial Sequence
  Description of Artificial Sequence: Synthetic coding sequence
atggagtttgtgctgtcctgggtgttcctggtggccatcctgaagggcgtgcagtgtgaggtgcagctggtgcagagcggcggcggcctggtgcaccctgggggcagcctgcggctgagctgtgccggcagcggcttcaccttcagcagctatgccatgcactgggtgcggcaggcccctgggaagggcctggagtgggtgtctgccatcggcaccggcggcggcacctactatgctgacagcgtgaagggccgcttcaccatcagccgggacaatgccaagaacagcctgtacctgcagatgaacagcctgcgggcagaggacatggctgtgtactactgtgcccgggacacagtgcggggctag

SEQ ID NO: 41303 - DNA, 777 bp, Artificial Sequence
  Description of Artificial Sequence: Synthetic coding sequence
cgcagcctgctgaaggagctggagaacaccaaggaccacaccctgctgctggagaagaggctgaagaagctgagccgggagggcagcagccaccacctgccccggcaggtgcggcccggccctgtgtacaagccagccccagccaggaaccaccggccccggggcggccggggcaaggccagccccaccagcttccacgtgagcccccgggcccccctggcccccctggcctccatgcccagctctgtgcccaagaccagcattgagagcctgggcagccccagcagcctgagcagcagccaggccagcgagcccctgtgccccctgaagcaccccagccaccggcccccagccagcaccctgagccccaacctgaccagcagcacagagagcctgggctacctgagcagcctgagcagcagccagcccccagagcccctgcggcccctggagtgccccagccacaagccctgtggccgcagcctgcccaggagaagaaatcctggctgggtgtcctggagcgacagcatgcaggccgacagcgagacagatgccatcatctgccccatgtgcaaggcccctgagaggagctgcccccacacctggtgggtgcccagcagccccagggtcatccggggcgtgggccgctgcagcgaccccaacctgggcctgtcctggaggcaggaggccgcccgggcctggtgccactgcaccagcagccagtaccccttcaagcaccccaacctgcccacccacctgcccaaggccagcttctag

SEQ ID NO: 41304 - DNA, 2253 bp, Artificial Sequence
  Description of Artificial Sequence: Synthetic coding sequence
gactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaaggacagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcatcggggaggaggtgctggccctgctgattgctgcccgctgtgtggtgcctgccctgcacctggtgaacacagaggtggactttggccactgcttcctgaagtacccctatgagaagaccctgcagctggccgaccaggatgacctgcccggcttctatgaggtgcagccccaggtgtgtgaggaggtgcccaccgtgctcttcagcagccccaccccatctggagtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttctag

SEQ ID NO: 41305 - DNA, 294 bp, Artificial Sequence
  Description of Artificial Sequence: Synthetic coding sequence
gaggtgcagctggtgcagagcggcggcggcctggtgcagcccggcggcagcctgcggctgagctgtgccggcagcggcttcaccttcagcagctatgccatgcactgggtgcggcaggcccctgggaagggcctggagtgggtgtctgccatcggcactggaggcggcacctactatgctgacagcgtgaagggccgcttcaccatcagccgggacaatgccaagaacagcctgtacctgcagatgaacagcctgcgggcagaggacatggctgtgtactactgtgccaggtag

SEQ ID NO: 41306 - DNA, 714 bp, Artificial Sequence
  Description of Artificial Sequence: Synthetic coding sequence
tgaacctaccaccgcatccccatgccagacttctgtgccccccgggaggaggactttgaccagctgctggaggccctgcgggccgccctgagcaaggaccccggcaccggctttgtgttcagctgcctgagcggccagggccgcaccaccacagccatggtggtggccgtgctggccttctggcacatccagggcttccctgaggtgggggaggaggagctggtgtctgtgcctgatgccaagttcaccaagggggagttccaggtggtgatgaaggtggtgcagctgctgcctgatggccaccgggtgaagaaggaggtggatgctgccctggacacagtgtctgagaccatgacccccatgcactaccacctgcgggagatcatcatctgcacctaccggcaggccaaggccgccaaggaggcccaggagatgaggcggctgcagctgcggagcctgcagtacctggagagatatgtgtgcctgatcctcttcaatgcctacctgcacctggagaaggctgacagctggcagaggcccttcagcacctggatgcaggaggtggccagcaaggccggcatctatgagatcctgaatgagctgggcttccctgagctggagagcggggaggaccagcccttcagccggctgcgctaccgctggcaggagcagagctgcagcctggagcccagcgcccctgaggacctgctgtag

SEQ ID NO: 41307 - DNA, 648 bp, Artificial Sequence
  Description of Artificial Sequence: Synthetic coding sequence
tatggagtgtgcagcgtgggcctggagtggctggcctacctgctggtgccctacagcctgggcgccagcgccaccagcctgctgggcctgctgggcctgtggctgcccaggcctgtgcccctggtggccggggccggcgtgcacctgctgctgaccttcatcctcttcttctgggcccctgtgccccgggtgctgcagcacagctggatcctgtatgtggccgccgccctgtgggtggtgggcagcagcctgaacaagacaggcctgagcaccctgctgggcatcctgtatgaggacaaggagcggcaggacttcatcttcaccatctaccactggtggcaggccgtggccatcttcaccgtgtacctgggcagcagcctgcacatgaaggccaagctggccctgctgctggtgaccctggtggccgccaccgtgtcctacctgaggatggagcagaagctgcggcggggcgtggccccccggcagccccgcatcccccggccccagcacaaggtgcggggctaccgctacctggaggaggacaacagtgatgaaagtgatgctgagggggacctgggagatggagaggaggccgaggccgaggcccctcctgctggccccaggcctggccctgagcccgccggctag

SEQ ID NO: 41308 - DNA, 3828 bp, Artificial Sequence
  Description of Artificial Sequence: Synthetic coding sequence
atggactgggatgatgagtacagccacaacagctttgacctgcactgcctgctgaacagcttccctggggacctggagtttgagcagatcttcagtgacattgatgagaagattgagcagaatgctgccagcatcaagcactgcatcaaggagatccagagcgagatcaacaagcagtgccctggggtgcagctgcagaccaccacagactgctttgagtggctgaccaactacaactacagcaccagcgagagcagcttcatcagccacggggacctgatcaagttcttcaagaccctgcaggacctgctgaagaatgagcagaaccaggaggagatgaccctggacctgctgtgggacctgagctgccacagctctgtgtccttccccagcaccctgagcggcaccagcttccacttcctgagcaggaccagcctgcacagcgtggaggacaacagctccatggatgtgaagtccatgtgggatgacatccggctgcacctgcggcgcttcctggtgtccaagctgcagagccacaatgagatcaacaacagccagcagaagatcctgctgaagaagcagtgcctgcagcagctgctcttcctgtacccagagagcgaggtgatcatcaagtaccagaacatccagaacaagctgctggccaacctgctgtggaactgcttccccagctacaacagagacagcaacctggatgtgattgcccacggctaccagagcaccatgctgaagctgtacagcgtcatcaaggaggacttcaacaccctgtgtgagatcctggcccccagctccatggtgaagttcatcaaggagacctacctggacacagtgacagaggagatggccaagttcctggagaacttctgtgagctgcagttcagagaaaatgctgtgcgggtggtgaagaccagcaagagcagcagcaagcacagaggagctgtgcacgccctggtgaccacagaatgtccccagaagggcaggaacttcagcctgcccctggacaaggtggagttcctgagccagctgatcaagagcttcatgaagctggagaagggcgtgcaggagctgtttgatgagatcctgctgagcctgaagatcacccgggacaccagcggcatcctggagaagagtgaccgggaggtggtgatggagaagccccgggccaatgagaccaacatccccagcgagcagagcctgcccgggaaggaggccaccctgctggactttggctggaggtctgccttcaaggaggtgtccctgcccatggcccactgtgtggtgacagccatcgagggcttcagcaccaagatcctgcagcaggagcagaatgaaagaagcagcgctgtgtcctatgccatgaacctggtgaatgtgcagcaggtgtggcaggacagccacatgtttcctgaggaggagcagcccaagaagattggcaagttctgcagcgacatcatggagaagctggacaccatgctgcccctggccctggcctgcagagatgacagcttccaggagatccgggccaacctggtggaggcctgctgcaaggtggccacagctgtgctgcagaggctgcaggagcgggccaaggaggtgcccagcaaggcccccctgaagaacctgcacacctacctgagcacagctgtgtatgtgttccagcacttcaagagatatgacaacctgatgaaggagatgaccaagaagcccatcttcctggtgctggtgcagcgctaccaggagttcatcaacaccctgcagttccaggtgaccaactactgtgtgcgggtgtgtgccaccagcatcctgcaggatgctgagagccaccactgggatgactacaaggccttctatgaaggagagcgctgcagcttcagcatccagatgtggcactacttctgctggagcctgcactatgacctgtggaccatcctgccccccaagctggcccaggagatcctggtggaggtgctggagaagagcctgagcctgctggccagccgctatgcccgggcccaccccagcaggaagaggaccccccagctgcggctggatgtgaccaccatcctgatctgcacagagaacatgctgtggagcgtgtgcacctctgtgcagaagctgctgaacccccaccagcacacagatgacaagatcttcaagatccacacccactgcaacaacctcttcaccaccctggtgatcctgaccagccccctgacagagctgtacaagaccttccagcacggcctggatgagagcgccagtgacagcctgaagagcttcttcaagcagcccctgtactgggtgtcctgcatcagccacttctaccccagcctgctgcggaccccatctgctgggggcctgaaggccgagggccagctgaagctgctgctgagccagccccgctgcaactggaacctgctgctggagaccctgctgcaccatgatggcctgctgctgcgcatcctgctgaagagcagcaagcaggtgtctgacacagagaacaacctgaaccagggccccagcctgatggaggccatcttcaagatcctgtaccactgcagcttcagcccccagacctttgccaacgtgtttgtgtcctacatggaggaggagcagctgtgggacttcctgtacaacatccctgtgtccacctgtgtggagtatgagctggaggtgatccgctgcctgcggctggccctgacagatgccatcaaggacacagtgcagcagatcgtgtctgtgatgagcagcagaagaaactgtgagaccaacctgaacaagcacatcgtgcctgactgcctgctggagagcatgcccaaggagtggaactacagccccaaggagaccaacaggaaggagagctgcaagagcttcacccggctgacagcccaggccgtgtccatcgtcatcagcaagctgcccaccgtgattgcctgcctgcccccacctgtgaagtacttcttcttcctgtctgagaggaagatgagcaagaagtttgtggagctgaagaaggccggcctgctggtgtggaacctgattgtcatcatctgccgcatctttgaagatggcaacacagtggagctgctgaccggggccagcctggaccgctggagcaaggagaagctgggcctcatctgcatgtgcctgaagagcatcatgggagaccagaccagcatccacaaccagatgatccagaaggtgatccagagcattgagcagcagaagcccaactggattgagcggcagctgctgaaggccaggaagctgagcacagaatgtgccttcatgaccatcgagaagagcacagccctgcaggagggagatgtggccctggagctgacagagcagaagatcaacaccatggtgctggacctgtgccacaagccaggcggccgggagtacctgcggcagatctaccacatcatgcagctgaatgaggagtacctgaaggagcagctgttctccatgaacagcagcgaggagaagcccctgcccatccggcccctgaagaccaccctgcggagcattgaggaccagcccagcgccttcaaccccttccacgtgtacaaggccttcagcgagaacatgctggaccagagcgccatcaccaagtggaactggaactgggccaagctgctgcccaactacctgcggctggacaagatgaccttctctgtgctgctgaagaaccgctgggagatgaagaaggatgagaccctggaggaggaggagaaggccatcctggagcacctgaagcagatctgcaccccccagaacagcagcgccagtgacaacatcgaggagcagtag

SEQ ID NO: 41309 - DNA, 132 bp, Artificial Sequence
  Description of Artificial Sequence: Synthetic coding sequence
cggctgcggagccggccccaggccggcggggccggcagcgctgctgcctgtggccctggccagggccgcttcagaagagctgccccccggcccagcagcagccgggtgtgtggccagaggaccagcaggtag

SEQ ID NO: 41310 - DNA, 585 bp, Artificial Sequence
  Description of Artificial Sequence: Synthetic coding sequence
atggtgacctggagccacagcaacagcaacaaggagctgaagcaggagaacagcgccctggccgagcagctgcaggtggtgctgattgacaaggccggcatgcagtgtgacctggaggagctgaagaagaagctggagctgacagagctgaccctgcagcagctgagctcctggtgtgaggccccagatgccaaccagcagctgcagcagcccacagatgagcgggcccagctggaggcccacctgggccaggtgatggagtggctgaagtacctgcagatggagcgggagcagtatgcagagtacctgcacggggagagcgccatgtggtggcagaggatgagggagatgtctgagcaggtgcacaccctgcgggaggagcgggtgcacagcatgagccgggtgcaggagctggagaccatcctggccgagctgaggaaccagctgaacccctgccccaggagcctgcagcagggcccccccaagtggagccgcagctacaagcagaggctgagcacctgtggccgctcctggaggatctggcaggacagcttcaagcccaagtggaagaagatgagggcctag

SEQ ID NO: 41311 - DNA, 879 bp, Artificial Sequence
  Description of Artificial Sequence: Synthetic coding sequence
atgatgttctactggctgctgagcatcgtgggccggcagagggccagccctggctggcagaactggagcagcgccaggaacagcgccagcgctgctgaggcccgctccatggccctgcccacccaggcccaggtggtggtgtgtggcggcggcatcaccggcacctctgtggcccaccaccagagcaagatgggctggaaggacatcgtgctgctggagcagggccgcctggccgccggcagcacccgcttctgtgccggcatcctgagcacagcccggcacctgaccatcgagcagaagatggctgactacagcaacaagctgtaccaccagctggagcaggagaccggcatcagaacaggctacaccaggacaggcagcatcttcctggcccagacccaggacaggctcatcagcctgaagaggatcaatgccggcctgaatgtcatcggcatccccagcgagatcatcagccccaagaaggtggccgagctgcaccacctgctgaatgtgcatgacctggtgggcgccatgcacgtgcctgaagatgctgtggtgagcagcgcagatgtggccctggccctggccagcgctgccagccagaatggagtgcagatctatgacaggacctctgtgctgcaggtgatgggcaagaagggccaggtgactggagtggagacagacaagggccagatcgagtgccagtactttgtgaactgtgccggccagctgctgtggatgctgatggaggagttcatcttcggcaccggccgggtggccagctgcctgggcgccctgcggaggacccagaaccagttcagcctgcgggcccggacctcctggaggttccgcatctaccggggcctgggcagcctgtag

SEQ ID NO: 41312 - DNA, 1989 bp, Artificial Sequence; identical to SEQ ID NO: 41230
  Description of Artificial Sequence: Synthetic coding sequence

SEQ ID NO: 41313 - DNA, 297 bp, Artificial Sequence
  Description of Artificial Sequence: Synthetic coding sequence
gtgtgtggcagcacccaggagaagacagtgttccggctggaggccatgctggagaggacagctggggtgcagagcaaggaggccgccctggaggaggaggccgtgctgaaggtggaggacatcatggccgaggtggaggtggtggtggaggtggaggtggtggtggaggtggagccagatgtgggctggcagaaggagggccagagggcccagcccggccctggccccagcaccccaggccccagcatggacagcctggaggtgctgcacctggagctgggctctgtgaatgcctag

SEQ ID NO: 41314 - DNA, 459 bp, Artificial Sequence
  Description of Artificial Sequence: Synthetic coding sequence
atgctgttctcctttgagcacaaggctgtggccctgagcgccacccggcgggccaccccccggccccagccctgggtgctgggcctgcagggccggggcggggagggagatgcccggacctgtggggccggccgggagcggggcctgcccggccctgccctggacacagagccccgctgggacccccggcggctgtgtgaggccctgcgggcccctggccggcggctggagggcgccggccagcccccagccaccagcggcggccctgccaccagcggccgcagcaaggagccctggggccacatcagcggctgtggggaccccccaggggccttccggggcagcggccgcatctgccagggcaccagcggggcccggccctgcttctgccgggcccctggctacccctggatggccgccctgtgccccaggagaagacctggccgccacagcggctag

SEQ ID NO: 41315 - DNA, 441 bp, Artificial Sequence
  Description of Artificial Sequence: Synthetic coding sequence
cctggccccccaggccggcctgggaagccaggcttccccaagccaggcggccctgggggccctgccatccctggggcccctggccggccctttgtgcccggcatccctggctggccaggggccccagctgcccctggcttccccatgcccagcggccccaggagccctgggggcccctggggccctgggggccccatcggccccatcagccctggccctggcatccctgggggccctgggggcccccggggccctggccggcctgctggccccaccagccccttcggcccctacggccccctgagccctggcttccctggcagccctggcaccccaggcttccccacagcagatggccctgggggccctggcaaccctggcagcccctggagccctggcctgccctacccccggggccctgctggccctgggggcccctag

SEQ ID NO: 41316 - DNA, 84 bp, Artificial Sequence
  Description of Artificial Sequence: Synthetic coding sequence
gtgccccccctgcacagcagcctgggggaccgggcccgcttcctgcggccctgcctgaagaagaagaccaagaagaagaggtag

SEQ ID NO: 41317 - DNA, 3063 bp, Artificial Sequence
  Description of Artificial Sequence: Synthetic coding sequence
cagctgcggcgctctgagctggagcacagcgtggacctggaggaggccctgggccgcctggaggccgctgaggagaggagcacaggcctgtgccaggtgaatgccctgctgcgggagcagctggagcacatgaagaaggccaatgatgccctgggccgggagctggccggcatgactggatctgtgcagaggctgcagggcgagctggagctgcggcgctgggcccagaggcaggagcccagcaggaccaggtctgggggcctgggccagccccgggacctgctgctgctgtggaggcaggccgtggtgctgggcacagacctggccgagctgcgggtggccacagagcggggcctggccgacctgcaggccgacacagccaggacagcccggcggctgcacacagcctgcctgaacctggacagcaacctgcggctgagcgccagcagcacagccagcaccctgggccagcagctgcgggacaaggccggggagatgctgcagctgcagggccgctgggatgctgagaaggtggccctgcaggcccggctgtctgagcagaccctgctggtggagaagctgacagagcagaatgagcagaaggccaagaccatcgccgccctgaggacagacctgcagaacctggtgggcggccaggacggcggcggctgtgtggccggcgtgtgccacccctgcagcggcgtgtccccagccaccggcagcctggtggcccaggaggatgcccgctgcctggagctggccggcagcagcatcacagagctgggggagccccggcggcccctgcggagcccccagagggccaccagcccccaccagggcgccagccccccccacatctgcagccctgccaccctggaccctgccctgcaggccatgagagctgccattgaaagacgctggaggcgggagcaggagctgtgcctgcagctgaagagcagccaggccctggtggccagcctgcaggagcagctgtctgagagcagaagagagctgtgggccgcccagaagctgcagcaggagcgggcccgggagcaggcccgggagcgggaggccctgcggggccagctggaggcccagaggctggaggtgcagcagtgccgggccagctgcaagctgctgggccgggagaaggccgccctggagatggtggtggaggagctgaagggcaaggcagatgctgctgatgctgagaagcagggcctggaggccgaggccgctgagctgcagaggagcctgctgctgcaggccgagcggcgggaggagctggccctgcggcgggagaggagctgccgggccctggagaccagccagggccgcctgcagcagctggaggagaaggtgtctggcctgcgggaggagctggcctctgtgcgggaggccctgagcacagcccagctgcagagagatgtggtggagagcgagcgggagggcctgcggagcgccctggcccgggcagaatgtagcaatgctgacctggagctgctggtgcggcggctgaagtctgagggcgtggagcagagggacagcctggccgccatggccgccctgatggagggcctggcccaggacaagagcgccctgaaccacctggccctgcagctggagcaggagcgggaccagctgcgggagcagaggaagaccctggagcaggagcgggcccgggccggggagcagctggcccaggccgagcagcagctggccctggagcgggcagagcggcggggcctgcagcaggcctgtggccgcctggagcagaggcaggagcagctggagggccaggccgccctgctgggccgggagaaggcccagctgcaggagcaggtgggccaggtgacctgccagaagcaggccctggaggagcagctggcccagagcctgcaggaccaggaggcccagatgggcaccctgcagcaggccctgcagggcaaggatgccctgtctgaggagcgggcccagctgctggccaagcaggaggccctggagcggcagggccgcctggccgctgaggaggccgctgacctgcgggtggagcgggacagcctggagagcagcctgctggaggcccagcagctggccaccaagctgcaggagcagctggaggaggaggcccggtctgctggcctggcccggcaggccctgcaggtggagatggagcagctgcagagcgactgggaggtgcaggagatgaagctgcggcaggacacagtgcggctgcagaggcaggtggcccagcaggagcgggaggcccagagggccctggagagccaggccctggcccaccgggaggccctggcccagctgcagcgggagaaggagaccctgagcctgaccctggccgaggagaaggaggtggcccgctgccagctggagcaggagaaggagctggtgaccaagtctgctgctgagcgggaggccctgaagggggagatccagagcctgaagcaggagagagatgagagcctgctgcagctggagcacaagatgcagcaggccctgagcctgaaggagacagagaggagcctgctgtctgaggagctgagccgggcccggaggaccctggagcgggtgcagcaggaggcccagagccagcaggagcaggcccaggccaccatcagcgccaccacagaggagctgaaggccctgcaggcccagtttgaagatgccatcacagcccaccagcgggagaccacagccctgcgggagagcctgcaggacctggccgctgagagaggagatgtggagcgggaggccgagcggctgcgggcccagctgactgtggcccaggagggcctggccgccctgcggcaggagctgcagggcgtggaggagagccgggagggcctgcaccgggaggcccaggaggcccggcgggccctgagtgatgaggcccgggagaaggatgtgctgctgctcttcaacagcgagctgcgggccaccatctgcagagctgagcaggagaaggccagcttcaagaggagcaaggaggagaaggagcagaagctgctgatcctggaggaggcccaggccgccctgcagcagtag

SEQ ID NO: 41318 - DNA, 1395 bp, Artificial Sequence
  Description of Artificial Sequence: Synthetic coding sequence
tgagccctgtgctgggcccgggccctgcccagcaggcctggggccagccgcagcggcggcctggaggagagccgggaccggccccggcccctgcccacagagcctgctgtgcggcccaaggagcccggcaccaagaggaagggcctgggggagggcgtgcccagcagccagaggggcccccggcggctgtctgctgagggcggggacaaggccctgcacaagatgggccctgggggcggcaaggccaaggccctgggcggggccggcagcggcagcaaaggatctgctgggggcggcagcaagaggcggctgagcagcgaggacagcagcctggagccagacctggccgagatgagcctggatgacagcagcctggccctgggcgctgaggccagcaccttcggcggcttccctgagagccccccaccctgccccctgcatggaggcagccggggccccagcaccttcctgcctgagcccccagacacctatgaggaggatggaggagtgtacttcagcgagggccctgagcccccaacagcctctgtgggccccccaggcctgctgcctggagatgtgtgcacccaggatgacctgcccagcacagatgaaagtggaaatggcctgcccaagaccaaggaggccgccccagctgtgggggaggaggatgatgactaccaggcctactacctgaatgcccaggatggagctggaggagaggaggagaaggccgagggcggggccggggaggagcatgacctgtttgctggcctgaagcccctggagcaggagagcaggatggaggtgctgtttgcctgtgccgaggccctgcacgcccacggctacagcagcgaggccagccggctgactgtggagctggcccaggacctgctggccaaccccccagacctgaaggtggagcccccaccagccaagggcaagaagaacaaggtgtccaccagccggcagacctgggtggccaccaacaccctgagcaaggccgccttcctgctgactgtgctgtctgagaggcctgagcaccacaacctggccttccgggtgggcatgtttgccctggagctgcagaggcccccagccagcaccaaggccctggaggtgaagctggcctaccaggagagcgaggtggccgccctgctgaagaagatccccctgggccccagcgagatgagcaccatgcgctgcagagctgaggagctgcgggagggcaccctgtgtgactacagacctgtgctgcccctgatgctggccagcttcatctttgatgtgctgtgtgcccctggcagcaggcctcccagcaggaactggaacagcgagaccccaggagatgaggagctgggctttgaggccgctgtggccgccctgggggagagctag

SEQ ID NO: 41319 - DNA, 3909 bp, Artificial Sequence
  Description of Artificial Sequence: Synthetic coding sequence
tgaccatctgccagtgaccagagcacctggtacctggatgagagcaccctgacagacaacatcaagaagaccctgcacaagttctgtggccccagccctgtggtgttcagtgatgtgaacagcatgtacctgagcagcacagagcccccagctgctgctgagtgggcctgcctgctgcggcccctgcggggccgggagcctgagggcgtgtggaacctgctgagcatcgtgcgggagatgttcaagagaagagacagcaatgctgcccccctgctggagatcctgacagaccagtgcctgacctatgagcagatcaccggctggtggtacagcgtgaggaccagcgccagccacagcagcgccagcggccacacaggccgcagcaatggccagagcgaggtggccgcccacgcctgtgcctccatgtgtgatgagatggtgaccctgtggaggctggccgtgctggaccctgccctgagcccccagaggcggcgggagctgtgcacccagctgcggcagtggcagctgaaggtgattgaaaatgtgaagaggggccagcacaagaagaccctggagcggctcttccctggcttccggcctgctgtggaggcctgctacttcaactgggaggaggcctaccccctgcccggggtgacctacagcggcacagacaggaagctggccctgtgctgggcccgggccctgcccagcaggcctggggccagccgcagcggcggcctggaggagagccgggaccggccccggcccctgcccacagagcctgctgtgcggcccaaggagcccggcaccaagaggaagggcctgggggagggcgtgcccagcagccagaggggcccccggcggctgtctgctgagggcggggacaaggccctgcacaagatgggccctgggggcggcaaggccaaggccctgggcggggccggcagcggcagcaaaggatctgctgggggcggcagcaagaggcggctgagcagcgaggacagcagcctggagccagacctggccgagatgagcctggatgacagcagcctggccctgggcgctgaggccagcaccttcggcggcttccctgagagccccccaccctgccccctgcatggaggcagccggggccccagcaccttcctgcctgagcccccagacacctatgaggaggatggaggagtgtacttcagcgagggccctgagcccccaacagcctctgtgggccccccaggcctgctgcctggagatgtgtgcacccaggatgacctgcccagcacagatgaaagtggaaatggcctgcccaagaccaaggaggccgccccagctgtgggggaggaggatgatgactaccaggcctactacctgaatgcccaggatggagctggaggagaggaggagaaggccgagggcggggccggggaggagcatgacctgtttgctggcctgaagcccctggagcaggagagcaggatggaggtgctgtttgcctgtgccgaggccctgcacgcccacggctacagcagcgaggccagccggctgactgtggagctggcccaggacctgctggccaaccccccagacctgaagggcaagaagaacaaggtgtccaccagccggcagacctgggtggccaccaacaccctgagcaaggccgccttcctgctgactgtgctgtctgagaggcctgagcaccacaacctggccttccgggtgggcatgtttgccctggagctgcagaggcccccagccagcaccaaggccctggaggtgaagctggcctaccaggagagcgaggtggccgccctgctgaagaagatccccctgggccccagcgagatgagcaccatgcgctgcagagctgaggagctgcgggagggcaccctgtgtgactacagacctgtgctgcccctgatgctggccagcttcatctttgatgtgctgtgtgcccctggcagccggccccccagcaggaactggaacagcgagaccccaggagatgaggagctgggctttgaagctgctgtggccgccctgggcatgaagaccaccgtgtctgaggccgagcaccccctgctgtgtgagggcacccggcgggagaagggggacctggccctggccctgatgatcacctacaaggatgaccaggccaagctgaagaagatcctggacaagctgctggaccgggagagccagacccacaagccccagaccctgagcagcttctacagcagcagccggcccaccacagccagccagaggagccccagcaagcacggcggccccagcgcccctggggccctgcagcccctgaccagcggcagcgctggccctgcccagcccggctctgtggccggggccggccctggccccacagagggcttcacagagaagaatgtgcctgagagcagcccccacagcccctgtgagggcctgcccagcgaggccgccctgacccccaggcctgagggcaaggtgcccagccggctggccctgggcagcagaggaggctacaacggccggggctggggcagccctggccggcccaagaagaagcacacaggcatggccagcattgacagcagcgcccctgagaccaccagtgacagcagccccaccctgagcagaagacccctgcggggcggctgggcccccacctcctggggccggggccaggacagcgacagcatcagcagcagcagcagtgacagcctgggcagcagcagcagcagcggcagcagaagagccagcgccagcggcggggcccgggccaagacagtggaggtgggccgctacaagggccggcggcctgagagccacgccccccacgtgcccaaccagcccagcgaggccgccgcccacttctactttgagctggccaagacagtgctgatcaaggccggcggcaacagcagcaccagcatcttcacccaccccagcagcagcggcggccaccagggcccccacaggaacctgcacctgtgtgcctttgagatcggcctgtatgccctgggcctgcacaactttgtgagccccaactggctgagcaggacctacagcagccacgtgtcctggatcaccggccaggccatggagatcggcagcgctgccctgaccatcctggtggagtgctgggatggccacctgaccccacctgaggtggccagcctggccgaccgggccagccgggcccgggacagcaacatggtgcgggctgctgctgagctggccctgagctgcctgccccacgcccacgccctgaaccccaatgagatccagagggccctggtgcagtgcaaggagcaggacaacctgatgctggagaaggcctgcatggctgtggaggaggccgccaagggcggcggcgtgtacccagaggtgctgtttgaggtggcccaccagtggttctggctgtatgagcagacagctgggggcagcagcacagcccgggagggcgccaccagctgcagcgccagcggcatccgggccggcggggaggccggccggggcatgcctgagggccggggcggccctggaacagagcctgtgacagtggccgctgctgctgtgacagctgctgccaccgtggtgcctgtgatctctgtgggcagcagcctgtacccaggccctggcctgggccacggccacagccctggcctgcacccctacacagccctgcagccccacctgccctgcagcccccagtacctgacccacccagcccacccagcccaccccatgccccacatgcccaggcctgctgtgtttcctgtgcccagcagcgcctacccccaggtgcggcctgtgttctgctggggcgtgagacatggcaagatcctgggcatccaccggggcctggagtgggtgctgtgggagtacaactggagcgtgggggagagctggtag

SEQ ID NO: 41320 - DNA, 327 bp, Artificial Sequence
  Description of Artificial Sequence: Synthetic coding sequence
cccagctgtgtgcctgtgctgaagggggcccacgccgctgacagcagccgcagcaagtggccagccctgatgggcaccggcaggaagagctttggagccttcctgttccaccacagcttctcctggggctggaagctgatcagcatcagctttggagacctgaaccccttccctgtgcggcagatccggaacagaagagcctaccacctggagaaggtgcggctggagctgacagagctggaggccatccgggaggacttcctgcacgagcgggacaccagcccagacaagggggagctggtgtctgatgaggaggaggacacctag

SEQ ID NO: 41321 - DNA, 3930 bp, Artificial Sequence
  Description of Artificial Sequence: Synthetic coding sequence
atgctgctgaatggagactgcccagagagcctgaagaaggaggccgctgctgctgagcccccaagagaaaatggcctggatgaagctggccctggagatgagaccaccggccaggaggtgattgtcatccaggacaccggcttctctgtgaagatcctggcccctggcatcgagcccttcagcctgcaggtgagcccccaggagatggtgcaggagatccaccaggtgctgatggaccgggaggacacctgccacaggacctgcttcagcctgcacctggatggaaatgtgctggaccacttcagcgagctgcggtctgtggagggcctgcaggagggctctgtgctgcgggtggtggaggagccctacacagtgcgggaggcccgcatccacgtgcgccacgtgcgggacctgctgaagagcctggaccccagtgatgccttcaatggagtggactgcaacagcctgtccttcctgagcgtcttcacagatggagacctgggggacagcggcaagaggaagaagggcctggagatggaccccatcgactgcaccccacctgagtacatcctgcccggcagccgggagcggcccctgtgccccctgcagccccagaacagagactggaagcccctgcagtgcctgaaggtgctgaccatgagcggctggaaccccccacctggcaacaggaagatgcatggagacctgatgtacctgtttgtgatcacagcagaagatcggcaggtgtccatcacagccagcacccggggcttctacctgaaccagagcacagcctaccacttcaaccccaagccagccagcccccgcttcctgagccacagcctggtggagctgctgaaccagatcagccccaccttcaagaagaactttgctgtgctgcagaagaagagggtgcagaggcacccctttgaaagaattgccacccccttccaggtgtacagctggacagccccccaggccgagcacgccatggactgtgtgcgggcagaagatgcctacaccagccggctgggctatgaggagcacatccctggccagacccgggactggaatgaggagctgcagaccacccgggagctgcccaggaagaacctgcctgagcggctgctgcgggagcgggccatcttcaaggtgcacagcgacttcaccgctgctgccaccaggggggccatggctgtgattgatggaaatgtgatggccatcaaccccagcgaggagaccaagatgcagatgttcatctggaacaacatcttcttcagcctgggctttgatgtgcgggaccactacaaggactttggaggagatgtggccgcctacgtggcccccaccaatgacctgaatggagtgaggacctacaatgctgtggatgtggagggcctgtacaccctgggcaccgtggtggtggactaccggggctacagagtgacagcccagagcatcatccctggcatcctggagcgggaccaggagcagagcgtcatctacggcagcattgactttgggaagacagtggtgagccacccccgctacctggagctgctggagaggaccagccggcccctgaagatcctgcggcaccaggtgctgaatgacagagatgaggaggtggagctgtgcagctctgtggagtgcaagggcatcattggaaatgatggccgccactacatcctggacctgctgcggaccttccccccagacctgaacttcctgcctgtgcctggagaggagctgcctgaagaatgtgcccgggccggcttcccccgggcccaccgccacaagctgtgctgcctgcggcaggagctggtggatgcctttgtggagcaccgctacctgctcttcatgaagctggccgccctgcagctgatgcagcagaatgccagccagctggagacccccagcagcctggagaatggaggccccagcagcctggagagcaagtcagaagatcctcctggccaggaggccggcagcgaggaggagggcagcagcgccagcggcctggccaaggtgaaggagctggccgagaccatcgccgcagatgatggaacagaccccaggagccgggaggtgatcagaaatgcctgcaaggctgtgggcagcatcagcagcacagcctttgacatccgcttcaacccagacatcttcagccctggggtgcgcttccctgagagctgccaggatgaggtgcgggaccagaagcagctgctgaaggatgctgctgccttcctgctgagctgccagatccctggcctggtgaaggactgcatggagcacgctgtgctgcctgtggatggagccaccctggccgaggtgatgaggcagaggggcatcaacatgagatacctgggcaaggtgctggagctggtgctgcggagccctgcccggcaccagctggaccacgtgttcaagattggaattggagagctgatcaccaggtctgccaagcacatcttcaagacctacctgcagggcgtggagctgagcggcctgtctgctgccatcagccacttcctgaactgcttcctgagcagctaccccaaccctgtggcccacctgcctgcagatgagctggtgtccaagaagaggaacaagaggaggaagaacagacctcctggagctgctgacaacacagcctgggccgtgatgaccccccaggagctgtggaagaacatctgccaggaggccaagaactactttgattttgacctggagtgtgagaccgtggaccaggccgtggagacctacggcctgcagaagatcaccctgctgcgggagatcagcctgaagacaggcatccaggtgctgctgaaggagtacagctttgacagccgccacaagccagccttcacagaagaagatgtgctgaacatcttccctgtggtgaagcacgtgaaccccaaggccagtgatgccttccacttcttccagagcggccaggccaaggtgcagcagggcttcctgaaggagggctgtgagctgatcaatgaggccctgaacctcttcaacaacgtgtatggagccatgcacgtggagacctgtgcctgcctgcggctgctggcccggctgcactacatcatgggagactatgcagaggccctgagcaaccagcagaaggctgtgctgatgtctgagcgggtgatgggcacagagcaccccaacaccatccaggagtacatgcacctggccctgtactgctttgccagcagccagctgagcacagccctgagcctgctgtaccgggcccgctacctgatgctgctggtgtttggagaggaccaccctgagatggccctgctggacaacaacatcggcctggtgctgcatggagtgatggagtatgacctgagcctgcgcttcctggagaatgccctggccgtgtccaccaagtaccacggccccaaggccctgaaggtggccctgagccaccacctggtggcccgggtgtatgagagcaaggccgagttccgcagcgccctgcagcacgagaaggagggctacaccatctacaagacccagctgggggaggaccacgagaagaccaaggagagcagcgagtacctgaagtgcctgacccagcaggccgtggccctgcagaggaccatgaatgagatctacagaaatggcagcagcgccaacatcccccccctgaagttcaccgcccccagcatggcctctgtgctggagcagctgaatgtcatcaatggcatcctcttcatccccctgagccagaaggacctggagaacctgaaggccgaggtggcccggcggcaccagctgcaggaggccagcaggaacagagacagagctgaggagcccatggccacagagcccgccccagctggggcccctggggacctgggcagccagcccccagctgccaaggaccccagccccagcgtgcagggctag

SEQ ID NO: 41322 - DNA, 459 bp, Artificial Sequence
  Description of Artificial Sequence: Synthetic coding sequence
gagggctccatggacagcctgtatgagcccatccctgagcagcaggccaaccaggagaacatgagcagcaggacagacagccccatccccccatttggagagagcgagcagacccccaacaacctgtttgtgggcgtgagcaacctggagaatgccaagcccaagaagaggaagctgttccgccgcttcatgtctgagaacaagatctttgagggcaagacagtgaatgacaagatctggcaggagcacagcaagcacaagaatgacagccacatcagaagaccctgccagctgaaggacctgaatgaaaatgacttcctgagcaacaacatccacacctaccagggcaagaccctgcagggcaccagctaccaggtgaccagcgagtgctggagccccttccactaccagagacatgtggagaccaccgtggatgagctggcccaggagttcatgtag

SEQ ID NO: 41323 - DNA, 840 bp, Artificial Sequence
  Description of Artificial Sequence: Synthetic coding sequence
atgccccaggaggagctgcacatgaaggagtgcccccacctgaagcccacccccagccagtgctgcggccaccggctggccgctgacagagtgcatgacagccaccccaccaacatgaccccccagcaccccaagacccaccctgagagctgcagctactgccgcctgtcctgggccagcctggtgcatggaggaggagccctgcagcccatcgagaccctgaagaagcagatcagcgaggacaggaagcagcagctgatgctgcagaagatggagctggagattgagaaggagcggctgcagcacctgctggcccagcaggagaccaagctgctgctgaagcagcagcagctgcaccagagccggctggactacaactggctgaaggcccaggccctcttcaagagccgggagctggtggccgagaagcagctgaccaagccccaggagctgaagctggacatgaatggaagtgacagcggccccagcctgctgaagagcaactgtgatggctggctgctgggcaccagcagcagcatcaagaagcaccaggacccccccaacagcggagaaaataggaaggagaggaagacagtgggcttccacagccacatgaaggatgatgcccagtggagctgccagaagaaggacacctgccggccccagaggggcaccgtgactggagtgaggaaggatgccagcaccagccccatgcccaccggcagcctgaaggactttgtgaccacagccagccccagcctgcagcacaccaccagcaggcctggcatcagcaccaagatctgcttcctgagcaaccacttcttcatcctcttctcctag

SEQ ID NO: 41324 - DNA, 399 bp, Artificial Sequence
  Description of Artificial Sequence: Synthetic coding sequence
atgagctttgagtaccgccactacaagcgggaggccaagatctgcacctgccggggcggctgggcccacgtgctgctgtgcatcggcgtgtcccagggcgcctgtgccgagcacctgccccacaggcctgctgtggagaaggatgtgcctggggccggggaggtgctcttcatgtgctcctggaggatcttccctgtggccagcgccagccccagcagcagcatcagcggcctggccggccacagcgtcttcctggtgcccggcctggccgcccaccctggcagccacagcgaccagcccccaggagtgcccagcaggaggaagagccggctggagcgctggagccccagcgtgagccgcagcaccagccccccaacagaggcccccttctgcctgtag

SEQ ID NO: 41325 - DNA, 1254 bp, Artificial Sequence
  Description of Artificial Sequence: Synthetic coding sequence
atgaaggccctggtgcctgtgaccagcagcggcacctggtactgcctggagcggcggcctgctgtgtttgtgaccagctctgtgagcagccctgtgaagttcacccatgacatctctgtgactggaaatggaattgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcagagcatcaacatcatggagctgaccctgcagaagtatggcagctatgagaagtttgagcaggccaccggcggcagcctgctgagcaagacccgcatctggagccacgtgaggaagtacatgatgaaggagggctgcctgggggagatcgtggtgcacctgacagaggacctgctgagccgggcctccatgacagtggtgaatggctgccccaccctgaccatcaacgtgtccacagcccgggagcactggctggagggcatgctgcggcatgagatcggcacccactacttccggggcatcaacaacctgcagcagccctggaacagctggacaggcaggaagaagcatgagctgaagcccaacaaccccacagaggagggcctggccagcatccacagcgtgctcttcaggaaggaccccttcctgtggagggctgccctgctgtactacacagtgtaccaggccagccagatgtccttctgtgagctgttcaaggacatcggccgctttgtgaaggaccccaacacccgctgggactactgtgtgcgggccaagaggggctggacagacaccagccagcccggctgcttcagcaaggaccaggtgtacctggatggcatcctgcagatcctgcgctacagagacaccatcgacttccacctgctgacagccctgggcaaggtgtcctatgaagatgtggaccggctgaagggcctggccgtgacagagaacatgagggtgccccacttcctgcaggaccacggccgctacatggagcacctggagaagatcatggaggtgaatgagctgacagaccgggagctgaaggacctgatctag

SEQ ID NO: 41326 - DNA, 627 bp, Artificial Sequence
  Description of Artificial Sequence: Synthetic coding sequence
atcacccccaccccacctcctccacccaggagccgggagaaggagagcccccgggtggccgcccgggtggtggtgcctgtgcgcagccgggagcgggtgctgacctccatgggcctgactggagtggagggccggggctgccgctacagcggctgcaagatgtggcctgtgcgggctgtgtccatcttcagcaccctgattggaagaaggctggcctggaggcggggcagcgagggcggcacagcctgcaccaagggcctggtgctgcctgctggagatgagcccggccctggccctgagctgtttcctgagagcgccctggtgcaggccggcagcgcccctcctcctcctcctcctcctcctcctccacccctgtgcctgctgctgctgcgggcagagagcgagggcgctgtgctgatgacccacccccgggcctgggagcagaggggcggcggcctgcgggaggcccggggcggcctgggcgccgcccggagcccccgggagcaggagcagcgggaggaggaggagctggcccggcggccccgggcccccagcgcccccagccggcggctggagccagatgccagcaaccctggctggccagctgctgagccctggccaggatag

SEQ ID NO: 41327 - DNA, 537 bp, Artificial Sequence
  Description of Artificial Sequence: Synthetic coding sequence
atggtgtcccagagcacagtgcggcaggacagccctgtggagccctgggagggcatcagtgaccacagcggcatcattgatggcagcccccggctgctgaacacagaccaccccccctgccagctggacatccggctgatgaggcacaaggctgtgtggatcaacccccaggatgtgcagcagcagccccaggacctgcagagccaggtgcctgctgctggcaacagcggcacccactttgtgacagatgctgccagccccagcggccccagccccagctgcctgggggacagcctggccgagaccaccctgtctgaggacaccacagattctgtgggcagcgccagcccccacggcagcagcgagaagagcagcagcttcagcctgagcagcacagaggtgcacatggtgcggcccggctacagccaccgggtgtccctgcccaccagccctggcatcctggccaccagcccctacccagagacagacagcgccttctttgagcccagccacctgaccagcgctgctgatgaatag

SEQ ID NO: 41328 - DNA, 207 bp, Artificial Sequence
  Description of Artificial Sequence: Synthetic coding sequence
gtggccgctgtgacagagaggaccagcggcaacctgagcgccagctctgtgaagtgtgaccacaagtacagagtgcccggcagcgcccgggacaggagccactacgtggacagagctggcctgaagctgctggccagcagcagccccccagctgccaccagccagcagcactggaatgacaggaggacccccctgaacatccactag

SEQ ID NO: 41329 - DNA, 1554 bp, Artificial Sequence
  Description of Artificial Sequence: Synthetic coding sequence
atgctggagagcatccgggtgacagagaagctgcactggccagagcaggagctggccaagaagagcatcctgaatgctgaggacagcctcatcatcgacaacaagaggagcatcagccacctgagcagtggagtgctgaaggacatcttcaccaccggcaccagcagctacaacgtgctgctgcagagcaaggaggagaagaagtaccacagccagaagcagagcagcagcacctacagcaagcgctgcaggaagcccagcaagagccccaacaccagccgcagcaaggaccccaggaggatgaaggccctggtgcctgtgaccagcagcggcacctggtactgcctggagcggcggcctgctgtgtttgtgaccagctctgtgagcagccctgtgaagttcacccatgacatctctgtgactggaaatggaattgtgctgccccccaagcccaagagcaaggtgaagtggtgccacttcagcaccctgcccaagcccaagccccagctgagccgcagctttgagaagggagatgacttcagcggcaagaagttctgcatcctgacagccatcaagcccaccaacctggagaaggagaagctgcgcttcttcaagagtgactacacctacaacccccagtttgaatatgccaacccagccctgcccagcgtgctggccaagcacagccacgccagtgaccgcttcctgaagcagagcatcaacatcatggagctgaccctgcagaagtatggcagctatgagaagtttgagcaggccaccggcggcagcctgctgagcaagacccgcatctggagccacgtgaggaagtacatgatgaaggagggctgcctgggggagatcgtggtgcacctgacagaggacctgctgagccgggcctccatgacagtggtgaatggctgccccaccctgaccatcaacgtgtccacagcccgggagcactggctggagggcatgctgcggcatgagatcggcacccactacttccggggcatcaacaacctgcagcagccctggaacagctggacaggcaggaagaagcatgagctgaagcccaacaaccccacagaggagggcctggccagcatccacagcgtgctcttcaggaaggaccccttcctgtggagggctgccctgctgtactacacagtgtaccaggccagccagatgtccttctgtgagctgttcaaggacatcggccgctttgtgaaggaccccaacacccgctgggactactgtgtgcgggccaagaggggctggacagacaccagccagcccggctgcttcagcaaggaccaggtgtacctggatggcatcctgcagatcctgcgctacagagacaccatcgacttccacctgctgacagccctgggcaaggtgtcctatgaagatgtggaccggctgaagggcctggccgtgacagagaacatgagggtgccccacttcctgcaggaccacggccgctacatggagcacctggagaagatcatggaggtgaatgagctgacagaccgggagctgaaggacctgatctag

SEQ ID NO: 41330 - DNA, 438 bp, Artificial Sequence; identical to SEQ ID NO: 41157
  Description of Artificial Sequence: Synthetic coding sequence

SEQ ID NO: 41331 - DNA, 1695 bp, Artificial Sequence
  Description of Artificial Sequence: Synthetic coding sequence
atgctgatgtggccccagccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcacaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagcgggaggagaagatccaggagcaggaggagaagatccgggagcaggaggagaagatgaggcggcaggaggagatgatgtgggagaaggaggagaagatgaggcggcaggaggagatgatgtgggagaaggaggagaagatccgggagctggaggagaagatgcatgagcaggagaagatccgggagcaggaggagaagaggcaggaggaggagaagatccgggagcaggagaagaggcaggagcaggaggccaagatgtggaggcaggaggagaagatccgggagcaggaggagaagatccgggagcaggaggagatgatgcaggagcaggaggagaagatgggagagcaggaggagaagatgtgggagcaggaggaggagatgcaggagcaggaggagaagatgaggcggcaggaggagaagatccgggagcaggagaagaagatccgggagcaggaggagaagatccgggagcaggaggagatgatgcaggagcaggaggagaagatgggagagcaggagggcaagatgtgtgagcaggaggccaagatgcaggagcaggaggagaagatgaggcggcaggaggagaagatccgggagcaggagaagaagatccgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgagggagcaggaggtgcggctgcggcagcaggaggagaagatgcaggagcactag

SEQ ID NO: 41332 - DNA, 744 bp, Artificial Sequence
  Description of Artificial Sequence: Synthetic coding sequence
ggcatcgtgggcggccacaatgcccctcctgggaagtggccctggcaggtgtccctgcgggtgtacagctaccactgggcctcctgggcccacatctgtggcggcagcctcatccacccccagtgggtgctgacagctgcccactgcatcttctggaaggacacagaccccagcatctaccgcatccacgccggagatgtgtacctgtatggaggccggggcctgctgaatgtgagccgcatcatcgtgcaccccaactacgtgacagctggcctgggcgcagatgtggccctgctgcagctggagccccatgacctgagcaatgtgaggacagtgaagctgagccctgtgtccctggagctgacccccaaggaccagtgctgggtgacaggctggggcgccatccgcatgaaggagagcctgcccccaccctaccgcctgcagcaggcctctgtgcaggtgctggagaatgctgtgtgtgagcagccctacagaaatgccagcggccacactggagaccggcagctgatcctggatgacatgctgtgtgccggcagcgagggccgggacagctgctatggagacagcggcggccccctggtgtgccgcctgcggggctcctggaggctggtgggcgtggtgtcctggggctacggctgcaccctgcgggacttccctggggtgtacacccacgtgcagatctacgtgctgtggatcctgcagcaggtgggggagctgccctag

SEQ ID NO: 41333 - DNA, 540 bp, Artificial Sequence
  Description of Artificial Sequence: Synthetic coding sequence
atgggctcctggcactgggagtggtatggagcccccaccagcaccctgagcctgggctgcctgctgctgcccggggagaagtggaccttcctgatcctgcccagccactacggcaccaccacccacgcccacagcctgcagggctgtgtggagcggcagtggcaggacagcaagcagctggccatcagccctggccccaccctgctgcggagtgaatatgtgggcagcctgagccctgtgtgcagcagcctgacccaggtgcaccgggtgccctggggccagcaccgggcctgccctgtgatgctgctggtgttcaccaagtggctgcagcgctacctgcactttgagaagccagctgagcccgcctctgtgggccaggaccctgacttcttcggcaagtctgagggggagcgggccacctgcctgctgagccgcagctgcctgtacctggcctctgtgtgcaacctgcgggagaatgacagctgcatgggccgcagcggcggcaccgggaagagtgacctgcccggcagctgcaggtag

SEQ ID NO: 41334 - DNA, 84 bp, Artificial Sequence
  Description of Artificial Sequence: Synthetic coding sequence
ttccccagctttgacatctccttcttcctgttcatctacctgttcaacagcagccacagcccagacagagtgtccctgtgctag

SEQ ID NO: 41335 - DNA, 1161 bp, Artificial Sequence
  Description of Artificial Sequence: Synthetic coding sequence
atgggcgtgggctgcttcaaggatgacagaattgtgttctggacctggatgttcagcacctacttcatggagaagtgggccccccggcaggatgacatgctgttctacgtgcggaggaagctggcctacagcggcagcgagagcggggctgatggcaggaaggctgctgagcctgaggtggaggtggaggtgtaccgccgggacagcaagaagctgcccggcctgggggaccctgacatcgactgggaggagagcgtgtgcctgaacctgatcctgcagaagctggactacatggtgacctgtgctgtgtgcaccagggcagatggaggagacatccacatccacaagaagaagagccagcaggtgtttgccagccccagcaagcaccccatggacagcaagggggaggagagcaagatctcctaccccaacatcttcttcatgattgacagctttgaggaggtgttcagtgacatgacagtgggggagggggagatggtgtgtgtggagctggtggccagtgacaagaccaacaccttccagggcgtcatcttccagggcagcatccgctatgaggccctgaagaaggtgtatgacaacagagtgtctgtggccgccaggatggcccagaagatgagctttggcttctacaagtacagcaacatggagtttgtgaggatgaagggcccccagggcaaaggacatgctgagatggctgtgtcccgggtgtccactggagacaccagcccctgtggcacagaggaggacagcagccctgccagccccatgcatgagcgggtgaccagcttcagcaccccacccaccccagagaggaacaacagacctgccttcttcagccccagcctgaagaggaaggtgcccaggaacagaattgctgagatgaagaagagccacagcgccaatgacagcgaggagttcttccgggaggatgatggcggcgctgacctgcacaatgccaccaacctgcggagccgcagcctgtctggaacaggccgcagcctggtgggctcctggctgaagctgaacagagcagatggcaacttcctgctgtatgcccacctgacctacgtgaccctgcccctgcaccgcatcctgacagacatcctggaggtgcggcagaagcccatcctgatgacctag

SEQ ID NO: 41336 - DNA, 393 bp, Artificial Sequence
  Description of Artificial Sequence: Synthetic coding sequence
tggaagccccagcacagcttcttcttcctgctgctgctgtggctgcctgacaccactggagagatcgtgatgacccagagccctgccaccctgagcctgagccctggagagcgggccaccctgagctgccgggccagccagagcgtgagcagcagctacctgtcctggtaccagcagaagccaggccaggccccccggctgctgatctacggggccagcacccgggccaccggcatcccagcccgcttcagcggcagcggcagcggcacagacttcaccctgaccatcagcagcctgcagcctgaggactttgctgtgtactactgccagcaggactacaacctgccccccaccgtcatccagcacgagaccaagaccagcacccggccctag

SEQ ID NO: 41337 - DNA, 696 bp, Artificial Sequence
  Description of Artificial Sequence: Synthetic coding sequence
atggccaagtgggtgcctgccctgctgctgcggcgggtgcccctcttcagcctgcgcttccggcctgccagcagcaccttcctgcctgtgctggccgccacagagcctgctgtgtctgtgcccagcggggacctgtccatgcctgtgaagaccagggctgagggggaggatgatggctttggagaggccggggacccccggcggctgctggagcggccctggaggttccggggctgcctgcctggaaaaggaaacagagatgtgggctttgagggcacagagggccccaccagcaccaggcctgagtgggtgtggagctgccgctgctgcctgggctgccgggccagcacccgggagcgggtgaccagccctgtgcgggccgccggcccccagccccgcttcacagaccgggagacagaagctgctgctggcaccctggcccacatgggctttgccccacccaccagcttcagccacttcacagaccaggagctgcgggactgcagcagcctggagtgcctgggcgtggtggagggggacccccacgtgctgtgcagcaccctgagcctgagccggcccagccccagcgccaccctgaccctgctgctggccagcagctgcctgctggccccagcccctccttccttcatcctgctgctcttcaccctcatcgccccagacctgccccacagctag

SEQ ID NO: 41338 - DNA, 276 bp, Artificial Sequence
  Description of Artificial Sequence: Synthetic coding sequence
atggagatcgcccactacgccaaggtgttcaccgcagatggccacctgggctgctacatcctggccaccatgaactaccacagcgccaagcactgcggcagctgcctgcagagccagctgtgcaagaggctgaagcaggaggaccggctgagccctggcttccagggccagctgggccagcacagcgagaccagcagcctgaagacagtgattggccccctggcccccagctgccacctggccgacatgaagaactggcgctggcagcagtggtag

SEQ ID NO: 41339 - DNA, 492 bp, Artificial Sequence
  Description of Artificial Sequence: Synthetic coding sequence
atgtgcaccgtgggcggcaatgtgtctgaagatgcctgctacggggagcccctggagttccctgagaacaccaagaacagagccaccctgggcagcagcagccccacagctggccacaccccccagaggaaggagatccgcatcagcaagatgtacctgcacatccccatccactgcagcaccacctacaacggccgggacctggagagcacctctgtgcccatcaacagaagaacagacaagaagaatgtggtgcggcggcacagcggctactgcagcgcccgggaggagaggaaccctgtgatctctgctgcctggatgagcctggaggagctgggcaagagcgcccgctgcaggaagaccaacaccccaggcagccacacctctgtgggcgccaagaaggccgagctgaaggctgtggtgatggactgctggctgcctgagagcggggagggcgtgcgggtgcgggcccggcgggagaacaagctgtag

SEQ ID NO: 41340 - DNA, 489 bp, Artificial Sequence
  Description of Artificial Sequence: Synthetic coding sequence
cacaagaacacctacatccgcacctacatccacatctgtgtgtacatccgcacctacatccacatctgtgtgtatgcctacgtgtacacctacatgtgtgtgtgtgtgcgcatctacatctacgtgtgcatgaggacctacatccacatctgtgtgtatgcctacgtgtacaagtacatgtgtgtgtgtgtgcgcatctacatccacacctgcatgtacatctacacctacatctgcatgtacatcatgtgcatctacgtgaggacctacatctacgtgtacatctgcacctgcatccacatctgtgtgtacatgtatgtgcacatctacggctacatctgcacctacatccacagatatggctacatctgcacctacatccacatctacgtgtacacctgcaagtacatccacatctacggctacacctgcatgtacatccacatctacggctacacctacatgtacatgtatgtgtgcatcttctag

SEQ ID NO: 41341 - DNA, 345 bp, Artificial Sequence
  Description of Artificial Sequence: Synthetic coding sequence
gtgctgtgcctcttcttcttcttcttcctgcggcgcagcctggccctgctgccccggctggagtgcagcggggccatctgggcccactgcaagctgtgcctgcccggcagccgccacagccctgccagccccagccgggtggccggcaccaccggcacctgccaccacgcccagctgatctttgtgttcctggtggagaccggcttccaccacatcggccaggccggcctggagctgctgaccagcggggaccccccagccctggccagccagagcgctggcatcaccggcatgagccaccgggcccagcccatgtgggacctgagcggcctcatccggctgtag

SEQ ID NO: 41342 - DNA, 273 bp, Artificial Sequence
  Description of Artificial Sequence: Synthetic coding sequence
gggggcgccaaggaggagcccaagagaagaagtgcccggctgagcgccaagcccccagccaaggtggaggccaagcccaagaaggccgccgccaaggacaagagcagtgacaagaaggtgcagaccaagggcaagagaggagccaagggcaagcagacagaggtggccaaccaggagaccaaggaggacctgcctgcagaaaatggagagaccaagacagaggagagccctgccagtgatgaggccggggagaaggaggccaagagtgactag

SEQ ID NO: 41343 - DNA, 1026 bp, Artificial Sequence
  Description of Artificial Sequence: Synthetic coding sequence
tgagctgagagatttgtgcctgccctgagcctgggggactggcccaggagccccctggccccccgctgctgggcccggcccggccctgtgtccttccctggcctgcgcttcagccctggaacagctgccctgagcgccccagccacccccagccctggcagccccctgcggccccgggccagcccccagcccccagctgggggccctggccctggcagcgctggaggagaccctgcccctgggggcgccggccccatggagctgatgtttgctgagtgggaggatggagagcgcttctcctttgaggacagcgacagatttgaggaggacagcctgtgcagcttcatcagcgaggccgagagcctgtgccagaactggaggggctggaggaagcagagcgctggccccaacagccccaccggcggcggcggcggcggcggcagcggcggcaccaggatgagagatggcctggtgatccccctggtggagctgagcgccaagcaggtggccttccacatcccctttgaggtggtggagaaggtgtacccacctgtgcctgagcagctgcagctgagaattgccttctggagcttcccagaaaatgaggaggacatccggctgtacagctgcctggccaatggatctgcagatgagttccagagaggagaccagctgttcaggatgagagctgtgaaggaccccctgcagatcggcttccacctgagcgccaccgtggtgcccccccagatggtgccccccaagggggcctacaacgtggccgtgatgtttgaccgctgccgggtgaccagctgcagctgcacctgtggggccggggccaagtggtgcacccacgtggtggccctgtgcctcttccgcatccacaatgccagcgctgtgtgcctgcgggcccctgtgtctgagagcctgagccggctgcagagggaccagctgcagaagtttgcccagtacctgatcagcgagctgccccagcaggtgggggaggtgggcacccccagctgcaactag

SEQ ID NO: 41344 - DNA, 426 bp, Artificial Sequence
  Description of Artificial Sequence: Synthetic coding sequence
atgctgcacagcatgaggttcctgaggacagacagcgccagcgctgaccccggcaacctgaagtacagcagcagccgggacagaggaggcagcagcagctatggcctgcagcccagcaacagcgctgtggtgtcccggcagagacatgatgacaccagggtgcacgccgacatccagaatgatgagaagggcggctacagcgtgaatggaggcagcggggagaacacctacggcaggaagagcctgggccaggagctgcgggtgaacaacgtgaccagccctgagttcacctctgtgcagcacggcagccgggccctggccaccaaggacatgaggaagagccaggagaggtccatgagctactgtgatgagagccggctgagcaacctgctgcggcgcatcaccagagaagatgaccgggactag

SEQ ID NO: 41345 - DNA, 321 bp, Artificial Sequence
  Description of Artificial Sequence: Synthetic coding sequence
ctggagtgcagcggccgcatcagcgcccactgcaacctgcacctgctgggcagcagtgacagccccaccagcgccagccaggtggtggagatcaccggcacctaccaccacgtgtccctgaactttgtgttcctggtgcagatgggcttcaaccacgtggtgcaggccggcctggagctgctgaccagcggcaacccccccagcagcgccagccagagcgctggcatcactggagtgagccaccacgcctggcccttccccttcaactttgctgagcggcagggcctgaccatgctgccccggctggtgagcaacagctag

SEQ ID NO: 41346 - DNA, 324 bp, Artificial Sequence
  Description of Artificial Sequence: Synthetic coding sequence
atgggcagagatgccacccgcatcggggagcggctgcagggcgagggcaacttccagctgaactttgtgaccatcagcagcaagctgaaggtgtcctggacagagagcggcaagggcgtgacccaggagcggcgctacagcacagagaccggggccggcggggaggcccagatcctgaaggccgcctgcttcctgagcggggaggcctggagcctgcggcaggtgttcagccctgcccaccggctgcccggcaacaagctgagcgccatcggcgtgcacagcgagagcgagaccagcctgagcggctgtgtgggcgccggctag

SEQ ID NO: 41347 - DNA, 354 bp, Artificial Sequence
  Description of Artificial Sequence: Synthetic coding sequence
tgagctggccggcggggccgcaccaccccccagaccctggagttccctggggcccagaccctggccatcagccggggctgccgctgtgccagcccccggcggggccggggcggctggtggagcctgacagcccgggtgctgtacatcaccaacaaggccggcaccttccccttcctgctgggcaagtacctggaggagaagctgctgggcaactgggtggagacccgcttccgccacatcgactgggccggcctggagctgctgagcagcagcaaccggcccagcctgaccagccagagcgcccgcatcaccggggtgaaccaccgggcccggccctacttcctgagcaagtag

SEQ ID NO: 41348 - DNA, 240 bp, Artificial Sequence; identical to SEQ ID NO: 41209
  Description of Artificial Sequence: Synthetic coding sequence

SEQ ID NO: 41349 - DNA, 783 bp, Artificial Sequence
  Description of Artificial Sequence: Synthetic coding sequence
gtgtgtggcagcacccaggagaagacagtgttccggctggaggccatgctggagaggacagctggggtgcagagcaaggaggccgccctggaggaggaggccgtgctgaaggtggaggacatcatggccgaggtggaggtggtggtggaggtggagccagatgtgggctggcagaaggagggccagagggcccagcccggccctggccccagcaccccaggccccagcatggacagcctggaggtgctgcacctggagctgggctctgtgaatgcccctggccaccgggccaccaacaagcagaagaagaagaaggagaggaaagaaaaccccaacctgtggaagccaggcagcaccctgcagaagccaccccagctgtggcgctgcctgctggcccggcagaatgagatgtctgcctgggtgggcaagcatgctgaggtgctgctgtgctacgtgatggacctgcaggtggaggagctgagccaccctggctaccgctggcagatgatctccttccaccccaacctgtacttccacagcgagatcatcatgaaggagcactgtgtgggcatcctgggctacagagtgagccacagcacagctgtgcagcgcttctgggaccacgagggccaggccagcagctgccggcagtacaccagctacctgagcagcttcagctgcctggccgagcatgactgccccggcttcggcagaattgctgagagcaccaggagcagcgcccgggcctgtggcagcatcttctgcagcaccacccagggctag

SEQ ID NO: 41350 - DNA, 288 bp, Artificial Sequence
  Description of Artificial Sequence: Synthetic coding sequence
agcctgcctgaggccctggtgcagcccggcggcagcctgcggctgagctgtgccgccagcggcttcacctgcagcaatgcctggatgtcctgggtgcggcaggcccctgggaagggcctggagtgggtgggccgcatcaagagcaaggccaatggaggcaccacagattatgctgcccctgtgaagggccgcttcaccatcagccgggtggacagcaagaacaccctgtacctgcagatgaacagcctgaagacagaggacacagctgtgtactactgcaccacctag

SEQ ID NO: 41351 - DNA, 657 bp, Artificial Sequence
  Description of Artificial Sequence: Synthetic coding sequence
tgacatgtggtggccctgtgcctcttccgcatccacaatgccagcgctgtgtgcctgcgggcccctgtgtctgagagcctgagccggctgcagagggaccagctgcagaagtttgcccagtacctgatcagcgagctgccccagcagatcctgcccacagcccagaggctgctggatgagctgctgagcagccagagcacagccatcaacacagtgtgtggggccccagaccccacagctggccccagcgccagtgaccagagcacctggtacctggatgagagcaccctgacagacaacatcaagaagaccctgcacaagttctgtggccccagccctgtggtgttcagtgatgtgaacagcatgtacctgagcagcacagagcccccagctgctgctgagtgggcctgcctgctgcggcccctgcggggccgggagcctgagggcgtgtggaacctgctgagcatcgtgcgggagatgttcaagagaagagacagcaatgctgcccccctgctggagatcctgacagaccagtgcctgacctatgagcagatcaccggctggtggtacagcgtgaggaccagcgccagccacagcagcgccagcggccacacaggccgcagcaatggccagagcgaggtggccgcccacgcctag

SEQ ID NO: 41352 - DNA, 120 bp, Artificial Sequence
  Description of Artificial Sequence: Synthetic coding sequence
cagaagggcggcgtggagggcaagtggcaggctgatgctgtgctgtcctggtgccccctggcctttgctgtggtgcccagcaagcagctgtctgagctgtggtacatctgcagcgactag

SEQ ID NO: 41353 - DNA, 2157 bp, Artificial Sequence; identical to SEQ ID NO: 41161
  Description of Artificial Sequence: Synthetic coding sequence

SEQ ID NO: 41354 - DNA, 537 bp, Artificial Sequence
  Description of Artificial Sequence: Synthetic coding sequence
gagctgagcagccagaagacaggaggcaacctggacagacacacagccagcaagcccacagccctgctgcagcccggccctggctggcagagaggagctgcctgctgcctgcagatcctgcctgagagccgggtgtgcttccccaccggcctgcccctggccaggaaggtgaccaagctgtcctgggtgggctacaagctgcagggccgggagctgcagtggcctgtgtaccgggaggagctggagctggagcggctgctgtggaggcggcggcctggggaccgggacctgcggaggactggagacctgcggctgggggagcgggacctgctgctgatccggggcggggacctgcggcacatcggcggcggcggcaacatcctgctgggcggcctgaacctgctgggcggcggcctgggccagggcgccagcacagctgtggccgtcatctcctggcccagcatctgccccccacccagcatgtgcttcagcgccttcagcgccagcagcggcttcagcaacagcacctacgcctag

SEQ ID NO: 41355 - DNA, 1713 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcagaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagcgggaggagaagatccaggagcaggaggagaagatccgggagcaggaggagaagatgaggcggcaggaggagatgatgtgggagaaggaggagaagatgaggcggcaggaggagatgatgtgggagaaggaggagaagatccgggagctggaggagaagatgcatgagcaggagaagatccgggagcaggaggagaagaggcaggaggaggagaagatccgggagcaggagaagaggcaggagcaggaggccaagatgtggaggcaggaggagaagatccgggagcaggaggagaagatccgggagcaggaggagatgatgcaggagcaggaggagaagatgggagagcaggaggagaagatgtgggagcaggaggaggagatgcaggagcaggaggagaagatgaggcggcaggaggagaagatccgggagcaggagaagaagatccgggagcaggaggagaagatccgggagcaggaggagatgatgcaggagcaggaggagaagatgggagagcaggagggcaagatgtgtgagcaggaggccaagatgcaggagcaggaggagaagatgaggcggcaggaggagaagatccgggagcaggagaagaagatccgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgagggagcaggaggtgcggctgcggcagcaggaggagaagatgcaggagcactag

SEQ ID NO: 41356 - DNA, 399 bp, Artificial Sequence
  Description of Artificial Sequence: Synthetic coding sequence
ttcacccagacctaccgccgcagccggcagcacgagcagctgcccggccagaggcacatggacctgctgaccggctacagcaagctgatccagagccggctgaagctgctgctgcacctgggcagccagccccctgtgggcaagaccttcttcttcagctgctggtgccaccccctcttccacggcagcaagaccacccccaacgtgtggtacaagttcagcgagacagccctgagcatcctgaacagctgccaggccagccagctgggcgtgaggaagatgcctggggacatgagcagcagcccccgggtgcgggagttcagcgccctggtggccatcaaggagaagatccacatcctgcccaccaatgccaaggtgggcagcaagtttggcagctag

SEQ ID NO: 41357 - DNA, 447 bp, Artificial Sequence
  Description of Artificial Sequence: Synthetic coding sequence
atgaacttcaccctgatggtgtccatggagcacaccaccaccatggccagcgccaccccagccccctggccccacaggagccagcgctgccggcaggccgtgcccggccacccagccagcggctgctgcggcaccggcaccttccgcacccagaggaggcctggggacaagagcagaagagctggcagccggggccgcggggccggccctggaagacatgaccgggacagcgcccacgccggctccatgagaggagcccggctggtgcctgccctggtgcggctgcagctgcggcccccagccctgcggggggagaggacccccatctccatgcccccagcccggcccccagctggggtggccttccctggggccagcgctggccccagcaggaccaggagaggagtggccacagctgggggccggcgggccccagctgtgatctag

SEQ ID NO: 41358 - DNA, 1599 bp, Artificial Sequence
  Description of Artificial Sequence: Synthetic coding sequence
atggaccagtttggagacatcctggagggggaggtggaccacagcttctttgacagcgactttgaggagggcaagaagtgtgagaccaacagcgtgtttgacaagcagaatgatgaccccaaggagagaattgacaaggacaccaagaatgtgaacagcaacacaggcatgcagaccacagagaactacctgacagagaagggaaatgaaagaaatgtgaagttccccccagagcaccctgtggagaatgatgtgacccagacagtgtcctccttcagcctgcctgccagcagccgcagcaagaagctgtgtgatgtgaccaccggcctgaagatccacgtgtccatccccaaccgcatccccaagatcgtgaaggagggggaggatgactactacacagatggagaggagagcagtgatgatggcaagaagtaccacgtgaagagcaagagcgccaagcccagcaccaacgtgaagaagagcatcaggaagaagtactgcaaggtgagcagcagcagcagcagcagcctgagcagcagcagcagcggcagcggcacagactgcctggatgctggcagtgacagccacctgagtgacagcagccccagcagcaagagcagcaagaagcacgtgtctggcatcaccctgctgagccccaagcacaagtacaagagcggcatcaagagcacagagacccagcccagcagcaccacccccaagtgtggccactacccagaggagagtgaagatactgtgacagatgtgagccccctgagcaccccagacatcagccccctgcagagctttgagctgggcatcgccaatgaccagaaggtgaagatcaagaagcaggagaatgtgtcccaggagatctatgaagatgtggaggacctgaagaacaacagcaagtacctgaaggccgccaagaagggcaaggagaagcatgagccagatgtgagcagcaagagcagctctgtgctggacagcagcctggaccaccgccacaagcagaaggtgctgcatgacaccatggacctgaaccacctgctgaaggccttcctgcagctggacaagaagggcccccagaagcaccactttgaccagcccagcgtggcccctgggaagaactacagcttcacccgggaggaggtgcggcagattgaccgggagaaccagaggctgctgaaggagctgagccggcaggccgagaagccaggcagcaagagcaccatccccaggtctgctgaccacccccccaagctgtaccacagcgccctgaaccggcagaaggagcagcagagaattgagcgggagaacctggccctgctgaagaggctggaggccgtgaagcccaccgtgggcatgaagaggtctgagcagctgatggactaccacaggaacatgggctacctgaacagcagccccctgagccggcgggcccggagcaccctgggccagtacagccccctgcgggccagcaggaccagcagcgccaccagcggcctgagctgccgctctgagaggtctgctgtggaccccagcagcggccacccccggcggcggcccaagccacccaacgtgaggacagcctggctgtag

SEQ ID NO: 41359 - DNA, 2085 bp, Artificial Sequence
  Description of Artificial Sequence: Synthetic coding sequence
atggacctgcacaagcagtgggagaacacagagaccaactggcacaaggagaagatggagctgctggaccagtttgacaatgaaaggaaggagtgggagagccagtggaagatcatgcagaagaagattgaggagctgtgccgggaggtgaagctgtggaggaagatcaacatcaatgaaagtgccaagatcatcgacctgtaccacgagaagaccatccctgagaaggtgattgagagcagccccaactacccagacctgggccagagcgagttcatccgcaccaaccacaaggatggcctgaggaaggagaacaagcgggagcagagcctggtgtctgggggcaaccagatgtgcaaggagcagaaggccaccaagaagagcaaggtgggcttcctggaccccctggccacagacaaccagaaggaatgtgaggcctggccagacctgcggaccagcgaggaggacagcaagagctgcagcggggccctgagcacagccctggaggagctggccaaggtgtctgaggagctgtgcagcttccaggaggagatcaggaagaggagcaaccacaggaggatgaagagtgacagcttcctgcaggagatgcccaacgtgaccaacatcccccatggagaccccatgatcaacaatgaccagtgcatcctgcccatcagcctggagaaggagaagcagaagaacaggaagaacctgagctgcaccaacgtgctgcagagcaacagcaccaagaagtgtggcatcgacaccatcgacctgaagagaaatgagaccccacctgtgcccccacccaggagcaccagcaggaacttccccagcagtgacagcgagcaggcctatgagcgctggaaggagcggctggaccacaacagctgggtgccccatgagggccgcagcaagaggaactacaacccccacttccccctgcggcagcaggagatgtccatgctgtacccaaatgaaggcaagaccagcaaggatggcatcatcttcagcagcctggtgcctgaggtgaagattgacagcaagccacccagcaatgaagatgtgggcctgtccatgtggagctgtgacattggaattggagccaagaggagccccagcacctcctggttccagaagacctgcagcacccccagcaaccccaagtatgagatggtgatcccagaccacccagccaagagccacccagacctgcacgtgtccaatgactgcagcagctctgtggccgagagcagcagccccctgaggaacttcagctgtggctttgagaggaccaccagaaatgagaagctggccgccaagacagatgagttcaacagaacagtgttcagaacagacaggaactgccaggccatccagcagaaccacagctgcagcaagagcagcgaggacctgaagccctgtgacaccagcagcacccacacaggcagcatcagccagagcaatgatgtgtctggcatctggaagaccaatgcccacatgcctgtgcccatggagaatgtgcctgacaaccccaccaagaagagcaccaccggcctggtgcggcagatgcagggccacctgagccccaggagctacagaaacatgctgcacgagcatgactggaggcccagcaacctgagcggccggcccaggtctgctgaccccaggagcaactacggcgtggtggagaagctgctgaagacctatgaaacagccacagagagcgccctgcagaacagcaagtgcttccaggacaactggaccaagtgcaacagtgatgtgtctgggggcgccaccctgagccagcacctggagatgctgcagatggagcagcagttccagcagaagacagctgtgtggggcggccaggaggtgaagcagggcatcgaccccaagaagatcacagaggagagcatgtctgtgaatgccagccacggcaagggcttcagcaggcctgcccggcctgccaacagaaggctgcccagccgctgggccagccgcagccccagcgcccccccagccctgcggaggaccacccacaactacaccatcagcctgcggtctgaggccctgatggtgtag

SEQ ID NO: 41360 - DNA, 447 bp, Artificial Sequence
  Description of Artificial Sequence: Synthetic coding sequence
atgtctgtgcccaagctggtgaaccacggctgggagacagagccctgcaacccagaccctgccctgctgctgactggagctgtgcctggagagggggagaccaccctggagcgggccctgccccgggtggtgggggagcaggagctgggctcctggagggagcgggccaacagcaccccagagcggcggctgagccctgccctgaagcacgtgtctgcccggcccaccagcatccctgagaccccaggagagcggggggcccggacccggcgggaccgggccggccgggccaggaaaggagagggcgccgccgccagcaccctgagcagcctgcggggggccgcccctgaggccggccgcggggctgaggcccctgagtggagcgtgtctgggggcgcagatgctgtgcccctggagggcgccccagctgtgcgcagcaagagctag

SEQ ID NO: 41361 - DNA, 306 bp, Artificial Sequence
  Description of Artificial Sequence: Synthetic coding sequence
atgctggtgggcaacagagcccgggagcgggagctgaagcaggaccggcggggcctggagatcgcctgggacctgatgaagaggcaggactgcttccgggaggccgcccacggcagcgccagcgagcaggtggccctggagcccatcctgtgctgtgatgaggtggccagccaggagcaccatgaaggaggcaagggcagcccccggcgggagagcacagtgcaggtgcctggaggagaccacggcaccctggagctgccctggtgtgtgtacttccagatcgtgtctggcatcaccctgaggtag

SEQ ID NO: 41362 - DNA, 213 bp, Artificial Sequence
  Description of Artificial Sequence: Synthetic coding sequence
atgagcctgcccatcggcatctacagaagagctgtgtcctatgatgacaccctggaggaccctgcccccatgaccccacctccaagtgacatgggctctgtgccctggaagcctgtgattcctgagaggaagtaccagcacctggccaaggtggaggagggggaggccagcctgcccagccctgccatgaccctgagcagcgccattgattag

SEQ ID NO: 41363 - DNA, 3702 bp, Artificial Sequence
  Description of Artificial Sequence: Synthetic coding sequence
atgggcacccgggccttcagccatgacagcatcttcatcccagatggaggagctgagagcgagcagacagtgcaggccatgagccaggacaacatcctgggcaaggtgaagaccctgcagcagcagctgggcaagaacatcaagtttggccagaggagccccaatgccatccccatgaacaaggccaacagcggggaggccagcctggaggaggacctcttcctgaccagccccatggagatcgtgacccagcaggacatcgtgctgagtgatgctgagaacaagagcagtgacacccccagcagcctgagccccctgaacctgcctggagctggcagcgagatggaggagaaggtggcccctgtgaagcccagccggcccaagaggcacttcagcagcgctggcaccattgaatctgtgaacctggatgccatccccctggccatcgcccggctggacaacagcgctgccaagcacaagctggccgtgaagcccaagaagcagagggtgtccaagaagcaccggcggctggcccaggacccccagcacgagcagggcggcctggagagccggccctgcctggaccagaatggccaccctggagaggacaagcccacctggcatgaggaggagcccaaccccctggacagcgaggaggagcggcggcggcaggaggactactggagggagctggaggccaagtgcaagaggcagaaggccgaggccgctgagaagaggcggctggaggagcagaggctgcaggccctggagcggcggctgtgggaggagaacagacggcaggagctgctggaggaggagggggagggccaggagccccccctggaggccgagcgggccccccgggaggagcagcagaggagcctggaggcccctggctgggaggatgctgagcggcgggagcgggaggagcgggagcggctggaggccgaggaggagcggcggcggctgcaggcccaggcccaggccgaggagcggcggcggctggaggaggatgcccggctggaggagcggcggcggcaggaggaggaggagggccgctgtgccgaggagctgaagaggcaggaggaggaggaggccgagggctgggaggagctggagcagcaggaggccgaggtgcagggccccccagaggccctggaggagactggagagggcagaagaggagctgaggaggaggacctgggggaggaggaggaggagggccaggcccacctggaggactggaggggccagctgtctgagctgctgaatgactttgaggagcggctggaggaccaggagcggctgaagccagagggccagcgggagcacagcgaggagcccggcatctgtgaggagcagaaccctgaggccgagaggagaagagagcagcagggccgcagcggggacttccagggcgctgacaggcctggccctgaggagaagcgggaggagggggacacagagcccctgctgaagcaggagggccctgtggaggccgcccagccccctgtggagaggaaggaggccgccgccctggagcagggcaggaaggtggaggagctgcgctggcaggaggtggatgagcggcagaccatgccccggccctacaccttccaggtgtcctctgggggcaagcagatcctcttccccaaggtgaacctgagccctgtgaccccagccaaggacaccggcctgacagctgccccccaggagcccaaggcccccaaggccagccctgtgcagcacgccctgcccagcagcctgtctgtgccccacacagccatcctggtgactggagcccagctgtgtggccctgctgtgaacctgagccagatcaaggacacagcctgcaagagcctgctgggcctggaggagaagaagcacgccgaggccccagctggggagaaccccccccggggccctggagatgcccgggccggcagcggcaaggccaagccccggcaggagagccccagcagcgccagcgccctggccgagtgggccagcatccgcagccgcatcctgaagaatgctgagagtgaccccaggagcagcgagcgggaccagctgcggcctggagatgagagcaccccccggggccgctgtgacagccggggcaaccagaggaagaccccacctgtgaatgccaagttcagcatcatgcctgcctggcagaagttcagtgatggcggcacagagaccagcaagcagagcacagaggccgagagcatcaggaagaggcccatgctgggccccagcgaggagacagccccccagcccccacctgctggggtgcgggagctgggcaaaggacctgagaagtctgagatgcaccgggagcctgctgacaccacagagggctgcaagtttgccaaggacctgcccagcttcctggtgcccagcctgccctacccaccccagaaggtggtggcccacacagagttcaccaccagcagtgacagcgagacagccaacggcatcgccaagccagaccctgtgatgcctggaggagaggagaaggccagccccttcggcatcaagctgcggaggaccaactacagcctgcgcttcaactgtgaccagcaggccgagcagaagaagaagaagaggcacagcagcactggagacagcgcagatgctggccccccagctgctggcagcgcccggggggagaaggagatggagggcgtggccctgaagcacggccccagcctgccccaggagaggaagcaggcccccagcacccggcgggacagcgctgagcccagcagcagccgctctgtgcctgtggcccaccctggccccccaccagccagcagccagaccccagcccctgagcatgacaaggccgccaacaagatgcccctggcccagaagccagccctggcccccaagcccaccagccagaccccaccagccagccccctgagcaagctgagccggccctacctggtggagctgctgagcagaagagctggccgcccagaccctgagcccagcgagcccagcaaggaggaccaggagagcagtgacagaagaccacccagccccccaggccctgaggagaggaagggccagaagagagatgaggaggaggaggccacagagaggaagccagccagcccccccctgcctgccacccagcaggagaagcccagccagaccccagaggccggcaggaaggagaagcccatgctgcagagccgccacagcctggatggcagcaagctgacagagaaggtggagacagcccagcccctgtggatcaccctggccctgcagaagcagaagggcttccgggagcagcaggccacccgggaggagaggaagcaggcccgggaggccaagcaggccgagaagctgagcaaagaaaatgtgtctgtgtctgtgcagcccggcagcagctctgtgtccagagctggcagcctgcacaagagcacagccctgcctgaggagaagaggcctgagacagctgtgtcccggctggagcggcgggagcagctgaagaaggccaacaccctgcccacctctgtgacagtggagatcagtgacagcgcccccccagcccccctggtgaaggaggtgaccaagcgcttcagcaccccagatgctgcccctgtgtccacagagcccgcctggctggccctggccaagaggaaggccaaggcctggagcgactgcccccagatcatcaagtag

SEQ ID NO: 41364 - DNA, 198 bp, Artificial Sequence
  Description of Artificial Sequence: Synthetic coding sequence
atgagcctgcccatcggcatctacagaagagctgtgtcctatgatgacaccctggaggaccctgcccccatgaccccacctccaagtgacatgggctctgtgccctggaagcctgtgattcctgagaggaagtaccagcacctggccaaggtggaggagggggaggccagcctgcccagccctgccatgaccctgtag

SEQ ID NO: 41365 - DNA, 288 bp, Artificial Sequence
  Description of Artificial Sequence: Synthetic coding sequence
atgagcctgcccatcggcatctacagaagagctgtgtcctatgatgacaccctggaggaccctgcccccatgaccccacctccaagtgacatgggctctgtgccctggaagcctgtgattcctgagaggaagtaccagcacctggccaaggtggaggagggggaggccagcctgcccagccctgccatgaccctgagcagcgccattgattctgtggacaaggtgcctgtggtgaaggccaaggccacccacgtgatcatgaacagcctcatcaccaagcagacctag

SEQ ID NO: 41366 - DNA, 2130 bp, Artificial Sequence; identical to SEQ ID NO: 41229
  Description of Artificial Sequence: Synthetic coding sequence

SEQ ID NO: 41367 - DNA, 168 bp, Artificial Sequence
  Description of Artificial Sequence: Synthetic coding sequence
gaggtgagcaacccctttgatggcctggaggagctgggcaagaccctggaggactacacccgggagttcatcaaccgcatcacccagagcgagctgcctgccaagatgtgggactggttcagcgagaccttcaggaaggtgaaggagaagctgaagacagacagctag

SEQ ID NO: 41368 - DNA, 228 bp, Artificial Sequence
  Description of Artificial Sequence: Synthetic coding sequence
atgtaccccatctgcaccgtggtggtggatggcctgcccagcgagagcagcagcagcagctacccaggccctgtgtctgtgtctgagatgagcctgctgcacgccctgggccctgtgcagacctggctgggccaggagctggagaagtgtggcattgatgccatgatctacacccgctacgtgctgagcctgctgctgcatgacagctatgactatgacctgcagtag

SEQ ID NO: 41369 - DNA, 918 bp, Artificial Sequence; identical to SEQ ID NO: 41122
  Description of Artificial Sequence: Synthetic coding sequence

SEQ ID NO: 41370 - DNA, 2130 bp, Artificial Sequence; identical to SEQ ID NO: 41229
  Description of Artificial Sequence: Synthetic coding sequence

SEQ ID NO: 41371 - DNA, 783 bp, Artificial Sequence
  Description of Artificial Sequence: Synthetic coding sequence
atggatgaggaggtgtctgaccccaccagcgctgctgcccagctgcggcagctgcgggaccacctgcccccacccagcagcgccagccccagccgggccctgcctgagccccaggaggcccagaagctggccgctgagcgggcccgggcccctgtggtgccctatggagtggacctgcactactggggccaggagctgcccacagctgggaagatcgtgaagagtgacagccagcaccgcttctggaagcccagcgaggtggaggaggaggtggtgaatgctgacatcagcgagatgctgcggagccgccacatcacctttgctgggaagtttgagcctgtgcagcactggtgccgggcccccaggccagatggccgcctgtgtgagcggcaggaccggctgaagtgccccttccacggcaagatcgtgcccagagatgatgagggccggcccctggaccctgaagatcgggcccgggagcagaggcggcagctgcagaagcaggagaggcctgagtggcaggaccctgagctgatgagagatgtggaggccgccaccggccaggacctgggcagcagccgctacagcggcaagggccggggcaagaagaggcgctaccccagcctgaccaacctgaaggcccaggccgacacagcccgggccagaattggaaggaaggtgtttgccaaggctgctgtgcggcgggtggtggccgccatgaacaggatggaccagaagaagcatgagaagttcagcaaccagttcaactatgccctgaactag

SEQ ID NO: 41372 - DNA, 783 bp, Artificial Sequence; identical to SEQ ID NO: 41371
  Description of Artificial Sequence: Synthetic coding sequence

SEQ ID NO: 41373 - DNA, 3828 bp, Artificial Sequence; identical to SEQ ID NO: 41308
  Description of Artificial Sequence: Synthetic coding sequence

SEQ ID NO: 41374 - DNA, 288 bp, Artificial Sequence
  Description of Artificial Sequence: Synthetic coding sequence
atggccagcagccactggaatgagaccaccacctctgtgtaccagtacctgggcttccaggtgcagaagatctaccccttccatgacaactggaacacagcctgcttcgtcatcctgctgctcttcatcttcaccgtggtgtccctggtggtgctggccttcctgtatgaggtgctggactgctgctgctgcgtgaagaacaagacagtgaaggacctgaagtctgagcccaaccccctgcgctccatgatggacaacatcaggaagcgggagacagaggtggtgtag

SEQ ID NO: 41375 - DNA, 354 bp, Artificial Sequence
  Description of Artificial Sequence: Synthetic coding sequence
atggagaccaagaagctgattggcaagcccctgcagcctgcccggcctgtgcgccacctgaccagccccccaggagctgtgttccccttcaacttccagaatgagtacccctgcaacacccagtgcatccagagcggcgtgagccgctgcaagaccaacggcatgcaggccttcagccagggcctgaatgagcagcagcagcagcagagccctgtgaagaaggagcgcatcaagtacagccgggacttcctgctgaagctgagctctgtgtccatctgcaggaagaagccagacttcctgcctgaccaccccatcgtgctgcagaagccagagaacaaccagagcttcaagtag

SEQ ID NO: 41376 - DNA, 339 bp, Artificial Sequence
  Description of Artificial Sequence: Synthetic coding sequence
ctgcaggacagaattgccaccttcttcttccccaagggcatgatgctgaccacagctgccctgatgctgttcttcctgcacctgggcatcttcatcagagatgtgcacaacttctgcatcacctaccactatgaccacatgtccttccactacacagtggtgctgatgttcagccaggtgatcagcatctgctgggccgccatgggcagcctgtatgcagagatgacagaaaataatgcccagaggagccacgtgctgcagccccctgtgctgggcgtgtctggccaccgggtgcctggaggagcccccctgcggcctggagagagcgagcagggctag

SEQ ID NO: 41377 - DNA, 6708 bp, Artificial Sequence
  Description of Artificial Sequence: Synthetic coding sequence
atgcccctcttcttcagcgccctgctggtgctgctgctggtggccctgagcgccctcttcctgggccgctggctggtggtgcggctggccaccaagtggtgccagaggaagctgcaggccgagctgaagattggcagcttccgcttcttctggatccagaatgtgtccctgaagttccagcagcaccagcagacagtggagattgacaacctgtggatcagcagcaagctgctgagccatgacctgccccactacgtggccctgtgcttcggggaggtgcgcatcagaacagacctgcagaaggtgtctgacctgagcgcccccttcagccagagcgctggggtggaccagaaggagctgtccttcagccccagcctgctgaagatcttctgccagctgttcagcatccacgtggatgccatcaacatcatggtgctgaaggtggacaccagcgagagcctgtggcacatccagatcagccgcagccgcttcctgctggacagtgatggcaagaggctcatctgtgaggtgtccctgtgcaagatcaacagcaaggtgctgaagagcggccagctggaggacacctgcctggtggagctgagcctggccctggacctgtgcctgaaggtgggcatcagcagccgccacctgacagccatcaccgtggatgtgtggaccctgcatgctgagctgcacgagggcctcttccagagccagctgctgtgccagggccccagcctggccagcaagcctgtgccctgcagcgaggtgacagagaacctggtggagcccaccctgcccggcctcttcctgctgcagcagctgcctgaccaggtgaaggtgaagatggagaacacctctgtggtgctgtccatgaacagccagaagaggcacctgacctggaccctgaagctgctgcagttcctgtaccacagagatgaggaccagctgcccctgcgctccttcaccgccaacagcgacatggcccagatgagcacagagctgctgctggaggatggcctgctgctgagccagagccggcagagaattgtgtgcctgaacagcctgaaggcctctgtgcaggtgaccaccatcgacctgagcgccagcctggtgctgaacacctgcatcatccactaccgccaccaggagttcagccactggctgcacctgctggccctggagacccagggcagcagcagccctgtgctgaagcagaggaagaagaggaccttcccccagatcctggcccccatcatcttcagcaccagcatcagcaatgtgaacatcagcatccagctgggggacaccccaccatttgccctgggcttcaacagcatcagcctggactaccagcacctgcggccccagagcatccaccagaggggcgtgctgactgtggaccacctgtgctggagggtgggcagtgacagccacatccagagggccccccacccccccaacatgcacgtgtggggcgaggccctggtgctggacagcttcaccctgcagggcagctacaaccagcccctgggcctgagcagcacccagagcgacaccctcttcctggactgcaccatccggggcctgcaggtggaggccagtgacacctgtgcccagtgcctgagccgcatcctgagcctgatgggcccccagagcggcaagtctgctgtgagccgccacagcagctttggagagagcgtgtccctgctgtggaaggtggacctgaaggtggaggacatgaacctcttcaccctgagcgccctggtgggcgccagcgaggtgcggctggacaccctgaccatcctgggcagcgctgagaccagcacagtgggcatccagggcctggtgctggccctggtgaagtctgtgacagagaagatgcagccctgctgcaaggccccagacatccccacccctgtgctgagcctgtccatgctgagcatcacctaccacagcagcatccgcagcctggaggtgcagtgtggggccggcctgaccctgctgtggagccccccagaccacatgtacctgtaccagcacgtgctggccaccctgcagtgccgggacctgctgcgggccaccgtcttccctgagaccgtgcccagcctggccctggagaccagcggcaccaccagcgagctggagggccgggcccctgagcccctgccccccaagaggctgctgaacctgaccctggaggtgtccacagccaagctgacagcctttgtggccgaggacaagttcatcaccctggccgctgagagcgtgtccctgagccgccacggcggcagcctgcaggcctactgcccagagctggccgccggctttgatggcaacagcatcttcaacttcaaggaggtggaggtgcagctgctgcctgagctggaggagatgatcctgcacaggaaccccttccctgccctgcagaccctgaggaacagagtgtggctgctgagctttggatctgtgtctgtggagttcccctaccagtatgacttcagcaggaccctggatgaagctgtgggcgtgcagaagtggctgaagggcctgcaccagggcacccgggcctgggccagccccagccctgtgcccctgcccccagacctgctgctgaaggtggagcacttctcctgggtgttcctggatgatgtgtttgaggtgaagctgcatgacaactatgagctgatgaaggatgagagcaaggagagcgccaagaggctgcagctgctggatgccaaggtggccgccctgaggaagcagcacggggagctgctgcctgccaggaagattgaggagctgtatgccagcctggagaggaagaacatcgagatctacatccagaggagccggcggctgtatggcaacacccccatgaggcgggccctgctgacctggagcctggccggcctggagctggtggccctggctgatgccagcttccacggccctgagcacgtggtggagcaggtgcaggagctggaccccggcagccccttccccccagagggcctggacctggtgatccagtggtgcaggatgctgaagtgcaatgtgaagagcttcctggtgcgcatccgggactacccccgctacctgtttgagatccgggactggaggctgatgggccgcctggtgggcacagagcagagcggccagccctgcagcagaagacggcagatcctgcacctgggcctgccctggggcaatgtggccgtggagaggaacatgccacccctgaagttctaccatgacttccacagcgagatcttccagtacacagtggtgtggggcccctgctgggaccctgcctggaccctcatcggccagtgtgtggacctgctgaccaagcccagcgctgaccccagcccccccctgccctggtgggacaagagccggctgctcttccatggagactggcacatggacatcgagcaggccaacctgcaccagctggccacagaggacccctacaacaccacagagaacatgcactgggagtggagccacctgtccttccactggaagccaggccagtttgtgttcaagggggacctggacatcaacgtgaggacagccagcaaatatgatgactgctgcttcctgcacctgcctgacctgtgcatgaccctggacctgcagtggctgtgccacggcaacccccatgaccaccacagcgtgaccctgcgggcccctgagttcctgcctgaggtgcccctgggccagctgcatgacagctaccgggccttccgctctgagaacctgaacctgagcatcaagatggacctgaccaggcacagcggcaccatcagccagccccgcatcctgctgtacagcagcaccctgcgctggatgcagaacttctgggccacctggacctctgtgacccggcccatctgccggggcaagctgttcaacaacctgaagcccagcaagaagaagctgggccagcactacaagcagctgagctacacagccctcttcccccagctgcaggtgcactactgggccagctttgcccagcagaggggcatccagatcgagtgcagccagggccacgtgttcacccggggcacccagaggctcatcccccaggccggcaccgtgatgagaagactcatcagtgactggagcgtgacccagatggtgtctgacctgagccaggtgacagtgcacctgatggccagccccacagaggagaatgctgaccactgcctggaccccctggtgaccaagacccacctgctgagcctgagcagcctgacctaccagaggcacagcaacagaacagctgaggaggagctgagcgccagagatggagaccccaccttccacacccaccagctgcacctggtggacctgcgcatctcctggaccaccaccaacagagacatcgccttcggcctgtatgatggctacaagaaggctgctgtgctgaagaggaacctgagcacagaggccctgaagggcctgaagattgacccccagatgcctgccaagaagcccaagaggggcgtgcccaccagcgccagcgccccaccccgggtgaacacccccagcttcagcggccagcctgacaagggcagcagcggcggggcctacatgctgcagaagctgattgaggagacagacagatttgtggtgttcacagaggaggagagcggcatgtctgaccagctgtgtggcattgctgcctgccagacagatgacatctacaacagaaactgcctgattgagctggtgaactgccagatggtgctgcggggagctgagacagagggctgtgtgattgtgtctgctgccaaggcccagctgctgcagtgccagcaccacccagcctggtatggagacaccctgaagcagaagacctcctggacctgcctgctggatggcatgcagtactttgccaccacagagagcagccccacagagcaggacggccggcagctgtggctggaggtgaagaacatcgaggagcaccggcagaggagcctggacagcgtgcaggagctgatggagagcggccaggccgtgggcggcatggtgaccaccaccacagactggaaccagcctgctgaggcccagcaggcccagcaggtgcagaggatcatcagccgctgcaactgcaggatgtactacatctcctacagccatgacatcgaccctgagctggccacccagatcaagcccccagaggtgctggagaaccaggagaaggaggacctgctgaagaagcaggagggcgctgtggacaccttcaccctcatccaccacgagctggagatcagcaccaacccagcccagtatgccatgatcctggacatcgtgaacaacctgctgctgcacgtggagcccaagaggaaggagcacagcgagaagaagcagagggtgcgcttccagctggagatcagcagcaaccctgaggagcagaggagcagcatcctgcacctgcaggaggccgtgcggcagcacgtggcccagatccggcagctggagaagcagatgtacagcatcatgaagagcctgcaggatgacagcaagaatgaaaacctgctggacctgaaccagaagctgcagctgcagctgaaccaggagaaggccaacctgcagctggagagcgaggagctgaacatcctgatccgctgcttcaaggacttccagctgcagagggccaacaagatggagctgaggaagcagcaggaggatgtgtctgtggtgagaagaacagagttctactttgcccaggcccgctggaggctgacagaagaagatggccagctgggcattgctgagctggagctgcagcgcttcctgtacagcaaggtgaacaagagtgatgacacagctgagcacctgctggagctgggctggttcaccatgaacaacctgctgcccaatgctgtgtacaaggccatcctgcggccccagagcagctgccagagcggccggcagctggccctgcggctcttcagcaaggtgcggccccctgtgggcggcatctctgtgaaggagcactttgaggtgaatgtggtgcccctgaccatccagctgacccaccagttcttccacaggatgatgggcttcttcttccctggccgctctgtggaggatgatgaggtgggagatgaggaggacaagagcaagctggtgaccaccggcatccctgtggtgaagccccggcagctgattgccacagatgatgctgtgcccctgggccctggaaaaggagtggcccagggcctgaccaggagcagtggagtgcggcgctccttcaggaagagccctgagcaccctgtggatgacatcgacaagatgaaggagagagctgccatgaacaacagcttcatctacatcaagatcccccaggtgcccctgtgtgtgtcctacaagggggagaagaacagcgtggactggggagacctgaacctggtgctgccctgcctggagtaccacaacaacacctggacctggctggactttgccatggctgtgaagagggacagcaggaaggccctggtggcccaggtgatcaaggagaagctgcggctgaagagcgccactggaagtgaggtgcggggcaagctggagaccaagagtgacctgaacatgcagcagcaggaggaggaggagaaggcccggctgctgattggcctgtctgtgggggacaagaaccctgggaagaagagcatctttggaagaaggaagtag

SEQ ID NO: 41378 - DNA, 3876 bp, Artificial Sequence
  Description of Artificial Sequence: Synthetic coding sequence
atgccacccaacttccctgagtttgctgagcgcatcgaggccagcctgtctgaggtgtctgaggccggggccagcaaccccagcctgcaggagaagaaggagagcagcagcgccctgacagagagcagcggccacctggaccaccgggagccccagagcgagagcgtgaccctggagcacgtgtccaagagcatcggcatccctgaggtgcaggacttcaagaacctgagcggggactgccaggacttccgcttccagcagcacagcgccaacccccctcatgagttccagcctgtggagagcgaggccgtggccaccagcggcaacacagatgtgatgcaggagagccgcttcagcagcgccacctggccccgggccaccaagagcctggccaagggcggcttcagcgagaagcagcaccccctgggggacacagcctgcaccgtggagatgccacccctgagcccctgcctgtctgaggagctgctggaccctgagctgcacgtgctgatcacccccagcctgcgggagaagacagaaagtgagctgaagtttgaagaagatgagcgctggatcatgatggaggccgagggggagtgggaggaggagaagctgagtgaccgggagaagaccttcctgatggctgatgagaagaacagcctggccgacatctttgaggagcgggagcaggccaacacagctgtggtggaggatggcagtgactgcctggccgctgtgctgcggaccttcggccacctgagcctgggccagatctgctgcccagatgacccccagcctgccaaggaccagctggccaccgtgcccaaggacatccccctggactgtgactgtgtgctgactggagaggacatcctgggggaggtggccaacagaacagcccagggcctggagggcctggtgtctgacagcgcctgcaccgtgggcaccattgatgctgagcagctgagtgacacagattctgtgcagatgttcctggagctggagaaggaatgtctgtgtgaggagggcgtgacccccctggtggagctgcagaaccagatcagcagcgagggcctggccgccagccaggatgctgagaacctgctggtgatcagccacttctctggagctgccctggagaaggagcagcacctgggcctgctgcacgtgcgggccaaggactatgacacccggctggactgtggctacttcaacaccctggacagcagccaggtgcccaatgctgtggagctgattgcccacgtggacatcatgagggacaccagcacagtgtccaaggaggagtgtgagaaggtgcccttcagccccaggacagctgagttcaagagccggcagcctgctgacctggacagcctggagaagctggaccccggcggcctgctgaacagcgaccaccgggtgtcccatgaggagaagctgagcggcttcatcgccagcgagctggccaaggacaatggcagcctgagccagggcgactgcagccagacagagggcaatggagaagaatgtattgagcgggtgaccttctcctttgccttcaaccacgagctgacagatgtgaccagcggccctgaggtggaggtgctgtatgagagcaacctgctgacagatgagatccacctggagagcggaaatgtgacagtgaaccaggagaacaacagcctgacctccatgggaaatgtggtgacctgtgagctgtctgtggagaaggtgtgtgatgaagatggagaggccaaggagctggactaccaggccaccctgctggaggaccaggccccagcccacttccacaggaacttccctgagcaggtgttccaggacctgcagaggaagagccctgagagcgagatcctgagcctgcacctgctggtggaggagctgcggctgaacccagatggagtggagaccgtgaatgacaccaagccagagctgaatgtggccagcagcgagggcggggagatggagcggcgggacagcgacagcttcctgaacatcttccctgagaagcaggtgaccaaggccggcaacacagagcctgtgctggaggagtggatccctgtgctgcagaggcccagcaggacagctgctgtgcccaccgtgaaggatgccctggatgctgccctgcccagccctgaggagggcaccagcattgctgctgtgcctgcccctgagggcacagctgtggtggccgccctggtgcccttcccccatgaggacatcctggtggccagcatcgtgtccctggaggaggaggatgtgacagctgctgctgtgtctgcccctgagcgggccaccgtgcctgctgtgacagtgtctgtgcctgagggcacagctgctgtggccgctgtgagcagccctgaggagacagccccagctgtggccgccgccatcacccaggagggcatgtctgctgtggccggcttcagccctgagtgggccgccctggccatcaccgtgcccatcacagaagaagatggcaccccagagggccctgtgaccccagccaccaccgtgcacgcccctgaggagccagacacagctgctgtgcgggtgtccaccccagaggagcccgccagccctgctgctgctgtgcccaccccagaggagcccaccagccctgctgctgctgtgcccaccccagaggagcccaccagccctgctgctgctgtgcccccacctgaggagcccaccagccctgctgctgctgtgcccaccccagaggagcccaccagccctgctgctgctgtgcccaccccagaggagcccaccagccctgctgctgctgtgcccaccccagaggagcccaccagccctgctgctgctgtgcccaccccagaggagcccaccagccctgctgctgctgtgcccaccccagaggagcccaccagccctgctgctgctgtgcccaccccagaggagcccgccagccctgctgctgctgtgcccaccccagaggagcccgccagccctgctgctgctgtgcccaccccagaggagcccgccttccctgccccagctgtgcccaccccagaggagagcgccagcgctgctgtggccgtgcccaccccagaggagagcgccagccctgctgctgctgtgcccaccccagctgagagcgccagctttgctgctgtggtggccaccctggaggagcccaccagccctgctgcctctgtgcccaccccagctgccatggtggccaccctggaggagttcaccagccctgctgcctctgtgcccaccagcgaggagcccgccagcctggccgctgctgtgagcaaccctgaggagcccaccagccctgctgctgctgtgcccaccctggaggagcccaccagcagcgctgctgctgtgctgaccccagaggagctgagcagccctgctgcctctgtgcccaccccagaggagcccgccagccctgctgctgctgtgagcaacctggaggagcccgccagccctgctgctgctgtgcccaccccagaggtggccgccatcccagctgcctctgtgcccaccccagaggtgcctgccatcccagctgctgctgtgccccccatggaggaggtgagccccatcggcgtgcccttcctgggcgtgtctgcccacacagacagcgtgcccatcagcgaggagggcacccctgtgctggaggaggccagcagcacaggcatgtggatcaaggaggacctggacagcctggtgtttggcatcaaggaggtgaccagcacagtgctgcacggcaaggtgcccctggccgccacagctggcctgaacagtgatgaagtcatcgtgcactttgattctgggaagggcctgaagagcaaggtgcgctttgctggcctgacctggtggtag

SEQ ID NO: 41379 - DNA, 207 bp, Artificial Sequence
  Description of Artificial Sequence: Synthetic coding sequence
atgtgcctgtactgctgggacatcgagcccagccaggtgaaccctgagggcccccggcagcaccaccccagcgaggtgacagagcggcagctggccaacaagaggatccagaacatgcagcacctgaagaaggagaagaggcggctgaacaagcgcttcagccggcccagccccatccctgagcccggcctgctgtggagcagctag

SEQ ID NO: 41380 - DNA, 1584 bp, Artificial Sequence
  Description of Artificial Sequence: Synthetic coding sequence
atggtgcggcccggctacagccaccgggtgtccctgcccaccagccctggcatcctggccaccagcccctacccagagacagattctgccttctttgagcccagccacctgaccagcgctgctgatgagggcgctgtgcaggtgtccaggaggaccatcagcagcaacagcttcagccctgaggtgtttgtgctgcctgtggatgtggagaaggaaaatgcccacttctacgtggccgacatgatcatcagcgccatggagaagatgaagtgcaacatcctgagccagcagcagacagagagctggagcaaggaggtgtctggcctgctgggcagtgaccagccagattctgagatgacctttgacaccaacatcaagcaggagagcggcagcagcaccagcagctacagcggctatgagggctgtgctgtgctgcaggtgtcccctgtgacagagaccaggacctaccatgatgtgaaggagatctgcaagtgtgatgtggatgaatttgtgatcctggagctgggggacttcaatgacatcacagagacctgcagctgcagctgcagcagcagcaagtctgtgacctatgagccagacttcaacagcgctgagctgctggccaaggagctgtacagagtcttccagaagtgctggatcctgtctgtggtgaacagccagctggccggcagcctgtctgctgctggcagcatcgtggtgaatgaagaatgtgtgaggaaggactttgagagctccatgaatgtggtgcaggagatcaagttcaagagccgcatccggggcacagaggactgggccccaccccgcttccagatcatcttcaacatccacccccccctgaagagggacctggtggtggccgcccagaacttcttctgtgccggctgcggcacccctgtggagcccaagtttgtgaagaggctgcgctactgtgagtacctgggcaagtacttctgtgactgctgccacagctatgcagagagctgcatcccagcccgcatcctgatgatgtgggacttcaagaagtactacgtgagcaacttcagcaagcagctgctggacagcatctggcaccagcccatcttcaacctgctgagcatcggccagagcctgtatgccaaggccaaggagctggacagagtgaaggagatccaggagcagctgttccacatcaagaagctgctgaagacctgccgctttgccaacagcgccctgaaggagtttgagcaggtgcccggccacctgacagatgagctgcacctgttcagcctggaggacctggtgcgcatcaagaagggcctgctggcccccctgctgaaggacatcctgaaggccagcctggcccacgtggccggctgtgagctgtgccagggcaagggcttcatctgtgagttctgccagaacaccaccgtcatcttccccttccagacagccacctgccgccgctgcagcgcctgccgggcctgcttccacaagcagtgcttccagagcagtgaatgtccccgctgtgcccgcatcacagcccggaggaagctgctggagagcgtggccagcgctgccacctag

SEQ ID NO: 41381 - DNA, 462 bp, Artificial Sequence
  Description of Artificial Sequence: Synthetic coding sequence
gtgcggggggccagcgcccggccccccctgctgggcagcgaggagcccctgagccctgccagccaccctgtgcgggagggcggcggcggcgtgtccccacctcctggccagcccccctgccctgggggccgctggggcggccagcccagcgcccggcctgctgcccccagcggccgggaggtgggcgtgtctgcccccaggcctgccagcaggcctgtgcgggaggtgcggggggccagcgcccggccccccctgctgggcagcgaggagcccctgtgcccagccagcaggcctgtgcgggagggcggcggcggcgtgagccccccacctggccagccccccaggcctgggggccgcggggccagcgcccggccccccctgctgggcagcgaggagcccctgtgtgccgccaccaccccatctggccgctgtgcccagcagctgattgaaaatggcccctag

SEQ ID NO: 41382 - DNA, 1290 bp, Artificial Sequence
  Description of Artificial Sequence: Synthetic coding sequence
atgggcctgcccagctggacccggcgcagcagaaatcatgatgtgtctggggcccccctgcccctggagtgcaaccacgtgggggaggccctgcccccagagatggtgacccggctgtatgatggcatgagaagagtggacctgaccgggaaggccaagggccccagtgaaaatgtgtcccaggagcagttcaccgcctccatgagccacctgctgaagggcaacagcgaggagaagagcctgatgatcatgaagatgatcagcgccacagagggccctgtgaaggcccgggaggtgcagaagttcacagaggacctggtgggctctgtggtgcacgtgctgagccaccggcaggagctgcggggctggacaggcaaggaggcccctggccccaacccccgggtgcaggtgctggccgcccagctgctgagtgacatgaagctgcaggacggcaagaggctgctgggcccccagtggctggactatgactgtgacagagctgtgattgaggactgggtgttccgggtgccccacgtggccatcttcctgtctgtggtgatctgcaagggcttcctgatcctgtgcagcagcctggacctgaccaccctggtgcctgagcggcaggtggaccagggccggggctttgagagcatcctggatgtgctgtctgtgatgtacatcaatgcccagctgccccgggagcagaggcaccgctggtgcctgctcttcagcagcgagctgcacggccacagcttcagccagctgtgtggccacatcacccaccggggcccctgtgtggccgtgctggaggaccatgacaagcacgtgtttggaggctttgccagctgctcctgggaggtgaagccccagttccagggcgacaaccgctgcttcctgttcagcatctgccccagcatggctgtgtacacccacacaggctacaatgaccactacatgtacctgaaccacggccagcagaccatccccaacggcctgggcatgggcggccagcacaactacttcggcctgtgggtggatgtggactttgggaagggccacagccgggccaagcccacctgcaccacctacaacagcccccagctgagcgcccaggagaacttccagtttgacaagatggaggtgtgggccgtgggggaccccagcgaggagcagctggccaagggcaacaagagcatcctggatgctgaccctgaggcccaggccctgctggagatcagcggccacagccgccacagcgagggcctgcgggaggtgcctgatgatgaatag

SEQ ID NO: 41383 - DNA, 2493 bp, Artificial Sequence
  Description of Artificial Sequence: Synthetic coding sequence
atggatgatgatgatgacagctgcctgctggacctgattggagacccccaggccctgaactacttcctgcacggccccagcaacaagagcagcaatgatgacctgaccaatgccggctacagcgctgccaacagcaacagcatctttgccaacagcagcaatgctgaccccaagagcagcctgaagggcgtgagcaaccagctgggggagggccccagtgatggcctgcccctgagcagcagcctgcagttcctggaggatgagctggagagcagccccctgcctgacctgacagaggaccagccctttgacatcctgcagaagagcctgcaggaggccaacatcacagagcagaccctggccgaggaggcctacctggatgccagcatcggcagcagccagcagtttgcccaggcccagctgcaccccagcagcagcgccagcttcacccaggccagcaatgtgagcaactacagcggccagaccctgcagcccatcggcgtgacccacgtgcctgtgggcgccagctttgccagcaacacagtgggcgtgcagcacggcttcatgcagcacgtgggcatctctgtgcccagccagcacctgagcaacagcagccagatcagcggcagcggccagatccagctgattggcagctttggaaaccaccccagcatgatgaccatcaacaacctggatggcagccagatcatcctgaagggcagcggccagcaggcccccagcaatgtgtctgggggcctgctggtgcaccggcagaccccaaatggaaacagcctgtttggaaacagcagcagcagccctgtggcccagcctgtgacagtgcccttcaacagcaccaacttccagaccagcctgcctgtgcacaacatcatcatccagaggggcctggcccccaacagcaacaaggtgcccatcaacatccagcccaagcccatccagatgggccagcagaacacctacaacgtgaacaacctgggcatccagcagcaccacgtgcagcagggcatcagctttgccagcgccagcagcccccagggctctgtggtgggcccccacatgtctgtgaacatcgtgaaccagcagaacaccaggaagcctgtgaccagccaggccgtgagcagcactggaggcagcatcgtcatccacagccccatgggccagccccacgccccccagagccagttcctgatccccaccagcctgtctgtgagcagcaacagcgtgcaccacgtgcagaccatcaatggccagctgctgcagacccagcccagccagctgatcagcggccaggtggccagcgagcacgtgatgctgaacagaaacagcagcaacatgctgcggaccaaccagccctacacaggccccatgctgaacaaccagaacacagctgtgcacctggtgtctggccagacctttgctgccagcggcagccctgtgattgccaaccacgccagcccccagctggtgggcggccagatgcccctgcagcaggccagccccaccgtgctgcacctgagccctggccagagctctgtgtcccagggccggcccggctttgccaccatgcccagcgtgacctccatgagcggccccagccgcttccctgctgtgtcctctgccagcacagcccaccccagcctgggcagcgctgtgcagagcggcagcagcggcagcaacttcaccggggaccagctgacccagcccaacagaacacctgtgcctgtgtctgtgagccaccggctgcctgtgagcagcagcaagagcaccagcaccttcagcaacaccccaggcaccggcacccagcagcagttcttctgccaggcccagaagaagtgcctgaaccagaccagccccatcagcgcccccaagaccacagatggcctgcggcaggcccagatccctggcctgctgagcaccaccctgcccggccaggacagcggcagcaaggtgatcagcgccagcctgggcacagcccagccccagcaggagaaggtggtgggcagcagccctggccaccctgctgtgcaggtggagagccacagcggcggccagaagaggcctgctgccaagcagctgaccaagggggccttcatcctgcagcagctgcagagggaccaggcccacacagtgaccccagacaagagccacttccgcagcctgagtgatgctgtgcagaggctgctgagctaccacgtgtgccagggctccatgcccacagaggaggacctgaggaaggtggacaatgaatttgagaccgtggccacccagctgctgaagaggacccaggccatgctgaacaagtaccgctgcctgctgctggaggatgccatgaggatcaaccccagcgctgagatggtgatgattgacaggatgttcaaccaggaggagcgggccagcctgagccgggacaagaggctggccctggtggaccctgagggcttccaggccgacttctgctgctacctgtacagctag

SEQ ID NO: 41384 - DNA, 1368 bp, Artificial Sequence
  Description of Artificial Sequence: Synthetic coding sequence
atggtggagcagggagatgctgcccccctgctgcgctgggccgagggccctgctgtgtccctgccccaggccccccagccccaggccggcggctggggccggggcggcggcggcggggcccggcctgctgctgagccccccaggagaagagagcctgaggagcctgctgcccctgaggtgctgctgcagcccggccgcctggagctgggagatgtggaggaggaccaggtggtggccgtgtttgtggtgacctttgaccccaggagcggcaacatggtggagtggtgcctgccccaggacatcgacctggagggcgtggagttcaagtccatggccagcggcagccacaagatccagagcgacttcatctacttcaggaagggccccttcttcggcctggcctgctttgccaacatgcctgtggagagcgagctggagcggggggccaggatgaagtctgtgggcatcctgagccccagctacaccctgctgtaccgctacatgcacttcctggagaaccaggtgcgccaccagctggagatgcctggccactacagccacctggccgccttctatgaggacaagaagggcgtgctgcatgctggccctggccggggcagcagcctgccccctgtgtactggctgcccagcatccaccgctacatgtacccagagatgaagatcacccaccctgctggctgcatgagccagttcatcaagttcttcggggagcagatcctgatcctgtggaagtttgccctgctgaggaagaggatcctgatcttcagccccccacctgtgggcgtggtgtgctacagagtgtactgctgctgctgcctggccaacgtgtccctgcccggcatcggcggcaccatccctgagagcaagcccttcttctacgtgaatgtggccgacatcgagagcctggaggtggaggtgtcctatgtggcctgcaccacagagaagatctttgaggagaagcgggagctgtatgatgtgtatgtggacaaccagaatgtgaagacccaccacgaccacctgcagcccctgctgaagatcaacagcgctgaccgggagaagtaccgccgcctgaatgagcagaggcagatgctgctgtacagccaggaggtggaggaggactacaacccctgtgaggaggacctgtttgtgctcttcttcctggagcagaacaaccgcatcttccagaccctgctggaggtgtctgccagccaggacaagaccctgacagctgagcacgcccggggcatgggcctggacccccagggcgacaggagcttcctgctggacctgctggaggcctatggaattgatgtgatgctggtgattgacaacccctgctgcccctag

SEQ ID NO: 41385 - DNA, 2235 bp, Artificial Sequence
  Description of Artificial Sequence: Synthetic coding sequence
atggaggactgcctgcacaccagcagcgagaacctgagcaagctggtgtcctgggcccacagccacggcaccatctgcagcctcatccccaacctgaagcacctgctgtctgagggcagccacggcaacctgacagccatgtggggctgcagcgctggccacgcctaccactggcccctgacagccacctgccgggccggcagccaggagcgggtgtgcttccaggacaacagaagcttcaacagcgacagccccagcatcatcggcgtgcccagcgagacccagaccagccctgtggagcgctacccaggccggcctgtgaaggccaagctggactgcaacagaacccgggacagctgtgacttctcctactgcagcgagcccagcgagctggatgagaccgtggaggagtatgaagatgagaacaccctgtttgacatggtgtgtgagagctctgtgacagatgaggacagcgactttgagccccagacccagaggccccagagcatcgccaggaagaggcctggggtggtgcccagcagcctgcacagcagcagccagacccagatggtggatgaatgtagcaatgatgtgatcatcaagaagatcaagcaggagatccctgaggactactacatcgtggccaatgctgagctgaccggcggcgtggatggccctgccctgagcctgacccagatggccaagcccaagccccagacccacgccggccccagctgtgtgggcagcgccaagctgatcccccacgtgaccagcgccatcagcacagagctggacccccacggcatgtctgccagccccagcgtcatcagccggcccatcgtgcagaagacagcccgggtgtccctggccagccccaacagaggccccccaggcacccacggcaccaaccagcaggtggccatgcagatgcctgtgtccaccagccaccccaacaagcagatcagcatccccctgagcgccctgcagctgcccggccaggatgagcaggtggccagcgaggagttcctgagccacctgcccagccaggtgagcagctgtgaggtggccctgagccccagcgtgaacacagagcctgaggtgagcagcagccagcagcagccccctgtggccccagccatcaccacagaggccacagcccagtgcatcccagaccaggatgaaagagctgctgagctgagccgggagcagaatgagaagaccatccgcagcacccagacagccctgaggaacttcccctacagcaccaagctgaacaagtttcctgtgttcaacatcaatgatgacctgaatgacctgtgcaccagcgctgtgagccccaacaccaccaaggccaccaggtatgccctgaatgtgtggagatactggtgcatgaccaacggcctgaaggaccacacagacatcaccaagatcccagctgtgaagctgaatgagctgctggagaacttctacgtgacagtgaagaagagtgatggcagtgacttcctggccaccagcctgcacgccatccggcggggcctggaccgcatcctgaagaatgctggggtgggcttcagcatcaccagcagcaccttcagcagcagcaccaagaagctgaaggagaagctgtgggtgctgagcaaggccggcatgtctggggcccggagcaggaacatcgtgtacttcagcctgagtgatgaggaggagatgtggcaggccggctgcctgggagatgacagccccatcaccctgctgagcacagtggtgaagtacaacagccagtacctgaacatgaggaccctgcaggagcacgccgacctgatgtacggggacatcgagctgctgaaggacccccagaaccagccctactttgccaggacagacagcgtgaagcgggagagccgcagcggcagcaccagggtgtgccacggcaagatctaccacgagcacagccggggccacaagcagtgcccctactgcctgctgtacaagtacatgtacatccaccggccccccacccagatggaggccaagagccccttctacctgacagccaggaaggaggccacagacatgggctctgtgtggtatgaggagcagaggatgggcctgcggagcctgcggggcatcgtgcccaacctggccaagaaggtgaagctggagaactgtgagaacttcacctttgtgtccttcacccaggtgtcccggcggctgggcagccacagctgctgccagtag

SEQ ID NO: 41386 - DNA, 111 bp, Artificial Sequence
  Description of Artificial Sequence: Synthetic coding sequence
aaggagaagaaggaggagaggaagaaggagaggaagaaggaggagaggaagaaggagaggaagaaggagaggaagaaggagaaggagaggaagaaggagaaggagaggtag

SEQ ID NO: 41387 - DNA, 462 bp, Artificial Sequence
  Description of Artificial Sequence: Synthetic coding sequence
gtgcggggggccagcgcccggccccccctgctgggcagcgaggagcccctgtgcccagccagcaggcctgtgcgggagggcggcggcggcgtgtccccacctcctggccagccccccaggcctgggggccgctggggcggccagcccccagcccggcctgctgcccccagcggccgggaggtgggcggcggccagcccccctgcccagccagcaggcctgtgcgggaggtgcggggggccagcgcccggccccccctgctgggcagcgaggagcccctgtgcccagccagcaggcctgtgcgggagggcggcggcggcgtgtccccacctcctggccagccccccaggcctggccgcggggccagcgcccggccccccctgctgggcagcgaggagcccctgtgcccagccaccaccccatctggccgctgtgcccagcagctgattgaaaatggcccctag

SEQ ID NO: 41388 - DNA, 267 bp, Artificial Sequence
  Description of Artificial Sequence: Synthetic coding sequence
atgcctggggtggtgtctgctgctggcacccaggtgcggcggctggatgaggtgcctgccagcctgcggctgcagcaccacctgcagctgcgggagggcctggccgtgcccctgccccccctggtgatccagagccctgctgcccaccacgtggccggcggcagcttcagtgacttcaccctggacatcgccctgggcgcccggcgcatccggctggccctggtgcggcaggtgacccaggacggccctgtggccttcctggcctag

SEQ ID NO: 41389 - DNA, 456 bp, Artificial Sequence
  Description of Artificial Sequence: Synthetic coding sequence
atgctgcgctggtttgtgcagcagcccaccagctgcagccacgcccagcccctgcccccaccccacggcacagccagcctgagccccctggtgcccagctgtggcagcgctgcctggcccagcctgcactacctgggcagccctgctgacagcggctgcagccggggccagagggccctgcctgctgtgtggccacccagctgctacagccagtgcccccagggccggcccccccaccctgtgcccaggagcccccggcggggcagccgggacctgggcaaggagcccggggaggaggccgccccctggcccagcccctgtgacagccggctgcaccgccaccccatgcccaggacccccctgagcgccagcgctggctgtgaccccagcctcatccagcccagcccccaccccaccccaccccagcagggctgtgtgacccccttccacaggtag

SEQ ID NO: 41390 - DNA, 2757 bp, Artificial Sequence
  Description of Artificial Sequence: Synthetic coding sequence
atgaatgaaaacatgagggccaccctggccaccagcaagaatgtgttccagctgaagctggaggagacccagaagctgctggaggaccagcacctgagcaacctgcagaagtttggagatgaggtgaaccagatcaccaacagcgagaccctgagcagcattgacagcctggaggccacagagcacgaggagatctacctgaccctgaacaaggagcacagcaccagcatccagaggaacaccatcagcctgaagccagccaacatgcagagcaccaacctgagctgctttgatgaggacaagctggccttcagcaagacccagcacatcaacaactggctgaccaacctggatgccagcaacacccagaatgtgacagccttcagtgacatcctgagcaagagcaatgtgctgcccagctgggagtacttcaacagcaaggagcagaaccccagccccctgaatggaacagtggagcgggccaccaacacagccaacaacagcgtgccctttgtgagcagcccccccatgtttgtgctggacaagaagtgtgagaagaccagcgagaccagcaccatgaggaccacagacagcaccagcggggccttcaagcgggagcggcccctggtgacagagagccccaccttcaagttcagcaagagccagagcaccagtgacagcctgacccaggaggtggccaccttcccagaccaggagaagtacagcgagctgaaccaggagaatggcaccaccagcatccccaccagctgtgtgcctgtggccacccccctggtgctgcccagcaacatccagagcgcccggcccagcgccaagaacagcatccacatcaaggagattgatgctgtgcagtgcagcgacaagctggatgagctgaaggatggcaaggaggaggagatcaagtacttcaactgcaacaaggaggagctgcccctcttcagtgacagcttccaggatgcctacatcccccacaacccagacagcaaggatgagaagcagaagctggccgagaccagcagcctgagcaatgtgaccagcaactatgactttgtgggccagcacaagaagatgaagtacaacatccacgagagaaatggagtgcgcttcctgaagagcatcctgaagaaggagagcaaatatgagcacggctacctgaaggccctgatcatcaaccagagcttcaagtttggaaaccagaaggccgccgccatccgggacagcattgagctgaccaaggagaagggagctgagatccccaagaccatcaagaagctgcgctggtttgatgagaccagcaacattgaaaataatgctgagaacagccacagcctgaagaacaagacaggcaccacccagcagcacagccagcagttccacatccagagcggggccggcagcaacatcatctctgtgtccacctgtgctgtgaacagcgctgacaccaagaagagccgggaggacagcatcagtgaaaatgtgaccaccctgggcggcagcggggctgaccacatgcccctgaactgcttcatccccagcggctacaactttgccaagcacgcctggccagccagcaagaaggaggagagcaagatccctgtgcatgatgacagcaagaccaagcagggcaagccccagaggggccgggccaagatcatcaggaagccaggcagcgccaaggtgcagagcggcttcatctgcaccaacaggaagggggccgtcatccagccccagagcgccagcaaggtgaacatcttcacccaggcccagggcaagctgatcatcccctgccccccaccccagagcaccagcaacatccgcagcggcaagaacatccaggtgtcccagtgccagcctgtgaccccagagaacccccagaacatcatcacccacaacagcttcaacagcaagcacgtgctgcccacagagcacagcctgaaccagtggaaccaggagagcagcagccccctgagcaatgcctgcagcgacctggtgaccgtcatccccagcctgcccagctactgcagcagcgagtgccagacctttgccaagatcaaccacagcaatggcacccaggccgtggcccggcaggatgccaccctgtactgcacccagaggagccctgtgtgtgaggagagctaccccagcgtgaccctgaggacagctgaggaggagagcgtgcccctgtggaagaggggccccaacgtgctgcaccagaacaagagggccaccggcagcacagtgatgaggaggaagagaattgctgagaccaagagaagaaacatcctggagcagaagaggcagaaccctggctctgtgggccagaagtacagcgagcagatcaacaactttggccagagcgtgctgctgagcagcagcgagcccaagcagaccacccggggcaccagctacatcgaggaggtgtctgacagcaccagcgagttcctgatggccgagaacctggtgaaggcctctgtgcctgaagatgagatcctgactgtgctgaacagcaagcagatccagaagagcaacctgcccctgaacaagacccagcagttcaacatctgcaccctgtctgctgaggagcagaagatcctggagagcctgaatgacctgtctgagcggctgcactacatccaggagagcatctgcaagaaccccagcatcaagaacaccctgcagatcatccccctgctggagaagcgggaggacaggaccagcagctgccgggacaagaggtag

SEQ ID NO: 41391 - DNA, 459 bp, Artificial Sequence
  Description of Artificial Sequence: Synthetic coding sequence
ctgcccctcttctgcagcagcggcatcctgcagaaggagttctggaggaaccgcatccagtacaaccagagccagaaggacatcctgcagagctggttccagcacgaccccttcccagacaaggccgcccgggagcagctggccaaggagattggagtgcctgagagcaacatccaggtgtggttcaagaactacagagtgaagcagaggaagctggactacaagtgcttcagcgagaaggaccagacccagggccatgaccagagccagcacctgacccaggagtacctgcccaaggaggcccggcagaagcagaccttcatcacctggacccagaagaaccggctggtgcaggcctttgagaggaaccccttcccagacatcgccaccaggaagaagctggccgagcagacaggcctgcaggagagccgcatccaggtgtcctccatgtgtgtgtag

SEQ ID NO: 41392 - DNA, 3930 bp, Artificial Sequence; identical to SEQ ID NO: 41321
  Description of Artificial Sequence: Synthetic coding sequence

SEQ ID NO: 41393 - DNA, 3681 bp, Artificial Sequence
  Description of Artificial Sequence: Synthetic coding sequence
atgggagagcagaaggtgtcccggcagttcaagcagtgccacaggaccacctcctgggccaagagcaagctgttcagccggctgagctccatgttcctgcagcagctgggcaagaacatcaagtttggccagaggagccccaatgccatccccatgaacaaggccaacagcggggaggccagcctggaggaggacctcttcctgaccagccccatggagatcgtgacccagcaggacatcgtgctgagtgatgctgagaacaagagcagtgacacccccagcagcctgagccccctgaacctgcccggggccggcagcgagatggaggagaaggtggcccctgtgaagcccagccggcccaagaggcacttcagcagcgctggcaccatcgagagcgtgaacctggatgccatccccctggccatcgcccggctggacaacagcgctgccaagcacaagctggccgtgaagcccaagaagcagagggtgtccaagaagcaccggcggctggcccaggacccccagcacgagcagggcggcctggagagccggccctgcctggaccagaatggccaccctggagaggacaagcccacctggcatgaggaggagcccaaccccctggacagcgaggaggagcggcggcggcaggaggactactggagggagctggaggccaagtgcaagaggcagaaggccgaggccgctgagaagaggcggctggaggagcagaggctgcaggccctggagcggcggctgtgggaggagaacagacggcaggagctgctggaggaggagggggagggccaggagccccccctggaggccgagcgggccccccgggaggagcagcagaggagcctggaggcccctggctgggaggatgctgagcggcgggagcgggaggagcgggagcggctggaggccgaggaggagcggcggcggctgcaggcccaggcccaggccgaggagcggcggcggctggaggaggatgcccggctggaggagcggcggcggcaggaggaggaggagggccgctgtgccgaggagctgaagaggcaggaggaggaggaggccgagggctgggaggagctggagcagcaggaggccgaggtgcagggccccccagaggccctggaggagaccggggagggcagaagaggagctgaggaggaggacctgggggaggaggaggaggagggccaggcccacctggaggactggaggggccagctgtctgagctgctgaatgactttgaggagcggctggaggaccaggagcggctgaagccagagggccagcgggagcacagcgaggagcccggcatctgtgaggagcagaaccctgaggccgagcggcggcgggagcagcagggccgcagcggggacttccagggcgctgaccggcccggccctgaggagaagcgggaggagggggacacagagcccctgctgaagcaggagggccctgtggaggccgcccagccccctgtggagaggaaggaggccgccgccctggagcagggcaggaaggtggaggagctgcgctggcaggaggtggatgagcggcagaccatgccccggccctacaccttccaggtgagcagcggcggcaagcagatcctcttccccaaggtgaacctgagccctgtgaccccagccaaggacaccggcctgacagctgccccccaggagcccaaggcccccaaggccagccctgtgcagcacgccctgcccagcagcctgtctgtgccccacacagccatcctggtgactggagcccagctgtgtggccctgctgtgaacctgagccagatcaaggacacagcctgcaagagcctgctgggcctggaggagaagaagcatgctgaggccccagctggagaaaatccaccccggggccctggagatgcccgggccggcagcggcaaggccaagccccggcaggagagccccagcagcgccagcgccctggccgagtgggccagcatccgcagccgcatcctgaagaatgctgagagtgaccccaggagcagcgagcgggaccagctgcggcctggagatgagagcaccccccggggccgctgtgacagccggggcaaccagaggaagaccccacctgtgaatgccaagttcagcatcatgcctgcctggcagaagttcagtgatggcggcacagagaccagcaagcagagcacagaagctgagagcatcaggaagaggcccatgctgggccccagcgaggagacagccccccagcccccacctgctggggtgcgggagctgggcaagggccctgagaagtctgagatgcaccgggagcctgctgacaccacagagggctgcaagtttgccaaggacctgcccagcttcctggtgcccagcctgccctacccaccccagaaggtggtggcccacacagagttcaccaccagcagtgacagcgagacagccaatggaattgccaagccagaccctgtgatgcctggaggagaggagaaggccagccccttcggcatcaagctgcggaggaccaactacagcctgcgcttcaactgtgaccagcaggccgagcagaagaagaagaagaggcacagcagcactggagacagcgcagatgctggccccccagctgctggcagcgcccggggggagaaggagatggagggcgtggccctgaagcacggccccagcctgccccaggagaggaagcaggcccccagcacccggcgggacagcgctgagcccagcagcagccgctctgtgcctgtggcccaccctggccccccaccagccagcagccagaccccagcccctgagcatgacaaggccgccaacaagatgcccctggcccagaagccagccctggcccccaagcccaccagccagaccccaccagccagccccctgagcaagctgagccggccctacctggtggagctgctgagccggcgggccggccgcccagaccctgagcccagcgagcccagcaaagaagaccaggagagcagtgaccggcggccccccagccccccaggccctgaggagaggaagggccagaagagagatgaggaggaggaggccacagagaggaagccagccagcccccccctgcctgccacccagcaggagaagcccagccagaccccagaggccggcaggaaggagaagcccatgctgcagagccgccacagcctggatggcagcaagctgacagagaaggtggagacagcccagcccctgtggatcaccctggccctgcagaagcagaagggcttccgggagcagcaggccacccgggaggagaggaagcaggcccgggaggccaagcaggccgagaagctgagcaaagaaaatgtgtctgtgtctgtgcagcccggcagcagctctgtgtcccgggccggcagcctgcacaagagcacagccctgcctgaggagaagaggcctgagacagctgtgtcccggctggagcggcgggagcagctgaagaaggccaacaccctgcccacctctgtgacagtggagatcagtgacagcgcccccccagcccccctggtgaaggaggtgaccaagcgcttcagcaccccagatgctgcccctgtgtccacagagcccgcctggctggccctggccaagaggaaggccaaggcctggagcgactgcccccagatcatcaagtag

SEQ ID NO: 41394 - DNA, 2538 bp, Artificial Sequence
  Description of Artificial Sequence: Synthetic coding sequence
atggcccaggtgtggaggagagtgtctgagcacttctgggagagcgagaccaccaccagcaagagcaccagcggcctgacagacatcacctggagcagcagcggcagtgacctgagtgatgaggacaagaccctgagccagctgcagagagatgagctgcagttcatcgactgggagattgacagcgacagagctgaggccagtgactgtgatgaatttgaagatgatgagggcgctgtggagatcagtgactgtgccagctgtgccagcaaccagagcctgaccagtgatgagaagctgtctgagctgcccaagcccagcagcattgagatcctggagtacagcagtgacagcgagaaggaggatgacctggagaatgtgctgctgattgacagcgagagcccccacaagtaccacgtgcagtttgccagtgatgcccggcagatcatggagcggctgattgaccccaggaccaagagcacagagaccatcctgcacaccccccagaagcccacagccaagttccccaggaccccagagaacagcgccaagaagaagctgctgcggggcggcctggccgagcggctgaatggcctgcagaaccgggagaggtctgccatcagcctgtggaggcaccagtgcatctcctaccagaagaccctgagcggcaggaagagcggcgtgctgactgtgaagatcctggagctgcatgaagaatgtgccatgcaggtggccatgtgtgagcagctgctgggcagccctgccaccagcagcagccagagcgtggcccccaggcctggggccggcctgaaggtgctcttcaccaaggagacagctggctacctgcggggccggccccaggacacagtgcgcatcttccccccctggcagaagctgatcatccccagcggcagctgccctgtgatcctgaacacctacttctgtgagaaggtggtggccaaggaggacagcgagaagacctgtgaggtgtactgcccagacatccccctgcccaggaggagcatcagcctggcccagatgtttgtgatcaagggcctgaccaacaacagccctgagatccaggtggtgtgcagcggcgtggccaccaccggcacagcctggacccacggccacaaggaggccaagcagaggatccccaccagcacccccctgcgggacagcctgctggatgtggtggagagccagggcgccgcctcctggccaggggccggcgtgcgggtggtggtgcagagggtgtacagcctgcccagccgggacagcacccggggccagcagggcgccagcagcggccacacagatcctgctggcacccgggcctgcctgctggtgcaggatgcctgtggcatgtttggagaggtgcacctggagttcaccatgagcaaggcccggcagctggagggcaagagctgcagcctggtgggcatgaaggtgctgcagaaggtgacccggggccgcacagctggcatcttcagcctgattgacaccctgtggcccccagccatccccctgaagaccccaggccgggaccagccctgtgaggagatcaagacccacctgcccccaccagccctgtgctacatcctgacagcccaccccaacctgggccagattgacatcattgatgaggaccccatctacaagctgtaccagccccctgtgacccgctgcctgcgggacatcctgcagatgaatgacctgggcacccgctgcagcttctacgccaccgtcatctaccagaagccccagctgaagagcctgctgctgctggagcagcgggagatctggctgctggtgacagatgtgaccctgcagaccaaggaggagcgggacccccggctgcccaagaccctgctggtgtatgtggcccccctgtgtgtgctgggcagcgaggtgctggaggccctggccggggccgccccccacagcctcttcttcaaggatgccctgcgggaccagggccgcatcgtgtgtgccgagaggacagtgctgctgctgcagaagcccctgctgtctgtggtgtctggggccagcagctgtgagctgcccggccctgtgatgctggacagcctggacagcgccacccctgtgaacagcatctgcagcgtgcagggcaccgtggtgggcgtggatgagagcacagccttctcctggcctgtgtgtgacatgtgtggaaatggccgcctggagcagaggcctgaggacagaggagccttcagctgtggggactgcagccgggtggtgaccagccctgtgctgaagaggcacctgcaggtgttcctggactgccgcagccggccccagtgccgggtgaaggtgaagctgctgcagaggagcatcagcagcctgctgcgctttgctgctggggaggatggcagctatgaggtgaagtctgtgctgggcaaggaggtgggcctgctgaactgctttgtgcagagcgtgacagcccaccccaccagctgcatcggcctggaggagattgagctgctgtctgctgggggcgccagcgctgagcactag

SEQ ID NO: 41395 - DNA, 324 bp, Artificial Sequence
  Description of Artificial Sequence: Synthetic coding sequence
atgctgagcaagggccgcagccccaggaggaagcaggtgcagacccagaggaaggccgccctggtgctgtctgtgacccccatggtgcctgtgggctctgtgtggctggccatgagctctgtgctgagcgccttcatgagggagctgcccggctggttcctgttcttcggggtcttcctgcctgtgaccctgctgctgctgctgctgattgcctacttccgcatcaagctgattgaggtgaatgaggagctgagccagaactgtgaccggcagcacaaccccaaggatggcagcagcctgtaccagaggatgaagtggacctag

SEQ ID NO: 41396 - DNA, 876 bp, Artificial Sequence
  Description of Artificial Sequence: Synthetic coding sequence
atccggcccttcagctctgtgaacagcctggtgctgaatgaggccagcaccctggccaagaggctgagcaccttcaccaccttcatccggcccttcagctccatgaagagccctgtgctgaatgaggcccgggccctgagcaagagatttgccaccttcaccgccctgatccgcagctgtgcctccatgaacagccctgtgctgaatgaggtgcgctttgctgggaagggcttcagcaccttcaccgccttcatccgctccttcagctctgtgaacagcctggtgctgaaccaggacaagtttgctgccaagggcttcctgaccttcaccgccctgatccggcccatcacctctgtgaatgctgctgtgtccaatgaggtgcgggagctgagcaagggcttccccaccttcagcgccttcatccgctccttcagcacagtgaacagcctggtgctgaatgagttccgctttgctgccaagcgcttccccaccatcacagccctgatccgccacttcagctctgtgaacagctccatgagcaatgaaattgaggacctgagcaagggcttccccaccctgacagccctgatccggcccttcagccgggtgaacagcctggtgtccaagaaggcccgggccctgagcaagggcttccctgccctggccaccttcatccggcccttcagctctgtgaacagcctggtgttcaatgaggtgcgctttgtggccaagggcttccccaccttcaccaccctgatgacccacagcagctctgtgaccagcctggtggtgaatgagttccgcttcatggacaagggcttcctgaccatcacagccttcatccggcccttcagctctgtgaactacctggtgtag

SEQ ID NO: 41397 - DNA, 672 bp, Artificial Sequence
  Description of Artificial Sequence: Synthetic coding sequence
aagccctatgcctgcaatgaatgtgtgaagagcttctgtgtgaagagcagcctcatcatccaccagaggacccacactggagagaagccctacaagtgcaatgaatatggcaagaccttccaccacaagagcaccctgactgtgcaccagaggacccatggagagaagccctacaagtgcaatgaatgtaggaagagcttctacatgaagagcgccctgagccagcaccagaggatccacatctgggaggagcactgtgagtgcaaggaatgtgggaagacctaccagaggagccacctggccaagcaccacaggaagtacaccaagaagccctatgagtgcaagcagtgtgggaagaccttccagaagagccacctgattgagcaccagaggacccaccctggagagatcccccatgagtgcaacaagtgtgggaagagcttctgctacaagagccccctgaccatccaccagaggacccacatcgaggagaagccctacaagtgcagcaagtctgtgacctacttctgcatgaagagccacctgactgtgcaccagaggccccacaccaggaagaacccctttgagtgcaatgaatgtaggaagatgttttatgtgaagagcaacctgatcaaccaccagaggacccacactggagagaagccctactag

SEQ ID NO: 41398 - DNA, 621 bp, Artificial Sequence
  Description of Artificial Sequence: Synthetic coding sequence
atgaaggccggcttccacctgaaccccaaggccatcgaggccagcctgcagggctgctgcagcgaggccgaggcccagcagacaggccggcggcagaccccaccccagcccatgcagtgtgagctgcccaccgtgcctgtgcagatcggcagccacttcctgaagggcgtgtccttcaatgaatctgctgctgacaacctgaagctgaagacccacaccatgctgcagctgatgaaggaggccggctgctacaacggcatcaccagcagagatgacttccctgtgacagaggtgctgaaccaggtgtgccccagcacctggaggggggcctgcaagacagctgtgcagctgctgtttggccaggccggcctggtggtggtggacacagcccagatcgagaacaaggaggcctatgccccccagatcagcctggagggcagcagaattgtggtgcaggtgcccagcacctggtgcctgaaggaggaccctgccaccatgagcctgctgcagaggagcctggaccctgagaagaccctgggcctggtggatgtgctgtacacagctgtgctggacctgaaccgctggagggctggccgcctggtgtacctgtccttcttctag

SEQ ID NO: 41399 - DNA, 3945 bp, Artificial Sequence
  Description of Artificial Sequence: Synthetic coding sequence
atggagaagcacaatgccctgcgctgcctgcctggaagaaacaggaaggagagcaccagcgagcagatgcccagcttccctgagatggtgtactacatccaggagaaggccagccacaggatgaagacccctgtgaagtacatgacaggcaccaccgtgctgcccttcaacccagctgcctttggagagatcgtgctgtacctgaggatgtgcctggcccacagcgctggggtggtgcccaccagccagagcctggccgacatgcaggaccacgccccagccatcggccgctacatccgcaccctgatgagcagcggccagatggcccccagcagcagcaacaagagcggggagaccaaccctgtgcagatctacatcggcctgctgcagcagctgctggccggcgtgggcggcctgcctgtgatgtactgcctgctggaggccgtgtctgtgtacccagagaagctggccaccaagtttgtggacaagacagagtggatcaagagcctgatgaacaacagcaaggaggagatgagggagctggccgccctcttctacagcgtggtggtgtccacagtgtctggaaatgagctgaagtccatgattgagcagctgatcaagaccaccaaggacaaccacagccctgagatccagcacggcagcctgctggccctgggcttcaccgtgggccgctacctggccaagaagaagatgaggatgtctgagcagcaggacctggagagaaatgctgacaccctgcctgaccaggaggagctgatccagagcgccacagagaccatcggcagcttcctggacagcaccagccccctgctggccatcgccgcctgcacagccctgggggagattggaagaaatggccccctgcccatccccagcgagggcagcggcttcaccaagctgcacctggtggagagcctgctgagccgcatccccagcagcaaggagaccaacaagatgaaggagcgggccatccagaccctgggctacttccctgtgggagatggagacttcccccaccagaagctgctgctgcagggcctgatggattctgtggaggccaagcagatcgagctgcagttcaccatcggggaggccatcaccagcgctgccatcggcaccagctctgtggccgccagagatgcctggcagatgacagaggaggagtacaccccacctgctggggccaaggtgaatgatgtggtgccctgggtgctggatgtgatcctgaacaagcacatcatcagccccaacccccacgtgcggcaggccgcctgcatctggctgctgagcctggtgaggaagctgagcacccacaaggaggtgaagagccacctgaaggagatccagagcgcctttgtgtctgtgctgtctgaaaatgatgagctgagccaggatgtggccagcaagggcctgggcctggtgtatgagctgggcaatgagcaggaccagcaggagctggtgtccaccctggtggagaccctgatgaccgggaagagggtgaagcatgaggtgtctggagaaacagtggtgttccagggcggggccctgggcaagaccccagatggccagggcctgagcacctacaaggagctgtgcagcctggccagtgacctgagccagcctgacctggtgtacaagttcatgaacctggccaaccaccacgccatgtggaacagcaggaagggggccgccttcggcttcaacgtgattgccaccagggctggggagcagctggcccccttcctgccccagctggtgccccggctgtaccgctaccagtttgaccccaacctgggcatccggcaggccatgaccagcatctggaatgccctggtgacagacaagtccatggtggacaagtacctgaaggagatcctgcaggacctggtgaagaacctgaccagcaacatgtggagggtgcgggagagcagctgcctggccctgaatgacctgctgcggggccggcccctggatgacatcatcgacaagctgcctgagatctgggagaccctcttccgggtgcaggatgacatcaaggagagcgtgaggaaggctgctgagctggccctgaagaccctgagcaaggtgtgtgtgaagatgtgtgaccctgccaagggagctgctggccagaggaccatcgccgccctgctgccctgcctgctggacaagggcatgatgagcacagtgacagaggtgcgggccctgagcatcaacaccctggtgaagatcagcaagtctgctggggccatgctgaagccccacgcccccaagctgatcccagccctgctggagagcctgtctgtgctggagccccaggtgctgaactacctgagcctgcgggccacagagcaggagaaggccgccatggacagcgcccggctgtctgctgccaagagcagccccatgatggagaccatcaacatgtgcctgcagtacctggatgtgtctgtgctgggggagctggtgccccggctgtgtgagctgatccgcagcggcgtgggcctgggcaccaagggcggctgtgccagcgtcatcgtgtccctgaccacccagtgcccccaggacctgaccccctacagcggcaagctgatgtctgccctgctgagcggcctgacagacagaaattctgtcatccagaagagctgtgcctttgccatgggccacctggtgaggaccagccgggacagcagcacagagaagctgctgcagaagctgaatggctggtacatggagaaggaggagcccatctacaagaccagctgtgccctgaccatccacgccatcggccgctacagcccagatgtgctgaagaaccacgccaaggaggtgctgcccctggccttcctgggcatgcatgaaattgctgatgaggagaagtctgagaaggaggagtgcaacctgtggacagaggtgtggcaggagaatgtgcccggcagctttggaggcatccggctgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgacagccctgctgcagggcctggccggccgcacctgggccggcaaggaggagctgctgaaggccatcgcctgtgtggtgacagcctgcagcgctgagctggagaagtctgtgcccaaccagcccagcaccaatgagatcctgcaggccgtgctgaaggagtgcagcaaagaaaatgtgaagtacaagatcgtggccatcagctgtgccgctgacatcctgaaggccaccaaggaggaccgcttccaggagttcagcaacatcgtcatccccctcatcaagaagaacagcctggagagcagtggagtgaggaccaccaagaatgaggaggagaatgagaaggagaaggagctgcagctggagtacctgctgggcgcctttgagagcctgggcaaggcctggcccagaaatgctgagacccagcgctgctaccggcaggagctgtgcaagctgatgtgtgagcggctgaagctgagcacctggaaggtgcagctgggcgtgctgcagagcatgaatgccttcttccagggcctgatgctgctggaggaggagcacgccgaccctgaggccctggccgagatcctgctggagacctgcaagagcatcacctacagcctggagaacaagacctacagctctgtgaggacagaggccctgagcgtcatcgagctgctgctgaagaagctggaggagagcaagcagtgggagtgcctgaccagtgaatgtcgggtgctgctgattgagagcctggccaccatggagccagacagcaggcctgagctgcaggagaaggccgccctgctgaagaagaccctggagaacctggagtag

SEQ ID NO: 41400 - DNA, 618 bp, Artificial Sequence
  Description of Artificial Sequence: Synthetic coding sequence
atggaggatggcggccagcgggaggaggagaccaggagaaatgccacctgtggggccgccgccaagtctgagaacagaggcaagagacatgccagcgctgggaagaagggggccggcggcaccagccccacagcccccagcaccaagaggcccctgcccggcctgagcgcccccctgggcgccggcagcgccagcagcccccccctgcgggcccctgtgcccaggagtgaatgtcctggaagaagaagacctgtgctggccgcccggagtgatgccctggagagcagccccatcagcctgcctgccacccctgtgcggcggcccctgctgagctacagcgcccccacccacctgggcaccccaggaggagcccggggccacctgcagggcgagggcctgcggggccagggcaagccccctgtgtggagggtgagaagagccctgcccccaggctggacccagcaggccgaggcccaggagcagggcagcgccaccagggctggcctgggcgcccggcggggcgtgggcacagcctcctggggctggacctgggccacctgtggcaggaagggggccaggaacaggaagagaagtgatgagcggccccggcccccatag

SEQ ID NO: 41401 - DNA, 1353 bp, Artificial Sequence
  Description of Artificial Sequence: Synthetic coding sequence
atgaacagagtgtctgaggagaaggaggtgacagaggagcggctgaaggccgagcaggagagctttgagaagaagatccggcagctggaggagcagaatgaactcatcatcaaggagcgggaggccctgcagctgcagtaccgggagtgccaggagctgctgagcctgtaccagaagtacctgtctgagcagcaggagaagctgaccatgagcctgtctgagctgggcgccgccaggatgcaggagcagcaggtgagcagcaggaagagcaccctgcagtgcagctctgtggagctggatggcagctacctgagcatcgcccggccccagacctactaccagaccaagcagaggcccaagtctgctgtgcaggacagcgccagcgagagcctcatcgccttcaggaacaacagcctgaagcctgtgaccctgcaccaccccaaggatgacctggacaagatccccagcgagaccaccacctgcaactgtgagagccctggcaggaagccagctgtgcccacagagaagatgccccaggaggagctgcacatgaaggagtgcccccacctgaagcccacccccagccagtgctgcggccaccggctggccgctgacagagtgcatgacagccaccccaccaacatgaccccccagcaccccaagacccaccctgagagctgcagctactgccgcctgtcctgggccagcctggtgcatggaggaggagccctgcagcccatcgagaccctgaagaagcagatcagcgaggacaggaagcagcagctgatgctgcagaagatggagctggagattgagaaggagcggctgcagcacctgctggcccagcaggagaccaagctgctgctgaagcagcagcagctgcaccagagccggctggactacaactgcctgctgaagagcaactgtgatggctggctgctgggcaccagcagcagcatcaagaagcaccaggacccccccaacagcggagaaaataggaaggagaggaagacagtgggcttccacagccacatgaaggatgatgcccagtggagctgccagaagaaggacacctgccggccccagaggggcaccgtgactggagtgaggaaggatgccagcaccagccccatgcccaccggcagcctgaaggactttgtgaccacagccagccccagcctgcagcacaccaccagccgctatgagaccagcctgctggacctggtgcagagcctgagccccaacagcgcccccaagccccagcgctaccccagccgggaggccggggcctggaaccacgtgaacctgcaggaggtgagcagccccagccggcggggcggcctgcacctgtag

SEQ ID NO: 41402 - DNA, 1257 bp, Artificial Sequence
  Description of Artificial Sequence: Synthetic coding sequence
atgaagaagaggaaggagctgaatgccctgattggcctggccggggacagcaggaggaagaagcccaagaagggccccagcagccaccggctgctgaggacagagcccccagacagcgacagcgagagcagcagcgaggaggaggaggagtttggagtggtgggcaacagaagcagatttgccaagggggactacctgcgctgctgcaagatctgctaccccctgtgtggcttcgtcatcctggccgcctgtgtggtggcctgtgtgggcctggtgtggatgcaggtggccctgaaggaggacctggatgccctgaaggagaagttccgcaccatggagagcaaccagaagagcagcttccaggagatccccaagctgaatgaggagctgctgagcaagcagaagcagctggagaagattgagagcggggagatgggcctgaacaaggtgtggatcaacatcacagagatgaacaagcagatcagcctgctgaccagcgctgtgaaccacctgaaggccaacgtgaagtctgctgctgacctgatcagcctgcccaccaccgtggagggcctgcagaagtctgtggccagcatcggcaacaccctgaacagcgtgcacctggccgtggaggccctgcagaagacagtggatgagcacaagaagaccatggagctgctgcagagcgacatgaaccagcacttcctgaaggagaccccaggcagcaaccagatcatccccagccccagcgccaccagcgagctggacaacaagacccacagcgagaacctgaagcagatgggagacagaagtgccaccctgaagaggcagagcctggaccaggtgaccaacagaacagacacagtgaagatccagagcatcaagaaggaggacagcagcaacagccaggtgtccaagctgcgggagaagctgcagctgatcagcgccctgaccaacaagccagagagcaacagacctcctgagacagcagatgaggagcaggtggagagcttcaccagcaagcccagcgccctgcccaagttcagccagttcctgggggaccctgtggagaaggccgcccagctgcggcccatcagcctgcccggggtgagcagcacagagggccagacccagctgctgctgagccctgcctggagaaatgctgtgaactttggcagcagccagtggggcatccctgggaaggtgatcctgagcaatgtgtggaacagacggcagatgccctggggcaacagcctgtag

SEQ ID NO: 41403 - DNA, 1203 bp, Artificial Sequence; identical to SEQ ID NO: 41100
  Description of Artificial Sequence: Synthetic coding sequence

SEQ ID NO: 41404 - DNA, 210 bp, Artificial Sequence
  Description of Artificial Sequence: Synthetic coding sequence
atgatggtgctgacccccttctggctgggccgggactgccccagccggggccagcccaccctgcgggagggcaagggcctgtctgtgcccttcacctgcaagctgaacaacccccagcgctacctgctgtacctgacccacaccccccggcggcagtacagccctgcctggtacctgcccgggaagctgggcatcaccctgactgtgtag

SEQ ID NO: 41405 - DNA, 1173 bp, Artificial Sequence
  Description of Artificial Sequence: Synthetic coding sequence
tgtgagaagagcaccttcttcaagcaccagaagaggacccacacagtggagaagacctttgaatgtagccacggcaagaagagcttctgccaggagagccacttcacagagcaccacaggacctgcacccgggagaagccctgtgagagcaacaagtatggcaagaccttccaccagaagaggagcttcatccaccaccagaggacccacactggagagaagccctatgagtgcaaggagtgcaggaagagcttccacgtgaagcccaacctgaccaagcaccagaagacccacatcggggagaagcccttcaagtgcacagcctgtggccgcaccttcttccagcagagcaccctgaatgtgcaccagggcaagcacacagaggagaagccctacaagtacacagaatgtgagaagagcttctacaagtctgtgctgatcatccacgagaggacccacactggagagaagccctgtggctgcaatgaatgtgagaagagctttgaggtgctgaccaccctggtgatccaccagaggacccacactggagagaagccctacaagtgcaatgaatgtgagaagagctacctgaacctgaagagccacctgaacatccacctgaggaaccacacaggcaagaggccccacgtgtgcaatgaatgtgggaaggccttctccatgaagagcaacttcacagaccaccagaggacccactgtggggagaagccctacaagtgcaatgaatgtaggaagagcttctacatgaagagcgccctgagccagcaccagaggatccacatctacaagaagccctatgagtgcaagcagtgtgggaagaccttccagaagagccacctgattgagcaccagaggacccaccctggagagatcccccatgagtgcaacaagtgtgggaagagcttctgctacaagagccccctgaccatccaccagaggacccacatcgaggagaagccctacaagtgcagcaagtctgtgacctacttctgcatgaagagccacctgactgtgcaccagaggccccacaccaggaagaacccctttgagtgcaatgaatgtaggaagatgttttatgtgaagagcaacctgatcaaccaccagaggacccacactggagagaagccctatgagggcaacacctgtgggaagtag

SEQ ID NO: 41406 - DNA, 6279 bp, Artificial Sequence
  Description of Artificial Sequence: Synthetic coding sequence
atggtgctgaaggtggacaccagcgagagcctgtggcacatccagatcagccgcagccgcttcctgctggacagtgatggcaagaggctcatctgtgaggtgtccctgtgcaagatcaacagcaaggtgctgaagagcggccagctggaggacacctgcctggtggagctgagcctggccctggacctgtgcctgaaggtgggcatcagcagccgccacctgacagccatcaccgtggatgtgtggaccctgcacgccgagctgcacgagggcctcttccagagccagctgctgtgccagggccccagcctggccagcaagcctgtgccctgcagcgaggtgacagagaacctggtggagcccaccctgcccggcctcttcctgctgcagcagctgcctgaccaggtgaaggtgaagatggagaacacctctgtggtgctgtccatgaacagccagaagaggcacctgacctggaccctgaagctgctgcagttcctgtaccacagagatgaggaccagctgcccctgcggagcttcaccgccaacagcgacatggcccagatgagcacagagctgctgctggaggatggcctgctgctgagccagagccggcagagaattgtgtgcctgaacagcctgaaggcctctgtgcaggtgaccaccatcgacctgagcgccagcctggtgctgaacacctgcatcatccactaccgccaccaggagttcagccactggctgcacctgctggccctggagacccagggcagcagcagccctgtgctgaagcagaggaagaagaggaccttcccccagatcctggcccccatcatcttcagcaccagcatcagcaatgtgaacatcagcatccagctgggggacaccccaccatttgccctgggcttcaacagcatcagcctggactaccagcacctgcggccccagagcatccaccagaggggcgtgctgactgtggaccacctgtgctggagggtgggcagtgacagccacatccagagggccccccacccccccaacatgcacgtgtggggcgaggccctggtgctggacagcttcaccctgcagggcagctacaaccagcccctgggcctgagcagcacccagagcgacaccctcttcctggactgcaccatccggggcctgcaggtggaggccagtgacacctgtgcccagtgcctgagccgcatcctgagcctgatgggcccccagagcggcaagtctgctgtgagccgccacagcagctttggagagagcgtgtccctgctgtggaaggtggacctgaaggtggaggacatgaacctcttcaccctgagcgccctggtgggcgccagcgaggtgcggctggacaccctgaccatcctgggcagcgctgagaccagcacagtgggcatccagggcctggtgctggccctggtgaagtctgtgacagagaagatgcagccctgctgcaaggccccagacatccccacccctgtgctgagcctgtccatgctgagcatcacctaccacagcagcatccgcagcctggaggtgcagtgtggggccggcctgaccctgctgtggagccccccagaccacatgtacctgtaccagcacgtgctggccaccctgcagtgccgggacctgctgcgggccaccgtcttccctgagaccgtgcccagcctggccctggagaccagcggcaccaccagcgagctggagggccgggcccctgagcccctgccccccaagaggctgctgaacctgaccctggaggtgtccacagccaagctgacagcctttgtggccgaggacaagttcatcaccctggccgctgagagcgtgtccctgagcagacatggaggcagcctgcaggcctactgcccagagctggccgccggctttgatggcaacagcatcttcaacttcaaggaggtggaggtgcagctgctgcctgagctggaggagatgatcctgcacaggaaccccttccctgccctgcagaccctgaggaacagagtgtggctgctgagctttggatctgtgtctgtggagttcccctaccagtatgacttcagcaggaccctggatgaggccgtgggcgtgcagaagtggctgaagggcctgcaccagggcacccgggcctgggccagccccagccctgtgcccctgcccccagacctgctgctgaaggtggagcacttctcctgggtgttcctggatgatgtgtttgaggtgaagctgcatgacaactatgagctgatgaaggatgagagcaaggagagcgccaagaggctgcagctgctggatgccaaggtggccgccctgaggaagcagcacggggagctgctgcctgccaggaagattgaggagctgtatgccagcctggagaggaagaacatcgagatctacatccagaggagccggcggctgtatggcaacacccccatgagaagagccctgctgacctggagcctggccggcctggagctggtggccctggctgatgccagcttccacggccctgagcacgtggtggagcaggtgcaggagctggaccccggcagccccttccccccagagggcctggacctggtgatccagtggtgcaggatgctgaagtgcaatgtgaagagcttcctggtgcgcatccgggactacccccgctacctgtttgagatccgggactggaggctgatgggccgcctggtgggcacagagcagagcggccagccctgcagcagaagacggcagatcctgcacctgggcctgccctggggcaatgtggccgtggagaggaacatgccacccctgaagttctaccatgacttccacagcgagatcttccagtacacagtggtgtggggcccctgctgggaccctgcctggaccctgattggccagtgtgtggacctgctgaccaagcccagcgctgaccccagcccccccctgccctggtgggacaagagccggctgctcttccacggggactggcacatggacatcgagcaggccaacctgcaccagctggccacagaggacccctacaacaccacagagaacatgcactgggagtggagccacctgtccttccactggaagccaggccagtttgtgttcaagggggacctggacatcaacgtgaggacagccagcaaatatgatgactgctgcttcctgcacctgcctgacctgtgcatgaccctggacctgcagtggctgtgccacggcaacccccatgaccaccacagcgtgaccctgcgggcccctgagttcctgcctgaggtgcccctgggccagctgcatgacagctaccgggccttccgctctgagaacctgaacctgagcatcaagatggacctgaccaggcacagcggcaccatcagccagccccgcatcctgctgtacagcagcaccctgcgctggatgcagaacttctgggccacctggacctctgtgacccggcccatctgccggggcaagctgttcaacaacctgaagcccagcaagaagaagctgggccagcactacaagcagctgagctacacagccctcttcccccagctgcaggtgcactactgggccagctttgcccagcagaggggcatccagattgaatgttcccagggccacgtgttcacccggggcacccagaggctcatcccccaggccggcaccgtgatgaggaggctcatcagtgactggagcgtgacccagatggtgtctgacctgagccaggtgacagtgcacctgatggccagccccacagaagaaaatgctgaccactgcctggaccccctggtgaccaagacccacctgctgagcctgagcagcctgacctaccagaggcacagcaacagaacagctgaggaggagctgagcgccagagatggagaccccaccttccacacccaccagctgcacctggtggacctgcgcatctcctggaccaccaccaacagagacatcgccttcggcctgtatgatggctacaagaaggctgctgtgctgaagaggaacctgagcacagaggccctgaagggcctgaagattgacccccagatgcctgccaagaagcccaagaggggcgtgcccaccagcgccagcgccccaccccgggtgaacacccccagcttcagcggccagcctgacaagggcagcagtggaggagcctacatgctgcagaagctgattgaggagacagacagatttgtggtgttcacagaggaggagagcggcatgtctgaccagctgtgtggcattgctgcctgccagacagatgacatctacaacagaaactgcctgattgagctggtgaactgccagatggtgctgcggggagctgagacagagggctgcgtcatcgtgtctgctgccaaggcccagctgctgcagtgccagcaccacccagcctggtacggggacaccctgaagcagaagacctcctggacctgcctgctggatggcatgcagtactttgccaccacagagagcagccccacagagcaggacggccggcagctgtggctggaggtgaagaacatcgaggagcaccggcagaggagcctggacagcgtgcaggagctgatggagagcggccaggccgtgggcggcatggtgaccaccaccacagactggaaccagcctgctgaggcccagcaggcccagcaggtgcagaggatcatcagccgctgcaactgcaggatgtactacatctcctacagccatgacattgatcctgagctggccacccagatcaagcccccagaggtgctggagaaccaggagaaggaggacctgctgaagaagcaggagggcgctgtggacaccttcaccctcatccaccacgagctggagatcagcaccaacccagcccagtatgccatgatcctggacatcgtgaacaacctgctgctgcacgtggagcccaagaggaaggagcacagcgagaagaagcagagggtgcgcttccagctggagatcagcagcaaccctgaggagcagaggagcagcatcctgcacctgcaggaggccgtgcggcagcacgtggcccagatccggcagctggagaagcagatgtacagcatcatgaagagcctgcaggatgacagcaagaatgaaaacctgctggacctgaaccagaagctgcagctgcagctgaaccaggagaaggccaacctgcagctggagagcgaggagctgaacatcctgatccgctgcttcaaggacttccagctgcagagggccaacaagatggagctgaggaagcagcaggaggatgtgtctgtggtgcggaggacagagttctactttgcccaggcccgctggaggctgacagaggaggatggccagctgggcattgctgagctggagctgcagcgcttcctgtacagcaaggtgaacaagagtgatgacacagctgagcacctgctggagctgggctggttcaccatgaacaacctgctgcccaatgctgtgtacaaggtggtgctgcggccccagagcagctgccagagcggccggcagctggccctgcggctcttcagcaaggtgcggccccctgtgggcggcatctctgtgaaggagcactttgaggtgaatgtggtgcccctgaccatccagctgacccaccagttcttccacaggatgatgggcttcttcttccctggccgctctgtggaggatgatgaggtgggagatgaggaggacaagagcaagctggtgaccaccggcatccctgtggtgaagccccggcagctgattgccacagatgatgctgtgcccctgggccctgggaagggcgtggcccagggcctgaccaggagcagcggcgtgagaagaagcttcaggaagagccctgagcaccctgtggatgacatcgacaagatgaaggagcgggccgccatgaacaacagcttcatctacatcaagatcccccaggtgcccctgtgtgtgtcctacaagggggagaagaacagcgtggactggggagacctgaacctggtgctgccctgcctggagtaccacaacaacacctggacctggctggactttgccatggctgtgaagagggacagcaggaaggccctggtggcccaggtgatcaaggagaagctgcggctgaagagcgccaccggcagcgaggtgcggggcaagctggagaccaagagtgacctgaacatgcagcagcaggaggaggaggagaaggcccggctgctgattggcctgtctgtgggggacaagaaccctgggaagaagagcatcttcggccgcaggaagtag

SEQ ID NO: 41407 - DNA, 2571 bp, Artificial Sequence
  Description of Artificial Sequence: Synthetic coding sequence
atgtctggagagctgcagaggaagattggcctgaaggtgctggagatgagaggaaatgctgtggtgggctacctgcagtgctttgacctggagggggagagcggcctggtggtgcgggccatcggcacagcctgcaccctggacaagctgagcagccctgctgccttcctgcctgcctgcaacagccccagcaaggagatgaaggagagccccctggtgcacccccccagccacggctgccgcagcacccacaacagccccatccacacagccaccggcagccggctgacccagaacttctctgtgtctgtgcccaccctcatctacacaggcatgggcagcggcagcgctgggaaggagggcggccccttcaaggccctgctgcggcagcagacccagagcgccctggagcagcgggagttccccttcttcaccctgacagccttccccccaggcttcctggtgcacgtgggcggcgtggtgtctgcccggtctgtgaagctgctggaccgcatccacaacccagcctttgtgggcatcatgggcaacaccaggagctacaagctgctggactggaacagcttcaacagtgatgagcctgagaccagagatgcctggtgggccgagatccggcaggagatcaagagccacgccaaggccctgggctgccacgctgtggtgggctacagcgagagcaccagcatctgtgaggaggtgtgcatcctgagcgccagcggcacagctgctgtgctgaacccccgcttcctgcaggacggcaccgtggagggctgcctggagcagaggctggaggagaacctgcccacccgctgtggcttctgccacatcccctatgatgagctgaacatgcccttccctgcccacctgacctactgctacaactgcaggaagcagaaggtgcctgatgtgctcttcaccaccatcgacctgcccacagatgccaccgtgattggcaagggctgcctgatccaggcccggctgtgccgcctgaagaagaaggcccaggccgaggccaatgccacagccatcagcaacctgctgcccttcatggagtatgaggtgcacacccagctgatgaacaagctgaagctgaagggcatgaatgccctgtttggcctgcgcatccagatcaccgtgggggagaacatgctgatgggcctggccagcgccactggagtgtacctggccgccctgcccaccccaggcggcatccagattgctgggaagaccccaaatgatggcagctatgagcagcacatcagccacatgcagaagaagatcaatgacaccatcgccaagaacaaggagctgtatgagatcaaccccccagagatcagcgaggagatcatcggcagccccatccctgagccccggcagaggagccggctgctgcggagccagagcgagagcagtgatgaggtgacagagctggacctgagccacggcaagaaggatgcctttgtgctggagattgatgacacagatgccatggaggatgtgcacagcctgctgacagatgtgcccccaccttctggcttctacagctgcaacacagagatcatgcctggcatcaacaactggaccagcgagatccagatgttcacctctgtgcgggtcatccggctgagcagcctgaacctgaccaaccaggccctgaacaagaacttcaatgacctgtgtgagaacctgctgaagagcctgtacttcaagctgcgctccatgatcccctgctgcctgtgccacgtgaacttcaccgtgtccctgcctgaagatgagctgatccaggtgacagtgacagctgtggccatcacctttgacaagaaccaggccctgcagaccaccaagacccctgtggagaagagcctgcagagggccagcacagacaatgaggagctgctgcagttccccctggagctgtgcagcgacagcctgcccagccaccccttccccccagccaaggagcacctggagagcgccagcagcaacagcggcatcccagctgcccagagggaccgctgcagctcctggattgagctgatcaagctgaaggcccagaccatccggcggggcagcatcaagaccaccatgacagtggagaaggccagccctgtgggagatggcaacttcaggaacagaagtgccccaccctgtgccaacagcacagtgggcgtggtgaagatgacccccctgtccttcatccctggggccaagatcaccaagtacctgggcatcatcaacatgttcttcatccgggagaccaccagcctgcgggaggagggcggcgtgtctggcttcctgcacgccttcatcgccgaggtgtttgccatggtgcgggcccacgtggccgccctgggcggcaatgctgtggtgtcctacatcatgaagcagtgtgtgttcatggagaaccccaacaagaaccaggcccagtgcctgatcaacgtgtctggagatgctgtggtgtttgtgcgggagagtgacctggaggtggtgagcagccagcagcccaccaccaactgccagagcagctgcacagaaggagaggtgaccacctag

SEQ ID NO: 41408 - DNA, 1545 bp, Artificial Sequence
  Description of Artificial Sequence: Synthetic coding sequence
atgatggaggacctgggcaggaaagaaaaccaggacaagaagcagcagaaggacccccggctgaccatggagatgaggcacaagcaggtgaaggagaaccggctgcggcgggagaaggagctggagtaccagagaattgagaagaccctgaagaagagcgccttcctggaggcccagtgcctggtgcaggaggagaagaagaggaaggccctggaggccaagaaggaggaggaggagatccagcgggagatggtgaagctgcggcgggagatcatcgagaggagaagaacagtgaaggccgcctggaagattgagaagaagaggcaggaggagaacagccagaacagcagcgagaaggtgatgttccagagcacccacatcctgcctgatgaggagaagatggtgaaggagaggaagaggaagctgaaggaggtgctgatccagaccttcaaggagaaccagcagtgccagaagcgctactttgctgcctggcacaagctgatcctggaccaccgcatcaagctgggcaaggccggcaccctgagtgactggaagatccagctgaaggtgctgcgggcctggagggactacacccgcttccagaagctggagcgggagacccaggccctggagaatgacctgcgggaggagaacaggaagcagcagctggccacagagtacaacaggaagcaggtgctgcggcactgcttcacagagtggcagcactggcacggggctgagctgctgaagcgggagctggccctgaccaaggaggagaccaggaagaagatggatgccctgctgcaggccgccagcctgggcaagctgagcgccaacggcctgagcggcatcagcctgcctgaggaggccacagccatggtgggcccccctgtgaagaatggccaggagacagctgtgccccccctgtgggagaagccacccctgggcagcagcggctgcatgctgagcccccccctgggccgcaccaccactggaaacctgcagggcagcctgcagaatgtgtccctgagcgcccctggcaacaagcagcacaagaccctgggcgctgagcccagccagcagcccggcagcaatgagaccctgcggaccaccagccagaaggccgagcccctgtgcctgggccacttccacaacagacatgtgttccagcagcagctgattgagaagcagaagaagaagctgcaggagcagcagaagaccatcctggagctgaagaagaacctgcagctggccgaggcccagtgggccgctgagcacgccctggccgtgacagaggcccagagccacctgctgagcaagccccgggaggaggagcccaggacctgccagatgctggtgaacagccctgtggccagccctggaacagagggccgcagtgacagcaggaacagcctgagcggcctgcggaggaagcccaagcagctgatgaccccccaccccatcctgaagggccgggctgtgtctgtggtggccctggtggtggtgatcttcagcccccgggtggagtgtgtgcactgggactag

SEQ ID NO: 41409 - DNA, 2283 bp, Artificial Sequence
  Description of Artificial Sequence: Synthetic coding sequence
atgggagaccccggcagcgagatcattgaatctgtgcccccagctggccctgaggccagcgagagcaccacagatgaaaatgaagatgacatccagtttgtgtccatcctcttccccaagatgcccaagaggcagggcgacttcctgcacttcctgaatgtgaagaaggtgaagacagacacagagaacaatgaggtgtccaagaaccactgccgcctgagcaaggccaaggagccccactttgagtacatcgagcagcccatcatcgaggagaagcccagcctgagcagcaagaaggagattgacaacctggtgctgcctgactgctggaatgagaagcaggccttcatgttcacagagcagtacaagtggctggagatcaaggagggcaagctgggctgcaaggactgcagcgctgtgcgccacctgggcagcaaggccgagaagcacgtgcacgtgtccaaggagtggatcgcctacctggtgaccccaaatggcagcaacaagaccacccggcaggccagcctgaggaagaagatccgggagcatgatgtgtccaaggcccacggcaagatccaggacctgctgaaggagagcaccaatgacagcatctgcaacctggtgcacaagcagaacaacaagaacattgatgccaccgtgaaggtgttcaacacagtgtacagcctggtgaagcacaaccggcccctgagtgacattgaaggagcccgggagctgcaggagaagaatggagaggtgaactgcctgaacacccgctacagcgccaccagaattgctgagcacatcgccaaggagatgaagatgaagatcttcaagaacatcattgaagaaaatgccaagatctgcatcatcattgatgaggccagcacagtgtccaagaagaccaccctggtgatctacctgcagtgcaccatccagagcgccccagcccctgtgatgctgtttgtggccctgaaggagctggtgtccaccatcgcagaatgtattgtgaacaccctgctgaccaccctgaatgactgtggcttcaccaatgagtacctgaaggccaacctgattgccttctgcagtgatggagccaacaccatcctgggcaggaagtctggagtggccaccaagctgctggagaacttccctgagatcatcatctggaactgcctgaaccaccggctgcagctgagcctggatgacagcatcagcgagatcaagcagatcaaccacctgaagatcttcatcgacaagatctacagcatctaccaccagcccaacaagaaccagaccaagctgctgggcaccgtggccaaggagctggagacagagatcatcaagattggccgggtgatgggcccccgctgggccgcctgcagcctgcaggccgccacagctgtgtggcacgcctaccccatcctgtacatgcacttcagccacagctacagcggcctggccaagaggctggccaacatcaacttcctgcaggacctggccctgatgattgacatcctggaggagttctctgtgctgagcacagccctgcagagccgcagcaccaacatcaagaaggcccagaagctgatcaagaggaccatccgggccctggagaacctgaagattggcaccgggaagtatgagagccagatcgaggacctgatcaagagtgacaagttcaaggacatccccttcaacaagaacaacaagttcaatgccctgcccaggagcatcctgctggacaacatcatccagcacatgaacctgcggctgctgagtgacagaaatcatgaggacatcttcaactactttgacctgctggagcccagcacctggccctatgaggagatcaccagcccctggattgctggggagaagaccctcttccacctgtgcaagatcctgaagtatgaggtggacctgaatgacttccgggagtttgtgaacaacaacatcaagagcaacaacgtgtccatccccaccaccatctacaaggccaagaagatcgtgtccaccatcgccatcaacagcgctgaggccgagcggggcttcaacctgatgaacatcatctgcaccagggtgaggaacagcctgaccatcgaccacgtgtctgacctgatgaccatcaacctgctgggcaaggagctggccgactgggatgccaccccatttgtgaagtcctggagcaactgcaaccaccggctggccacagacaccagggtgcggcagaagagcaccaaggtgttccacgagaaccagctggccatctggaacctgaagtag

SEQ ID NO: 41410 - DNA, 1230 bp, Artificial Sequence
  Description of Artificial Sequence: Synthetic coding sequence
atgaccctgagccggggcaaggtggactttgccaccatccagtgtggccagtgcctgatggagaccatccagctgagcaaccacctgcaggtgccctgtgagtggtttgtgcagagccagaagcctgtggacaagctggagaagcacatgcccaagtacctgcggcagaagctgcgggcagagctgaagcccaagacccgcatctttgagatccagcccatctctggagtgctggaccccggggagaagagcaatgtgcaggtgaagttcatgcccaaggaggagaagttctacagccagaccctggtgttccagatcgcccagagcgcccagaagctgaccctgctggcccggggccagggcctggagccccggctggagttcagccccagcgtgctggacctgggccccctgctgctgtgtgcccctggagatgaagctgaggtgattgtgaagaacccctgcaacttccccatcgagttctacagcctggagtttgaccagcagtacctgattgaggagaagatcctgaggaagctgaagggctatgacagctacaacaccctgctgctgccccccaggaaccctggagagaagctgcccccagagctgtatgagtacttcaaggagatcaagaagagcaaggaggagcagatgagggccaagtacctggagaacctggcccaggagaatgaggaggaggacatcaccagcagtgaccagggcaccagcaacagcaccaagaggaccagcctgagccggggcatctctgtgaccagcaacctggaggagtggcacgccctgctggtggagagcaagacctacctggaggaggaggaggatgaggagagcctggagaagatcatcttccagacagacaagctgcagagcattgacagccacagcatggaggaggtgggggaggtggagaacaaccctgtgtccaaggccatcgcccggcacctgggcatcgacatctctgctgagggccgcctggccaagaacagaaaaggaattgccatcatcatccacggcacccccctgagcggcaagagcgccaatgctgtgtctgtggccaagtactacaatgctgcctgcctgagcattgacagcatcgtgctggaggccgtggccaacagcaacaacatccctggcatccgggcctgtgagctgtgcatccgggccgccatcgagcagagcatgaaggagggggaggaggccgctgagtag

SEQ ID NO: 41411 - DNA, 375 bp, Artificial Sequence
  Description of Artificial Sequence: Synthetic coding sequence
atggctgtgtacacccacacaggctacaatgaccactacatgtacctgaaccacggccagcagaccatccccaacggcctgggcatgggcggccagcacaactacttcggcctgtgggtggatgtggactttgggaagggccacagccgggccaagcccacctgcaccacctacaacagcccccagctgagcgcccaggagaacttccagtttgacaagatggaggtgtgggccgtgggggaccccagcgaggagcagctggccaagggcaacaagagcatcctggatgctgaccctgaggcccaggccctgctggagatcagcggccacagccgccacagcgagggcctgcgggaggtgcctgatgatgaatag

SEQ ID NO: 41412 - DNA, 2607 bp, Artificial Sequence
  Description of Artificial Sequence: Synthetic coding sequence
atgggcatcacagagagcagtgacacccccagcagcctgagccccctgaacctgcctggagctggcagcgagatggaggagaaggtggcccctgtgaagcccagccggcccaagaggcacttcagcagcgctggcaccattgaatctgtgaacctggatgccatccccctggccatcgcccggctggacaacagcgctgccaagcacaagctggccgtgaagcccaagaagcagagggtgtccaagaagcaccggcggctggcccaggacccccagcacgagcagggcggcctggagagccggccctgcctggaccagaatggccaccctggagaggacaagcccacctggcatgaggaggagcccaaccccctggacagcgaggaggagcggcggcggcaggaggactactggagggagctggaggccaagtgcaagaggcagaaggccgaggccgctgagaagaggcggctggaggagcagaggctgcaggccctggagcggcggctgtgggaggagaacagacggcaggagctgctggaggaggagggggagggccaggagccccccctggaggccgagcgggccccccgggaggagcagcagaggagcctggaggcccctggctgggaggatgctgagcggcgggagcgggaggagcgggagcggctggaggccgaggaggagcggcggcggctgcaggcccaggcccaggccgaggagcggcggcggctggaggaggatgcccggctggaggagcggcggcggcaggaggaggaggagggccgctgtgccgaggagctgaagaggcaggaggaggaggaggccgagggctgggaggagctggagcagcaggaggccgaggtgcagggccccccagaggccctggaggagactggagagggcagaagaggagctgaggaggaggacctgggggaggaggaggaggagggccaggcccacctggaggactggaggggccagctgtctgagctgctgaatgactttgaggagcggctggaggaccaggagcggctgaagccagagggccagcgggagcacagcgaggagcccggcatctgtgaggagcagaaccctgaggccgagaggagaagagagcagcagggccgcagcggggacttccagggcgctgacaggcctggccctgaggagaagcgggaggagggggacacagagcccctgctgaagcaggagggccctgtggaggccgcccagccccctgtggagaggaaggaggccgccgccctggagcagggcaggaaggtggaggagctgcgctggcaggaggtggatgagcggcagaccatgccccggccctacaccttccaggtgtcctctgggggcaagcagatcctcttccccaaggtgaacctgagccctgtgaccccagccaaggacaccggcctgacagctgccccccaggagcccaaggcccccaaggccagccctgtgcagcacgccctgcccagcagcctgtctgtgccccacacagccatcctggtgactggagcccagctgtgtggccctgctgtgaacctgagccagatcaaggacacagcctgcaagagcctgctgggcctggaggagaagaagcacgccgaggccccagctggggagaaccccccccggggccctggagatgcccgggccggcagcggcaaggccaagccccggcaggagagccccagcagcgccagcgccctggccgagtgggccagcatccgcagccgcatcctgaagaatgctgagagtgaccccaggagcagcgagcgggaccagctgcggcctggagatgagagcaccccccggggccgctgtgacagccggggcaaccagaggaagaccccacctgtgaatgccaagttcagcatcatgcctgcctggcagaagttcagtgatggcggcacagagaccagcaagcagagcacagaggccgagagcatcaggaagaggcccatgctgggccccagcgaggagacagccccccagcccccacctgctggggtgcgggagctgggcaaaggacctgagaagtctgagatgcaccgggagcctgctgacaccacagagggctgcaagtttgccaaggacctgcccagcttcctggtgcccagcctgccctacccaccccagaaggtggtggcccacacagagttcaccaccagcagtgacagcgagacagccaacggcatcgccaagccagaccctgtgatgcctggaggagaggagaaggccagccccttcggcatcaagctgcggaggaccaactacagcctgcgcttcaactgtgaccagcaggccgagcagaagaagaagaagaggcacagcagcactggagacagcgcagatgctggccccccagctgctggcagcgcccggggggagaaggagatggagggcgtggccctgaagcacggccccagcctgccccaggagaggaagcaggcccccagcacccggcgggacagcgctgagcccagcagcagccgctctgtgcctgtggcccaccctggccccccaccagccagcagccagaccccaggcccccctgtgcggccccaccagcacccccacttccccaactag

SEQ ID NO: 41413 - DNA, 309 bp, Artificial Sequence
  Description of Artificial Sequence: Synthetic coding sequence
gtgctgctgtgctgccccggctggagcgctgtggtgcgctcctggctgacagccaccagcgcctcctggcagctggccggcatcaccggcatgtgccaccacgcccagctgatctttgtgttcttcattgaaacagagttccaccacgtgggccaggccggccctgagctgctgaccagcggggaccccagcgccagcgccagccagagcgctggcatcaccggggccagccacccccggcgggccaacttctgcatcttcggcagagatggagtgagcccctgctggccaggctggagcagcacctag

SEQ ID NO: 41414 - DNA, 396 bp, Artificial Sequence
  Description of Artificial Sequence: Synthetic coding sequence
tctgcctgcatgtgtgtgtgtgtgtgtgtgtgcatgtacatctacatctacatctacatcttcttcttcttcttcttcttcttcttcctgaacatcttcaagcaggccccaccccggcagaaccaggtgcggcggcctggagctgtggcccacacctgcaaccccagcacagtgggcggccatggaggccagatcacccggggccaggagtttgagaccagcctggccaacatgggagagacccccagcctgctgaagatccagacctggccaggagtggtggcccacgcctgcaaccccagctacagcggcggccgcctgcggcaggagaactgcctgaacctgggcggcggcggctgtggggagatcgccctgcagcccggccagcaggagtag

SEQ ID NO: 41415 - DNA, 309 bp, Artificial Sequence
  Description of Artificial Sequence: Synthetic coding sequence
gaggtgggccgctggctggagcccgggaagcagaggctgcagtgtgccgagatggcccccctgcacagcagcctgggggacaaggcccggccctgcctgaccaagaagaagaagatgctggacatgaaccccaccctggtgtgctaccggcagggcctggccctgctgccccggctgggctgcagcggggccatcctggcccactgcaacctgcggctgctgggcagcagtgacagccctgccagcgccagccgggtggccggcatcaccggggcccggcaccacgcccagctgatctttgtgttctag

SEQ ID NO: 41416 - DNA, 288 bp, Artificial Sequence
  Description of Artificial Sequence: Synthetic coding sequence
ttcttcttcttcctgcgctggagcctggccctgctgccccgggtggagtgcagcggcatgatcagcgcccactacaacctgcacctgcccggcagcagtgacagccctgccagcgccagccgggtggccggcaccaccggggtgcaccaccacgcctggctgatcttctgcatcttcagcagagatggagtgctgctgtgctgccccggctggagccccaccccaggcctgaagaggagcagctgcctgggcttcaggaagtgctgggactacagacatgagccctag

SEQ ID NO: 41417 - DNA, 345 bp, Artificial Sequence
  Description of Artificial Sequence: Synthetic coding sequence
tggtgcacccccctcatcccagccacagaggtggagaccggccgctgggtggagcccaggagcagccggctgggcttcttcctggtggagctgctgagctttgacctgggcaacagagcccggctgcacctgaagaagaagaagaagaagaagagcctgggcaagatctacttcttcctgcgctggagcctggccctgctgccccggctgggctgcagcggggccatcagcgcccactgcaagctgcacctgctgggcagccaccacagccctgccagcgccagccgggtggccggcatcactggagcccggcaccacaccaggctcatcttcttcttcctgtag

SEQ ID NO: 41418 - DNA, 396 bp, Artificial Sequence
  Description of Artificial Sequence: Synthetic coding sequence
tctgcctgcatgtgtgtgtgtgtgtgtgtgtgcatctacatctacatctacatctacatcttcttcttcttcttctttgagttcctgaccaagctgatcaagcagctggtgatgatcaagaaccaggtgcggcggcctggagctgtggcccacacctgcaatgccagcacagtgggcggccatggaggccagatcacccggggccaggagtttgagaccagcctggccaacatgggagagacccccagcctgctgaagatccagacctggccaggagtggtggcccacgcctgcaaccccagctacagcggcggccgcctgcggcaggagaactgcctgaacctgggcggcggcggctgtggggagatcgccctgcagcccggccagcaggagtag

SEQ ID NO: 41419 - DNA, 384 bp, Artificial Sequence
  Description of Artificial Sequence: Synthetic coding sequence
atcctggcccactgcaacctgcacctgcccaacagcagtgacagccctgccagcgccagccaggtggccggcatcaccggcacctgctaccacacccagctgatctttgtgttcctggtggagaccggcttccaccacgtgggccaggacggcctggagctgctgaccagcggggacctgcctgccagcgccagccagagcgctggcatcactggagtgacccactgtgcccagcccagcagcctgctgaccagcgagggcaggaaggagaccgtgtccaccttcttcttcttcttcctgcatgaaacagtgagccacagcgtggcccaggcccgggtgcagtggcacaacctgagcagcctgcagcccccacccagcaggtag

SEQ ID NO: 41420 - DNA, 288 bp, Artificial Sequence; identical to SEQ ID NO: 41416
  Description of Artificial Sequence: Synthetic coding sequence

SEQ ID NO: 41421 - DNA, 96 bp, Artificial Sequence
  Description of Artificial Sequence: Synthetic coding sequence
gccaagccccggctgcaccagcccggccagagcggggagacccccagcctgctgaagatccagaagctggccaggagaggaggagtgcacctgtag

SEQ ID NO: 41422 - DNA, 264 bp, Artificial Sequence
  Description of Artificial Sequence: Synthetic coding sequence
tctgtggcccaggccggcgtgcagtggcacaacctgggcagcctgcagcccccaccaccccgcttcaaccgcttcagctgcctgagcatccccagctcctgggactaccgccacagcccccccctgctggccgacttctgcatctacctggtggagaccggcttccaccacgtgggccaggccggcctggagctgctgaccagcagtgacctgcccaccagcgccagccagagcgcccgcatcaccggggtgagccacaggtag

SEQ ID NO: 41423 - DNA, 195 bp, Artificial Sequence
  Description of Artificial Sequence: Synthetic coding sequence
ccccggcgctggagcctgcaggtgtaccccacagcccccaagaggcagaggcccagcaggatgggccatgatgacaatggcagctttgtggagaagaagagaggaaaatgtggggagaagaaggagaggagtgactgctactacgtgtgtgtggagaggagccgccaccggcggctgcactttgtgctgtactag

SEQ ID NO: 41424 - DNA, 456 bp, Artificial Sequence
  Description of Artificial Sequence: Synthetic coding sequence
cgcttctacatcggctgtgacctgtgcaccaactgctactacggggagtgtgtgggcattgctgagaaggaggccaagaagatggatgtgtacatctgcaatgactgcaagtgggcccaggagggcagcagcgaggagctgtactgcatctgcaggaccccagctggcagctgccgcttcttcatcggccatgaccgctgccagaactggtaccacggctgctgcatcggcatcctgcagagcgaggccgagctgattgatgaatatgtgtgcccccagtgccagagcacagaagatgccatggctgtgctgacccccctgacagagaaggatgatgaggagctgaagagggtgctgtgcagcctgcagacccacaagatggcccagcccttcctggagcctgtggaccccaatgatgccccagactactacggcgtcatcaaggagcccatgtag

SEQ ID NO: 41425 - DNA, 411 bp, Artificial Sequence
  Description of Artificial Sequence: Synthetic coding sequence
ggcaccatcagcgcccactgcaacctgtgcctgctggacagcagtgacagccctgccagcgccagccgggtggccggcatcatcggggcccaccaccacgcccagctgatctttgtgttcctggtggagatgggcttccaccacgtgggccaggccggcctgaagctgctgaccagtgaccccccagccagcgccagccagagcgctggcatcaccggggtgagccaccacaactggctgcatggaggccctgacagagtgaagaggcctcctgtgttcttcttctggttcttcttctttgagatggagagctacagcgtggcccaggccggcgtgcagtggagggacctgagcagcctgcagcccccaccacccaggcacaccatcctgctgccccagcccccagagtag

SEQ ID NO: 41426 - DNA, 279 bp, Artificial Sequence
  Description of Artificial Sequence: Synthetic coding sequence
ctgaccccagatggcttcttcttccgggtgcacatgctggtgctggacagcagcagctgcaacaagccctgcccagagttcaagccaggcagccgctacatcgtgatgggccacatctaccacaagaggggccagctgcccacagccctgctgcaggtgctgcggggccacctgtgccctggagatggcctgctgcggagcagcagcagctatgtgaagcgcttcaaccccaagcgggagggccagatccagggcgccatccacacccagtgcatctag

SEQ ID NO: 41427 - DNA, 378 bp, Artificial Sequence
  Description of Artificial Sequence: Synthetic coding sequence
tccttcttcttcttcctgcggcagagcctgagcctgagcgcccggctggagtgcagcggcaccatcagcgcccactgcaagctgcggctgctgggcagccaccacagccctgcctctgtgagccgcatcaccaggtctggagtgcaggaccagaggggccagcacagcgagaccctgagcctgctgaagatccagaagctggccggccacggcggccgccacctgcagagccagctgctgggccgggtgcggcaggagaaccggctgaaccctgggggcaagggctgcagcgagccccggccctgccactgcaccagcgcctggaccaccagcaggaagatcaagaagaagaagaggaagaggaagaagaagaagtag

SEQ ID NO: 41428 - DNA, 399 bp, Artificial Sequence
  Description of Artificial Sequence: Synthetic coding sequence
tgcatgtgtgtgtgtgtgtgtgtgtgcatctacatctacatctacatctacatcagccagcccatctacatcttcctgctgctgctgctgctgctcttcctgcggcagagcctgatgatcaagaaccaggtgagaagacctggagctgtggcccacacctgcaaccccagcacagtgggcggccacggcggccagatcacccggggccaggagtttgagaccagcctggccaacatgggagagacccccagcctgctgaagatccagacctggccaggagtggtggcccacgcctgcaaccccagctacagcggcggccgcctgcggcaggagaactgcctgaacctgggcggcggcggctgtggggagatcgccctgcagcccggccagcaggagtag

SEQ ID NO: 41429 - DNA, 111 bp, Artificial Sequence
  Description of Artificial Sequence: Synthetic coding sequence
ggcagagatgactggcaggccgcccctcctgctgcccctgtgcgggaccccctgggggaggcctcctgggccccagaatgtggcggggacctggagaacctgtatgtgtag

SEQ ID NO: 41430 - DNA, 321 bp, Artificial Sequence
  Description of Artificial Sequence: Synthetic coding sequence
ttcttcctgtccttcctgcacagcttcttcctgcggcagagctttgccctggtggcccaggccggcgtgcagtggcacaacctgggcagcctgcagcccccacctcctggcttcaagcagttcagctgcctgagcctgctgagctcctgggactaccgccacgtgcccccctgcccagccaactttgtgttcctggtggagatgggcttcctgcacgtgggccaggccggcctggagctgcggaccagcggggacccccccaccctggccagccagagcgctggcatcactggagtgagccaccgggcccagcccagctag

SEQ ID NO: 41431 - DNA, 276 bp, Artificial Sequence
  Description of Artificial Sequence: Synthetic coding sequence
ttcttcctgcgctggagcctgaccctgagcagccggctggagtgcagcggggccaccagcgcccactgcaatgtgcggctgcccggcagccgccacagccccaccagcgccagccgggtggccggcaccaccggggcccggcacctgagccgcctcatcttcatcttcagcagagatggagtgagcccctggagccgcagcccagacctggccatccggccccccaggcctcccaagaagctgggcctgcaggccccagccaccatgcctggatag

SEQ ID NO: 41432 - DNA, 381 bp, Artificial Sequence
  Description of Artificial Sequence: Synthetic coding sequence
cgccaccaggcccagctgatcttcctgtatgacctcttcctgtatgtgtacttcctgaaggacagagtgctgctgtgccaccctggctggagcgccatgaccaggagccggctgacagccaccagcgccagccaggtggccggcaccatcggcatgtgccaccacgcccggctcatcttcttcttcttctttgtgttcctggtggagaccggcttccactgtgtgtcccagcacggcctggagctgctgaccctggaccccccagccagcgccagccagagcgcccgcatcatcggcctgaaccactgcacccagcccaccttctgcatcttcagcagagatggagacagcccctgctggccagactggagcaggacatag

SEQ ID NO: 41433 - DNA, 327 bp, Artificial Sequence
  Description of Artificial Sequence: Synthetic coding sequence
cagatcaagagcaagttcttcttcttcctgcggcgcagcctggccctgagcccccggctggagtgcagcggcggcatcagcgcccactgcaagctgcggctgcccggcagccgccacagccctgccagcgccagccaggtggccggcaccactggagcccggcactacgcccggctcatcttcctgttcctgattgaaacaggcttccactacgtgggccaggccggcctggagctgctgaccagcggggacctgcccaccagcgccagccagagcgctggcatcaccggggtgagccactgcacccagcctgaggacatcttctag

SEQ ID NO: 41434 - DNA, 369 bp, Artificial Sequence
  Description of Artificial Sequence: Synthetic coding sequence
tgggactacagcttcttcttcttcctgcggcagagccacagcgtgccccaggccggcgtgcagtggtgcaacctgagcagcctgcagcccccacccagccgcttcaagcgcttcagctgcctgagcctgctgagctcctgggactaccgccacaccccaccctgcccagccaacttctgcatcttccgcaccttcttcttcttcctgcgctggagctttgccctgagcccccggctggagtgcagcggggccatcctggtgcactgcaacctgtgcctgcccggcagcagtgacagctgcctgagcctgcccatctcctgggactaccgctgtgccccaccctgcctggccaacttctgcatcttctag

SEQ ID NO: 41435 - DNA, 372 bp, Artificial Sequence
  Description of Artificial Sequence: Synthetic coding sequence
tgggactacagcttcttcttcttcctgcggcagagccacagcgtgccccaggccggcgtgcagtggtgcaacctgagcagcctgcagcccccacccagccgcttcaagcgcttcagctgcctgagcctgctgagctcctgggactaccgccacaccccaccctgcccagccaacttcctgtacacctttgagctgttcttcttcttcctgcgctggagctttgccctgagcccccggctggagtgcagcggggccatcctggtgcactgcaacctgtgcctgcccggcagcagtgacagctgcctgagcctgcccatctcctgggactaccgctgtgccccaccctgcctggccaacttctgcatcttctag

SEQ ID NO: 41436 - DNA, 372 bp, Artificial Sequence; identical to SEQ ID NO: 41435
  Description of Artificial Sequence: Synthetic coding sequence

SEQ ID NO: 41437 - DNA, 81 bp, Artificial Sequence
  Description of Artificial Sequence: Synthetic coding sequence
ttcctgatggacaagagcagcctgactggagccctgtgcagcatcaccctggccagcccctgtggcaccccaggcatctag

SEQ ID NO: 41438 - DNA, 318 bp, Artificial Sequence
  Description of Artificial Sequence: Synthetic coding sequence
gagaccggccgctgggtggagcccaggagcagccggctgggcttcttcctggtggagctgctgagctttgacctgggcaacagagcccggctgcacctgaagaagaagaagaagaagaagatccctgggaagcactgtgtgtgcttcatgcgctggagcctggccctgctgccccggctgggctgcagcggggccatcagcgcccactgcaagctgcacctgctgggcagccaccacagccctgccagcgccagccgggtggccggcatcactggagcccggcaccacaccaggctcatcttcttcttctttgtgtag

SEQ ID NO: 41439 - DNA, 228 bp, Artificial Sequence
  Description of Artificial Sequence: Synthetic coding sequence
tgcttcagccacagcttcttcttcttcttcttcttcctgcgctggagcctggccctgagcccccggctggagtgcagcggggccatcagcgcccactgcaagctgcggctgctgggcagccgccacagccctgccagcgccagccgggtggccggcaccaccggggcctgccaccacgcccggctcttcttctgcatcttcagcagagatggagtgagcccctgctag

SEQ ID NO: 41440 - DNA, 324 bp, Artificial Sequence
  Description of Artificial Sequence: Synthetic coding sequence
gtgctgaatggagcccaggccggcgtgcagtggagggacctgggcagcctgcagcccccaccacccagccacctgccccggcccagcaaggtgccccgggtgcagcccctgcccggccgccaccctgtgtgggaggtgcggggcgtgtctgcctggccacccatcgtgtgggatgtgcgcagccccagcgcctggctgcccagcctggagagcgaggagcggctgtgcccagctgccatccccagcaggaagtggggcgcccctgtgccccggcggcccatctgggatgtgcgctctgtgtctgcccagcccccccggctgtag

SEQ ID NO: 41441 - DNA, 288 bp, Artificial Sequence; identical to SEQ ID NO: 41416
  Description of Artificial Sequence: Synthetic coding sequence

SEQ ID NO: 41442 - DNA, 399 bp, Artificial Sequence
  Description of Artificial Sequence: Synthetic coding sequence
tgcatgtgtgtgtgtgtgtgtgtgtgcatgtacatctacatctacatctacatcagccagcccatctacatcttcctgctgctgctgctgctgctcttcctgcggcagagcctgatgatcaagaaccaggtgagaagacctggagctgtggcccacacctgcaaccccagcacagtgggcggccacggcggccagatcacccggggccaggagtttgagaccagcctggccaacatgggagagacccccagcctgctgaagatccagacctggccaggagtggtggcccacgcctgcaaccccagctacagcggcggccgcctgcggcaggagaactgcctgaacctgggcggcggcggctgtggggagatcgccctgcagcccggccagcaggagtag

SEQ ID NO: 41443 - DNA, 282 bp, Artificial Sequence
  Description of Artificial Sequence: Synthetic coding sequence
tctgtggcccaggccggcgtgcagtggcacaacctgggcagcctgcagcccccaccaccccgcttcaaccgcttcagctgcctgagcatccccagctcctgggactaccgccacagccccccccggctggccgacttcctgttcctggtggagacagagttctgccacgtgggccaggccgccctggagctgctgaccagcggggacctgcccaccagcgccagccagagcgcccgcatcactggagtgagccacaggacccggcccagcctcttctactag

SEQ ID NO: 41444 - DNA, 423 bp, Artificial Sequence
  Description of Artificial Sequence: Synthetic coding sequence
ggcaccatcagcgcccactgcaacctgtgcctgctggacagcagtgacagccctgccagcgccagccgggtggccggcatcatcggggcccaccaccacgcccagctgatctttgtgttcctggtggagatgggcttccaccacgtgggccaggccggcctgaagctgctgaccagtgacccccctgtgtctgccagccagagcgctggcatcaccggggtgagccaccaccgggagccccagcaccccttcctgctgtctgtggagagccgggaccggcccttcttcttcttcggcttcttcttctttgagatggagagctacagcgtggcccaggccggcgtgcagtggagggacctgagcagcctgcagcccccaccaccccgggcccaggccatcctgcccccccagccccccaagtag

SEQ ID NO: 41445 - DNA, 396 bp, Artificial Sequence
  Description of Artificial Sequence: Synthetic coding sequence
tgcaacctgtgcctgctgggcagcagtgacagccctgccagcgccagccagattgctggcatcaccggggcccaccaccacacctggctgttcagcgtcttcctggtggagagcggcttccaccacgtgggccaggccggcctggagctgctgaccagcggggaccctgccagcgccagccacagcgctggcatcaccggggtgagccactgtgcctggccccggctggaggccacctctgtgcccaacttcttcttcttcttcttcttcttcttcttcttcctgcggcgcagcctggccgtggcccaggccggcgtgcagtggaggaacctgggcagcctgcaggcccctcctcctggggtgcacgccatcctgctgccccagcccccagagtag

SEQ ID NO: 41446 - DNA, 153 bp, Artificial Sequence
  Description of Artificial Sequence: Synthetic coding sequence
cccagcttcctgctcttcttcctgcccagcttcctgcccttcagcctgagcagcctgtccttcctgcccttcctgctgtccttcctgaccggcagccacctgttcagcatcacccacacccacacccacacccacacccacacccacacctag

SEQ ID NO: 41447 - DNA, 423 bp, Artificial Sequence; identical to SEQ ID NO: 41444
  Description of Artificial Sequence: Synthetic coding sequence

SEQ ID NO: 41448 - DNA, 396 bp, Artificial Sequence; identical to SEQ ID NO: 41445
  Description of Artificial Sequence: Synthetic coding sequence

SEQ ID NO: 41449 - DNA, 279 bp, Artificial Sequence
  Description of Artificial Sequence: Synthetic coding sequence
ttcttcttcttcttctttgaaacagactgccgctctgtgacccggctggagtgcagcggcatcatcagcgcccactgcaagctgtgcctgcccggcagcagtgacagccctgccagcgccagccaggccgcccggaccatcggcacctgccaccacacccagctgatctttgtgttctttgtggagaccggcttccaccacgtgggccaggacggcctgaacctgagcctggtgatccaccccccccggccccccaaggtgctgggcctgcaggtgtag

SEQ ID NO: 41450 - DNA, 228 bp, Artificial Sequence; identical to SEQ ID NO: 41439
  Description of Artificial Sequence: Synthetic coding sequence

SEQ ID NO: 41451 - DNA, 177 bp, Artificial Sequence
  Description of Artificial Sequence: Synthetic coding sequence
cctggaggagctgctgctgctgcctctgtgatggccccccggcgcagccgctgcttctgcaccagcatctgtggcggccgcggggcccggccccagctgcccaggacctgtggagatggcacccagcactgcggccggggcaagccagccctggccgctgctgaggagtggccctag

SEQ ID NO: 41452 - DNA, 372 bp, Artificial Sequence
  Description of Artificial Sequence: Synthetic coding sequence
gtgtgtgtgtgtgtgtgtgtgtgtgtgtgtgtgtgcctcttcatctacttcagcgtcttctggagcttcctgtacctgtttgtgttcctgctgaagatctatgagaagaggccctgtgctgtggcccacgcctgcaaccccccaggagtggtggcccacgcctgcaaccccagcaccctgggcggccggggcggccagatctcctggagccaggagtttgagaccagcctggccaacatgagcaagacccccagcaggaagaagaggaagggctggagcggcgtggtggcccacgcctgcaaccacagctacagcggcctgcggcaggagaactgcctgaaccctgtgggcggcggctgtgtgcagccctag

SEQ ID NO: 41453 - DNA, 288 bp, Artificial Sequence; identical to SEQ ID NO: 41416
  Description of Artificial Sequence: Synthetic coding sequence

SEQ ID NO: 41454 - DNA, 261 bp, Artificial Sequence
  Description of Artificial Sequence: Synthetic coding sequence
ggcaccatcagcgcccactgcaacctgtgcctgctgggcagcagtgacagccctgccagcgccagccaggtggccgccggcatcactggagcctgccacctggcccagctgatcttcatcttcctgattgaaacaggcttccaccacgctgtgcaggccggcctgaagctgctgaccctgagtgacctgcctgccagcgccagccagagcgtgggcatcaccggggccagccacagagctgaccccaaggtgttcctgtag

SEQ ID NO: 41455 - DNA, 66 bp, Artificial Sequence
  Description of Artificial Sequence: Synthetic coding sequence
aacaggaagaaggagggcaagaagaaccagagccccccacccaccgtgagccccctggccacctag

SEQ ID NO: 41456 - DNA, 303 bp, Artificial Sequence
  Description of Artificial Sequence: Synthetic coding sequence
ttcctgcggcgcagcctggccctgagcccccggcagtggcatgacctgggcagcctgcagcccccacctcctggcttcaagcccttcagctgcctgagcctgctgagctcctgggactaccgctgtgccccaccctgcccagccaacttctgcatcctggtggagatgggcttccaccacgtgggccaggccggcctggagctgctgaccagtgacctgcccaccagcgccagccagagagctggcatcaccggggtgaaccaccacgcctggcccagagatgccttcagcatctcctactag

SEQ ID NO: 41457 - DNA, 282 bp, Artificial Sequence
  Description of Artificial Sequence: Synthetic coding sequence
tctgtggcccaggccggcgtgcagtggcacaacctgggcagcctgcagcccccaccaccccgcttcaaccgcttcagctgcctgagcatccccagctcctgggactaccgccacagcccccccctgctggccgacttcctgttcctggtggagacagagttctgccacgtgggccaggccgccctggagctgctgaccagcggggacctgcccaccagcgccagccagagcgcccgcatcactggagtgagccacaggacccggcccagcctcttctactag

SEQ ID NO: 41458 - DNA, 111 bp, Artificial Sequence
  Description of Artificial Sequence: Synthetic coding sequence
aagaggaagaagaaggagaggaagaaggagaggaagaagaaggagaggaagaaggagaggaagaaggagaggaagaaggagaaggagaggaagaaggagaaggagaggtag

SEQ ID NO: 41459 - DNA, 234 bp, Artificial Sequence
  Description of Artificial Sequence: Synthetic coding sequence
atcaactgctacagcttctacagcctcttcctgtttgtgtgcatcacagatggagtgtccctgagccccaggcctgagtgcagcggggccatcagcgcccactgccgcctgcggccccggggcagccgccacagccctgccagcgccagccgggtggccggcaccaccggggcccggcacctggcccagctgatcttctgcatcttcagcagagatggagtgtccctgtgctag

SEQ ID NO: 41460 - DNA, 222 bp, Artificial Sequence
  Description of Artificial Sequence: Synthetic coding sequence
agaagagagcggcccctgcctgagccccacagccagttcttcttcttcttcttcttctactacaccctgtccttccgggtgcacgtgcacatcgtgcaggtgtcctacatctgcatccacgtgccctgctggtgtgccgcccccaccaacgtgagcagcagcatccgctacatcagccagtgctaccccagccccctgccccggccccaccacagcccctag

SEQ ID NO: 41461 - DNA, 123 bp, Artificial Sequence
  Description of Artificial Sequence: Synthetic coding sequence
agccccccacctcctgggggcggggagaagcccctggcccctcctcctggctgggtggagccccccaagtggctgggcctgcagggccccagcggcggccctggggccggccctggcctgtag

SEQ ID NO: 41462 - DNA, 318 bp, Artificial Sequence
  Description of Artificial Sequence: Synthetic coding sequence
tacttctacttcctgcggcagagcctgaccctgagcccccggctggagtgcagcggcaccatcagcgcccactgcaacctgtgcctgcccggcagcagcaacagccctgccagcgccagccaggtggccggcatcaccggggtgtgccaccacacccagctgatctttgtgttcctggtggagatgggcttctgccacgtgggccaggccggcctggagctgctgaccagcggcaaccccccagccctggccttccagagcgctggcatcaccggcatgagccaccacgcctggccaggccacatgttcttcaagtag

SEQ ID NO: 41463 - DNA, 216 bp, Artificial Sequence; identical to SEQ ID NO: 39086
  Description of Artificial Sequence: Synthetic coding sequence

SEQ ID NO: 41464 - DNA, 168 bp, Artificial Sequence
  Description of Artificial Sequence: Synthetic coding sequence
gtcatcggctgggtgtggtggctgacccctgtgatcccagccctgtgggaggccgaggccggcggcagccctgagatccgcagcagcaggcctgcctggcccacctggggcaaccccagcctgctgaagatccagaagctggccaggagaggaggagcccacctgtag

SEQ ID NO: 41465 - DNA, 366 bp, Artificial Sequence
  Description of Artificial Sequence: Synthetic coding sequence
ctgcccccagctgacctcttcatcttcatcttcatcgacaaggtgtccctgctgagcccccggctggagtgcaatggcaccatcagcgcccactacaagctgcacctgcccttcaagcgcttcagctgcctgagcctgctgaagacaggcttccaccacgtgggccagctgatctttgtgttcctggtggagatggccttccaccacgtgggccaggccggcctggagctgctgaccagcggggacctgtttgaggtggagttccacagctgctgcctgggctggagcgccatggcccggagccggctgacagccaccagcgccagccgggtgcaggccatcctgctgccccagcccccagagtag

SEQ ID NO: 41466 - DNA, 420 bp, Artificial Sequence
  Description of Artificial Sequence: Synthetic coding sequence
atctgccaccacacccagctgatctttgtgttcctgggcttctacctgttcatctacctgttcattgatggagtgctgctgtgctgccccggctggagcgctgtggtgcagagctggctgacagccaccagcgccagccaggtggccggcatcaccggcatgcaccaccacgcccagctgatctttgtgttcctggtggagatgggcttccaccacgtgggccaggccggcctggagctgctgaccagcggggaccccccagccagcgccagccagagcacaggcatcactggagtgagccactgcacccggcccaacttctgcatcttcagcagagatggagtgagcccctgctggccaggctggagcaggaccccagacctggtgatcagcgcccacctgggcctgcccaagtgctag

SEQ ID NO: 41467 - DNA, 228 bp, Artificial Sequence; identical to SEQ ID NO: 41439
  Description of Artificial Sequence: Synthetic coding sequence

SEQ ID NO: 41468 - DNA, 303 bp, Artificial Sequence
  Description of Artificial Sequence: Synthetic coding sequence
ttcctgcggcgcagcctggccctgagcccccggcagtggcatgacctgggcagcctgcagcccccagcccctggcttcaagcccttcagctgcctgagcctgctgagctcctgggactaccgctgtgccccaccctgcccagccaacttctgcatcctggtggagatgggcttccaccacgtgggccaggccggcctggagctgctgaccagtgacctgcctgccagcgccagccagagagctggcatcaccggggtgaaccaccacgcctggcccagagatgccttcagcatctcctactag

SEQ ID NO: 41469 - DNA, 1251 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagtgagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 41470 - DNA, 372 bp, Artificial Sequence; identical to SEQ ID NO: 41435
  Description of Artificial Sequence: Synthetic coding sequence

SEQ ID NO: 41471 - DNA, 309 bp, Artificial Sequence
  Description of Artificial Sequence: Synthetic coding sequence
gtgctgctgtgctgccccggctggagcgctgtggtgcgctcctggctgacagccaccagcgcctcctggcagctggccggcatcactggagtgtgccaccacgcccagctgatctttgtgttcttcattgaaacagagttccaccacgtgggccaggccggccctgagctgctgaccagcggggaccccagcgccagcgccagccagagcgctggcatcaccggggccagccacccccggcgggccaacttctgcatcttcggcagagatggagtgagcccctgctggccaggctggagcagcacctag

SEQ ID NO: 41472 - DNA, 381 bp, Artificial Sequence
  Description of Artificial Sequence: Synthetic coding sequence
cgccaccaggcccagctgatcttcctgtatgacctcttcctgtatgtgtacttcctgaaggacagagtgctgctgtgccaccctggctggagcgccatgaccaggagccggctgacagccaccagcgccagccaggtggccggcaccatcggcatgtgccaccacgcccggctcatcttcttcttcttctttgtgttcctggtggagatgggcttccactgtgtgtcccagcacggcctggagctgctgaccctggaccccccagccagcgccagccagagcgcccgcatcatcggcctgaaccactgcacccagcccaccttctgcatcttcagcagagatggagacagcccctgctggccagactggagcaggacatag

SEQ ID NO: 41473 - DNA, 153 bp, Artificial Sequence
  Description of Artificial Sequence: Synthetic coding sequence
cccagcttcctgctcttcttcctgcccagcttcctgcccttcagcctgagcagcctgtccttcctgcccttcctgctgtccttcctgaccggcagctttggccaggacaaggtgttcagcatcacccacacccacacccacacccacacctag

SEQ ID NO: 41474 - DNA, 372 bp, Artificial Sequence
  Description of Artificial Sequence: Synthetic coding sequence
tgtgtgtgtgtgtgtgtgtgtgtgtgtgtgtgcctcttcatctacttctctgtgttctggagcttcctgtacctgtttgtgttcctgctgaagatctatgagaagaggccctgtgctgtggcccacgcctgcaaccccccaggagtggtggcccacgcctgcaaccccagcaccctgggcggccggggcggccagatctcctggagccaggagtttgagaccagcctggccaacatgagcaagacccccagcaggaagaagaggaagggctggagcggcgtggtggcccacgcctgcaaccacagctacagcggcctgcggcaggagaactgcctgaaccctgtgggcggcggctgtgtgcagcccaggtag

SEQ ID NO: 41475 - DNA, 279 bp, Artificial Sequence; identical to SEQ ID NO: 41449
  Description of Artificial Sequence: Synthetic coding sequence

SEQ ID NO: 41476 - DNA, 384 bp, Artificial Sequence
  Description of Artificial Sequence: Synthetic coding sequence
atcttcttcttcctgcggcagggcctgctgctgagcccccggctgctggagtgcaatggcaccatcagcacccactgcaacctgcacatccctggcagcagtgacagccctgccagcgccagccaggtggccggcatctaccgcagccgggaccagcctgaccagcacggggagacccccagcctgctgaagatccagaagctggtgggccggggcggcttccacttcttcagccagctgctgggccggccccggcaggagaatggagtgaaccctgggggccgggcctgcagcgagctgcggctgcggcactgcaccccagcctgggccacagaggcccggctgtgcctgaagaagaagaagaagaagaagaagaagaagtag

SEQ ID NO: 41477 - DNA, 312 bp, Artificial Sequence
  Description of Artificial Sequence: Synthetic coding sequence
ttcttcttcttcctgcggcgcagcctggccctgagcccccggctggagtgcagcggcggcatcagcgcccactgcaagctgcggctgctgggcagccgccacagccctgccagcgccagccaggtggccggcaccaccggggcccggcactacgcccggctcatcttcctgttcctgattgagaccggcttccactacgtgggccaggccggcctggagctgctgaccagcggggacctgcccaccagcgccagccagagcgctggcatcactggagtgagccactgcacccagcctgaggacatcttctag

SEQ ID NO: 41478 - DNA, 243 bp, Artificial Sequence
  Description of Artificial Sequence: Synthetic coding sequence
gcccaccacctgcggagcggggccggggaccagcccggccagcacggggagacccccagcctgctgaagattgagaagctggccgagcacggcggcagctgcttctccttccaggtgctgggccgcctgcggcaggagaactgcctgaaccctgggggcggcggctgcagcgagccccggctgtgccactgcaccccagcctgggccacagagcagggctctgtgtccaggaagaaggagtag

SEQ ID NO: 41479 - DNA, 420 bp, Artificial Sequence; identical to SEQ ID NO: 41466
  Description of Artificial Sequence: Synthetic coding sequence

SEQ ID NO: 41480 - DNA, 318 bp, Artificial Sequence
  Description of Artificial Sequence: Synthetic coding sequence
tacttctacttcctgcggcagagcctgaccctgagcccccggctggagtgcagcggcatgatcagcgcccactgcaacctgtgcctgcccggcagcagcaacagccctgccagcgccagccaggtggccggcatcaccggggtgtgccaccacacccagctgatctttgtgttcctggtggagatgggcttctgccacgtgggccaggccagcctggagctgctgaccagcggcaaccccccagccctggccttccagagcgctggcatcaccggcatgagccaccacgcctggccaggccacatgttcttcaagtag

SEQ ID NO: 41481 - DNA, 462 bp, Artificial Sequence
  Description of Artificial Sequence: Synthetic coding sequence
gtgcggggggccagcgcccggccccccctgctgggcagcgaggagcccctgagccctgccagcaggcctgtgcgggagggcggcggcggcgtgtccccacctcctggccagcccccctgccctgggggccgctggggcggccagcccagcgcccggcctgctgcccccagcggccgggaggtgggcgtgtctgcccccaggcctgccagcaggcctgtgcgggaggtgcggggggccagcgcccggccccccctgctgggcagcgaggagcccctgtgcccagccagcaggcctgtgcgggagggcggcggcggcgtgagccccccacctggccagccccccaggcctgggggccgcggggccagcgcccggccccccctgctgggcagcgaggagcccctgtgtgccgccaccaccccatctggccgctgtgcccagcagctgattgaaaatggcccctag

SEQ ID NO: 41482 - DNA, 348 bp, Artificial Sequence
  Description of Artificial Sequence: Synthetic coding sequence
atgaatgtgtgctgcagcagccaccctgtgaatgagaaggtgtggaagcccagcagcaggaagtggagcagcaaggtgtggagcatggatgaatttgacctgcagacagcctgctactggttcatgacccgctgccagaaggaggccggcaagtttggcacccaccggggcaagcccatgtgctttgtgcgcagcctgctgcgggtgcagctgctgcccaggaccttccctgccaacagctttgtgatctccttcttccccagcctcatctaccccctgcaggtgtaccagctgcactttgagagcagtgacaagcagagggccatgcagtttgtgacagagggctag

SEQ ID NO: 41483 - DNA, 318 bp, Artificial Sequence; identical to SEQ ID NO: 41462
  Description of Artificial Sequence: Synthetic coding sequence

SEQ ID NO: 41484 - DNA, 111 bp, Artificial Sequence; identical to SEQ ID NO: 41458
  Description of Artificial Sequence: Synthetic coding sequence

SEQ ID NO: 41485 - DNA, 420 bp, Artificial Sequence; identical to SEQ ID NO: 41466
  Description of Artificial Sequence: Synthetic coding sequence

SEQ ID NO: 41486 - DNA, 111 bp, Artificial Sequence; identical to SEQ ID NO: 41458
  Description of Artificial Sequence: Synthetic coding sequence

SEQ ID NO: 41487 - DNA, 108 bp, Artificial Sequence
  Description of Artificial Sequence: Synthetic coding sequence
agccccaacaagctgctgtttgacccccgggtgggcggccgggtgagccacgtgttcttcctgtttcctccatttgtgctgctgcccggccccccaggcctgccctag

SEQ ID NO: 41488 - DNA, 303 bp, Artificial Sequence; identical to SEQ ID NO: 41468
  Description of Artificial Sequence: Synthetic coding sequence

SEQ ID NO: 41489 - DNA, 399 bp, Artificial Sequence; identical to SEQ ID NO: 41428
  Description of Artificial Sequence: Synthetic coding sequence

SEQ ID NO: 41490 - DNA, 111 bp, Artificial Sequence; identical to SEQ ID NO: 41429
  Description of Artificial Sequence: Synthetic coding sequence

SEQ ID NO: 41491 - DNA, 228 bp, Artificial Sequence; identical to SEQ ID NO: 41439
  Description of Artificial Sequence: Synthetic coding sequence

SEQ ID NO: 41492 - DNA, 336 bp, Artificial Sequence
  Description of Artificial Sequence: Synthetic coding sequence
ttcttcttcttcttcttcctgcggcacaccctggccctgctgccccggctggagtgcagcggggccatcctggcccactgcaacatccccctgagcagcagcagcaacagccctgccagcgccagccaggtggccggcatcaccggggtgtgccaccacgcccagctgatctttgtgttcttcatcgagacagagttccaccacgtgggccaggccggccctgagctgctgaccagcggggaccccagcgccagcgccagccagagcgctggcatcactggagccagccaccgggcccagcccctgagcatcctcttcttcttctttgaggcctag

SEQ ID NO: 41493 - DNA, 462 bp, Artificial Sequence; identical to SEQ ID NO: 41481
  Description of Artificial Sequence: Synthetic coding sequence

SEQ ID NO: 41494 - DNA, 273 bp, Artificial Sequence
  Description of Artificial Sequence: Synthetic coding sequence
cagtggagcgacctgggcagcctgcagcccccacctcctggcttcaagcgcttcagctgcctgaacctgcccacctcctgggactacagacatgtgccccccaggcctgccaacttctgcttcttcatcgagatgggcttcctgcacgtgggccagacaggcctggagctgcccaccagcggggaccccccagccagcgccagccagagcgctggcatcaccggggtgagccaccacgcctggccccacttcatcatcctgctgatgatctag

SEQ ID NO: 41495 - DNA, 387 bp, Artificial Sequence
  Description of Artificial Sequence: Synthetic coding sequence
tggagggcccctgtgatcccagccacccgggaggccgaggccggggagtggtgtgagcccaggagcacccgcatccaggagaaggacatcgccttcctggccttcagcctgggggacagagtgcggctgtacctgcagaagaagaagaagaagaagaagaagaaccagagccgcctcttcctgcggctgagcctggccctgagcccccggctggagtgcagcggggccatcagcgcccactgcaacctgcaccacctgggcagcagtgacagccctgccagcgccagccgggtggccggcatcaccggggcccggcaccacacccgcttcatctttgtgttcctggtggagaccagctgctggaacctgctggtgagcaacagctag

SEQ ID NO: 41496 - DNA, 357 bp, Artificial Sequence
  Description of Artificial Sequence: Synthetic coding sequence
tggtgtgcccctgtggccccagccacccgggaggtggaggtgggcggcagcctggagcccaacagaagccggctgcagagcgccaagatcgcccccctgcactacagcctgggcaacagaacccggctgtgcctgaagaagaagaagaagaagagcctcttcaacaaggtgtgcctcttcctgcggcgcagcctgaccctgagcccccggctggagcacagcggcatgatcagcgcccactgcaacctgcggctgcccggcagcagctacagccctgtgtctgccagccaggtggccggcatcaccggggcctgccaccacacccagctgatctttgtgttcctggtggagacctag

SEQ ID NO: 41497 - DNA, 318 bp, Artificial Sequence; identical to SEQ ID NO: 41462
  Description of Artificial Sequence: Synthetic coding sequence

SEQ ID NO: 41498 - DNA, 354 bp, Artificial Sequence
  Description of Artificial Sequence: Synthetic coding sequence
gacagagtgctgctgtgccaccctggctggagcgccatgaccaggagccggctgacagccaccagcgccagccagctggccggcatcaccggcacccaccaccacgtgtggctgagctttgtgttcctggtggagatgggcatccaccacgtgggccagacaggcctggagctgcccaccagcggggacctgcccaccagcgccacccagagcgctggcatcactggagtgggccactgcagcaggcctgaggaggtgctcttcttcagagatggagtgagcccctgctggagcggctggagccagaccccaggcctgaagcccagcagccacctgggcctgcccaagtgctag

SEQ ID NO: 41499 - DNA, 111 bp, Artificial Sequence
  Description of Artificial Sequence: Synthetic coding sequence
aaggagaagaaggaggagaggaagaaggagaggaagaagaaggagaggaagaaggagaggaagaaggagaggaagcgggagaaggagaggaagaaggagaaggagaggtag

SEQ ID NO: 41500 - DNA, 306 bp, Artificial Sequence
  Description of Artificial Sequence: Synthetic coding sequence
ttccacctgttcctgttcatctgcttcttcctgttcctgcggcgcagcctggccctgagcccccggctggagtacagcggcaccatcagcgcccactgcaagctgcggctgcccggcagccgctacagcgccagcgccagccgggtggccggcaccactggagcccggcaccacgcccggctcatcttctgcatcttctacagagatggagtgagcccctgctggagccgcatcccagacctgatctgcctgccctggccacccaaggtgctgggcctgcaggccccagccaccatccctggatag

SEQ ID NO: 41501 - DNA, 423 bp, Artificial Sequence; identical to SEQ ID NO: 41444
  Description of Artificial Sequence: Synthetic coding sequence

SEQ ID NO: 41502 - DNA, 387 bp, Artificial Sequence
  Description of Artificial Sequence: Synthetic coding sequence
tggagggcccctgtgatcccagccacccgggaggccgaggccggggagtggtgtgagcccaggagcacccgcatccaggagaaggacatcgccttcctggccttcagcctgggggacagagtgcggctgtacctgcagaagaagaagaagaagagcaagaacaacaagaccagcctcttcctgcggctgagcctggccctgagcccccggctggagtgcagcggggccatcagcgcccactgcaacctgcaccacctgggcagcagtgacagccctgccagcgccagccgggtggccggcatcaccggggcccggcaccacacccgcttcatctttgtgttcctggtggagaccagctgctggaacctgctggtgagcaacagctag

SEQ ID NO: 41503 - DNA, 306 bp, Artificial Sequence; identical to SEQ ID NO: 41500
  Description of Artificial Sequence: Synthetic coding sequence

SEQ ID NO: 41504 - DNA, 111 bp, Artificial Sequence
  Description of Artificial Sequence: Synthetic coding sequence
aagaggaagaagaaggagaggaagaaggagaggaggaagaaggagaggaagaaggagaggaagaaggagaggaagaaggagaaggagaggaagaaggagaaggagaggtag

SEQ ID NO: 41505 - DNA, 279 bp, Artificial Sequence; identical to SEQ ID NO: 41449
  Description of Artificial Sequence: Synthetic coding sequence

SEQ ID NO: 41506 - DNA, 111 bp, Artificial Sequence; identical to SEQ ID NO: 41458
  Description of Artificial Sequence: Synthetic coding sequence

SEQ ID NO: 41507 - DNA, 333 bp, Artificial Sequence
  Description of Artificial Sequence: Synthetic coding sequence
tgcacccgctacttctacttctacctgttctgcttcatcttcatctacctgttcttcttcctgcgctggagcctggccctgagcccccggctggagtgcagcggggccatcagcgcccactgcaagctgcacctgcccggcagctgccactacccagccagcgccagccgggtggccggcaccaccggggcccggcaccacgcctggctgatcttctgcatgttcagcaaggacagagtgagccgctggagccagagcccagacatcgccatctgcctgccctggccacccaaggtgctgggcctgcaggccccagccaccaccccaggatag

SEQ ID NO: 41508 - DNA, 357 bp, Artificial Sequence
  Description of Artificial Sequence: Synthetic coding sequence
tggtgtgcccctgtggccccagccacccgggaggtggaggtgggcggcagcctggagcccaacagaagccggctgcagagccccaagatcgcccccctgcactacagcctgggcaacagaacccggctgtgcctgaagaagaagaagaagaagaagaagatcaacaaggtgtgcctcttcctgcggcgcagcctgaccctgagcccccggctggagcacagcggcatgatcagcgcccactgcaacctgcggctgcccggcagcagctacagccctgtgtctgccagccaggtggccggcatcaccggggcctgccaccacacccagctgatctttgtgttcctggtggagacctag

SEQ ID NO: 41509 - DNA, 177 bp, Artificial Sequence; identical to SEQ ID NO: 41250
  Description of Artificial Sequence: Synthetic coding sequence

SEQ ID NO: 41510 - DNA, 129 bp, Artificial Sequence
  Description of Artificial Sequence: Synthetic coding sequence
aaggaggagaatgaggaggagaaggtgaaggagaaggagaagaacaagaagaggaagaagaggaagaagagccagagcagaagagtgtaccaccaggagaagacccacatcctgtgggtgtccacctag

SEQ ID NO: 41511 - DNA, 309 bp, Artificial Sequence; identical to SEQ ID NO: 41471
  Description of Artificial Sequence: Synthetic coding sequence

SEQ ID NO: 41512 - DNA, 333 bp, Artificial Sequence
  Description of Artificial Sequence: Synthetic coding sequence
ttcttcttcttctttggaaatggagtgtggctgtgccaccctggctggagcgctgtggtgcagagccggctgacagccaccagcgcctcctggcagctggccggcatcactggagtgtgccaccacgcccagctgatctttgtgttcttcattgaaacagagttccaccacgtgggccaggccggccctgagctgctgaccagcggggaccccagcgccagcgccagccagagcgctggcatcaccggggccagccacccccggcgggccaacttctgcatcttcggcagagatggagtgagcccctgctggccaggctggagcagcacctag

SEQ ID NO: 41513 - DNA, 75 bp, Artificial Sequence
  Description of Artificial Sequence: Synthetic coding sequence
cgggagacagagaggaccatcacagatgatggctggatggatggctggatggatggctggatggatggctggtag

SEQ ID NO: 41514 - DNA, 372 bp, Artificial Sequence
  Description of Artificial Sequence: Synthetic coding sequence
ttcatcttcctgcgctggagcctgagcctgagcccccggctggagtgcagcggcaccatcagcgcccactgcaacctgtgcctgcccggcagcagccacagcagcgccagcgccagccaggtggcccgcatcacagatgtgggctacgcccctggccagcacggggagacccccagcctgctgaagatccagaagctggccggctatggagtggccaacgtgtacagccagctgctgggccgcctgcggcaggagaatggagtgaaccctgggggcggcacctgcagcgagcccaggagccgccactgcaccccagcctgggccacagcccggctgcggctgaagaagaagaagaagaagaagaagaagtag

SEQ ID NO: 41515 - DNA, 459 bp, Artificial Sequence
  Description of Artificial Sequence: Synthetic coding sequence
agccgcttctacatcggctgtgacctgtgcaccaactgctactatggagaatgtgtgggcattgctgagaaggaggccaagaagatggatgtgtacatctgcaatgactgcaagtgggcccaggagggcagcagcgaggagctgtactgcatctgcaggaccccagctggcagctgccgcttcttcatcggccatgaccgctgccagaactggtaccacggctgctgcatcggcatcctgcagagcgaggccgagctgattgatgaatatgtgtgcccccagtgccagagcacagaagatgtgatgacagtgctgacccccctgacagagaaggatgatgaggagctgaagagggtgctgcggagcctgcaggcccacaagatggcccggcccttcctggagcctgtggaccccaatgatgccccagactactatggagtcatcaaggagcctgtgtag

SEQ ID NO: 41516 - DNA, 123 bp, Artificial Sequence; identical to SEQ ID NO: 41461
  Description of Artificial Sequence: Synthetic coding sequence

SEQ ID NO: 41517 - DNA, 96 bp, Artificial Sequence; identical to SEQ ID NO: 41421
  Description of Artificial Sequence: Synthetic coding sequence

SEQ ID NO: 41518 - DNA, 417 bp, Artificial Sequence
  Description of Artificial Sequence: Synthetic coding sequence
ggcaccatcagcgcccactgcaacctgtgcctgctggacagcagtgacagccctgccagcgccagccgggtggccggcatcatcggggcccaccaccacgcccagctgatctttgtgttcctggtggagatgggcttccaccacgtgggccaggccggcctgaagctgctgaccagtgaccccccagccagcgccagccagagcgctggcatcaccggggtgagccaccacaactggctgttcttcagcatcttcctgaagaacagccaggagacagcccgcttcttcttctggttcttcttctttgagatggagagctacagcgtggcccaggccggcgtgcagtggagggacctgagcagcctgcagcccccaccacccaggcacaccatcctgctgccccagcccccagagtag

SEQ ID NO: 41519 - DNA, 108 bp, Artificial Sequence; identical to SEQ ID NO: 41487
  Description of Artificial Sequence: Synthetic coding sequence

SEQ ID NO: 41520 - DNA, 369 bp, Artificial Sequence
  Description of Artificial Sequence: Synthetic coding sequence
ttcatcttcctgcgctggagcctgagcctgagcccccggctggagtgcagcggcaccatcagcgcccactgcaacctgtgcctgcccggcagcagccacagcagcgccagcgccagccaggtggcccgcatcacagatgtgggctacgcccctggccagcacggggagacccccagcctgctgaagatccagaagctggccggctatggagtggccaacgtgtacagccagctgctgggccgcctgcggcaggagaatggagtgaaccctgggggcggcacctgcagcgagcccaggagccgccactgcaccccagcctgggccacagcccggctgcggctgaagaagaagaagaagaagaagaagtag

SEQ ID NO: 41521 - DNA, 462 bp, Artificial Sequence; identical to SEQ ID NO: 41481
  Description of Artificial Sequence: Synthetic coding sequence

SEQ ID NO: 41522 - DNA, 213 bp, Artificial Sequence
  Description of Artificial Sequence: Synthetic coding sequence
atcagcgcccactgcaacctgtgcctgctgggcagcagcaacagcctggccagcgccagccaggtggccggcatcaccggggcccaccaccaggcccagctgatctttgtgttcctggtggagacagagttccaccacgtgggccaggccggcctgaagctgctgaccaatgagtggctgcctgtgtgcctgcccaagtgctgggactactag

SEQ ID NO: 41523 - DNA, 366 bp, Artificial Sequence
  Description of Artificial Sequence: Synthetic coding sequence
tgtgtgtgtgtgtgtgtgtgtgtgtgtgtgtgtgtgttcatctacttctctgtgttctggagcttcctgtacctgtttgtgttcctgatctgggccaaggagcaggacagcgtgtccaagaagaagaagaagaagccaggagtggtggcccacgcctgcaaccccagcaccctgggcggccggggcggccagatcaccaagcaggagtttgagaccagcctgagcaacatggccaagccacccaaggtgctgggcctgcagaactggccaggcatggtggccagcacctgcaaccccagctatggccgcctgaagcaggagaaccacctgatccggggcggccggggctgcagcgagcccaggtag

SEQ ID NO: 41524 - DNA, 276 bp, Artificial Sequence
  Description of Artificial Sequence: Synthetic coding sequence
accttcttcttcttcttctttgaaacagactgccgctctgtgacccggctggagtgcagcggcatcatcagcgcccactgcaagctgtgcctgcccggcagcagtgacagccctgccagcgccagccaggccgcccggaccatcggggcctgccaccacgcccagctgatctttgtgttctttgaaacaggcttccaccacgtgggccaggacggcctgctggacctggtgatccacccccccaggcctcccaaggtgctgggcctgcaggtgtag

SEQ ID NO: 41525 - DNA, 372 bp, Artificial Sequence; identical to SEQ ID NO: 41435
  Description of Artificial Sequence: Synthetic coding sequence

SEQ ID NO: 41526 - DNA, 765 bp, Artificial Sequence
  Description of Artificial Sequence: Synthetic coding sequence
aaggtgagccacgtgtacttcttcctgcaccgccacggcaaccaccccatcagccagagcttcccccacctgagccggctgagcatcccccagagccgccactgccaccctggccccttctccatgagctgctgggcccacctgcctgatggagctgtggccggccagaggggcagcagcctgcccagcagaggaggccgggcagaggcccccctgaccagcaggacaggccgcctggccggccagggcgccccacccaccagcctgcctgactgggtggccgccggcagaagaagaagcagcctgccccgctggggcggctgcagagctgagcggctgctgaccagccagacaggccagctgcccggcggcggggccccccacttcagtgatggagtggtggcccggcagagggtgagcagcctgctgcggcggggcggccgggcagagaccctgctgaccagccagacaggcagcaggcctggccgcggggccccccacatcccagatggagctgctggccagaggaggagcccccacctgcggcgctgggccgccggccagaggaggagcagcctgccccgctgggatggcggccgggcagagaccctgctgaccttccagacaggccagcccggccgcggggccccccacatcccagatgatggccggcccggccgggacaccccccacttcccagatggagtggccgccggccagaggctgcagagccgccacttcggccggccccggcaggccgcctag

SEQ ID NO: 41527 - DNA, 456 bp, Artificial Sequence
  Description of Artificial Sequence: Synthetic coding sequence
atggagaggaagaaccccagccgggagagcccccggcggctgagcgccaaggtgggcaagggcacagagatgaagaaggtggcccggcagctgggcatggctgctgctgagagtgacaaggacagcggcttcagtgatggcagcagcgagtgcctgagcagcgctgagcagatggagagcgaggacatgctgagcgccctgggctggagccgggaggaccggccccggcagaacagcaagacagccaagaatgccttccccaccctgagccccatggtggtgatgaagaatgtgctggtgaagcagggcagcagcagcagccagctgcagagctggacagtgcagcccagctttgaggtgatcagcgcccagccccagctgctcttcctgcacccccctgtgcccagccctgtgagcccctgccacactggagagaagaagagtgacagcaggtag

SEQ ID NO: 41528 - DNA, 408 bp, Artificial Sequence
  Description of Artificial Sequence: Synthetic coding sequence
atggagaggaagaaccccagccgggagagcccccggcggctgagcgccaaggtgggcaagggcacagagatgaagaaggtggcccggcagctgggcatggctgctgctgagagtgacaaggacagcggcttcagtgatggcagcagcgagtgcctgagcagcgctgagcagatggagagcgaggacatgctgagcgccctgggctggagccgggaggaccggccccggcagaacagcaagacagccaagaatgccttccccaccctgagccccatggtggtgatgaagaatgtgctggtgaagcagggcagcagcagcagccagctgcagagctggacagtgcagcccagctttgaggtgatcagcgcccagccccagctgctcttcctgcacccccctgtgccctag

SEQ ID NO: 41529 - DNA, 426 bp, Artificial Sequence
  Description of Artificial Sequence: Synthetic coding sequence
atggagaggaagaaccccagccgggagagcccccggcggctgagcgccaaggtgggcaagggcacagagatgaagaaggtggcccggcagctgggcatggctgctgctgagagtgacaaggacagcggcttcagtgatggcagcagcgagtgcctgagcagcgctgagcagatggagagcgaggacatgctgagcgccctgggctggagccgggaggaccggccccggcagaacagcaagacagccaagaatgccttccccaccctgagccccatggtggtgatgaagaatgtgctggtgaagcagggcagcagcagcagccagctgcagagctggacagtgcagcccagctttgaggtgatcagcgcccagccccagctgctcttcctgcacccccctgtgcccagccctgtgagcccctgctag

SEQ ID NO: 41530 - DNA, 474 bp, Artificial Sequence
  Description of Artificial Sequence: Synthetic coding sequence
atggagaggaagaaccccagccgggagagcccccggcggctgagcgccaaggtgggcaagggcacagagatgaagaaggtggcccggcagctgggcatggctgctgctgagagtgacaaggacagcggcttcagtgatggcagcagcgagtgcctgagcagcgctgagcagatggagagcgaggacatgctgagcgccctgggctggagccgggaggaccggccccggcagaacagcaagacagccaagaatgccttccccaccctgagccccatggtggtgatgaagaatgtgctggtgaagcagggcagcagcagcagccagctgcagagctggacagtgcagcccagctttgaggtgatcagcgcccagccccagctgctcttcctgcacccccctgtgcccagccctgtgagcccctgccacactggagagaagaagagtgacagcaggaactacctgcccatcctgtag

SEQ ID NO: 41531 - DNA, 1752 bp, Artificial Sequence
  Description of Artificial Sequence: Synthetic coding sequence
atgaccttctacctgtttggcatccgctccttccccaagctgtggaagagcccctacctgggcctgggccctggccacagctatgtgtccctcttcctggccgacagatgtggcatccggaaccagcagaggctcttcagcctgaagaccatgagcccccagaacaccaaggccaccaacctgattgccaaggcccgctacctgaggaaggatgagggcagcaacaagcaggtgtacagcgtgccccacttcttcctggccggggccgccaaggagaggagccagatgaacagccagacagaagatcatgccctggcccctgtgaggaacaccatccagctgcccacccagcccctgaacagcgaggagtgggacaagctgaaggaggacctgaaggaaaatacaggcaagaccagctttgagagctggatcatcagccagatggccggctgccacagcagcattgatgtggccaagagcctgctggcctgggtggccgccaagaacaacggcatcgtgtcctatgacctgctggtgaagtacctgtacctgtgtgtgttccacatgcagaccagcgaggtgattgatgtgtttgagatcatgaaggcccgctacaagaccctggagccccggggctacagcctgctgatccggggcctcatccacagcgaccgctggagggaggccctgctgctgctggaggacatcaagaaggtgatcacccccagcaagaagaactacaatgactgcatccagggcgccctgctgcaccaggatgtgaacacagcctggaacctgtaccaggagctgctgggccatgacatcgtgcccatgctggagaccctgaaggccttctttgattttgggaaggacatcaaggatgacaactacagcaacaagctgctggacatcctgagctacctgaggaacaaccagctgtacccaggagagagctttgcccacagcatcaagacctggtttgaatctgtgcctgggaagcagtggaagggccagttcaccaccgtgaggaagagcggccagtgcagcggctgcggcaagaccatcgagagcatccagctgagccctgaggagtatgagtgcctgaagggcaagatcatgagagatgtgattgatggaggagaccagtacaggaagaccaccccccaggagctgaagagatttgagaacttcatcaagagccggcccccatttgatgtggtgattgatggcctgaatgtggccaagatgttccccaaggtgcgggagagccagctgctgctgaatgtggtgtcccagctggccaagaggaacctgcggctgctggtgctgggcaggaagcacatgctgcggcgcagcagccagtggagcagagatgagatggaggaggtgcagaagcaggccagctgcttctttgctgatgacatcagtgaagatgaccccttcctgctgtatgccaccctgcacagcggcaaccactgccgcttcatcacccgggacctgatgagggaccacaaggcctgcctgcctgatgccaagacccagaggctcttcttcaagtggcagcagggccaccagctggccatcgtgaaccgcttccctggcagcaagctgaccttccagaggatcctgtcctatgacacagtggtgcagaccaccggggacagctggcacatcccctatgatgaggacctggtggagcgctgcagctgtgaggtgcccaccaagtggctgtgcctgcaccagaagacctag

SEQ ID NO: 41532 - DNA, 309 bp, Artificial Sequence
  Description of Artificial Sequence: Synthetic coding sequence
gacatcgtgatgacccagagccccctgagcctgcctgtgaccccaggagagcccgccagcatcagctgccgcagcagccagagcctgctgcacagcaatggctacaactacctggactggtacctgcagaagccaggccagagcccccagctgctgatctacctgggcagcaacagagccagcggcgtgcctgaccgcttcagcggcagcggcagcggcacagacttcaccctgaagatcagccgggtggaggccgaggatgtgggcgtgtactactgcatgcaggccctgcagaccccacccacctag

SEQ ID NO: 41533 - DNA, 348 bp, Artificial Sequence
  Description of Artificial Sequence: Synthetic coding sequence
aagatgagccccagccagctgattggcttcctgctgctgtgggtgcctgccagcagaggagagatcgtgctgacccagagcccagacttccagagcgtgacccccaaggagaaggtgaccatcacctgccgggccagccagagcatcggcagcagcctgcactggtaccagcagaagccagaccagagccccaagctgctgatcaagtatgccagccagagcatcagcggcgtgcccagccgcttcagcggcagcggcagcggcacagacttcaccctgaccatcaacagcctggaggctgaagatgctgctgcctactactgccaccagagcagcagcctgccctag

SEQ ID NO: 41534 - DNA, 396 bp, Artificial Sequence
  Description of Artificial Sequence: Synthetic coding sequence
atgggccctgctgtgctgggccagggccaggagggccagcctgaggcccgggcctgcagcggcctgctgcagccccccaagaggcccatcgtgttcaaggagaagctgaccatgaagacagacagcctgatggaggagaagctggagtgcagcctgtggtgctgcctgagtgaccccagcatccctggccgctgctgcgtgctggagcggcgcatcgtgccctggatgcagcaggagagctacagcagcagcagccccatctggagcgtggacagtgatgagcccaacctgacctctgtgctggagcggctggaggacaccaaggagaacagctctgtgaggaaggagaccaagctgttcagcctcttcctgatgaacatcatcttcaggaactag

SEQ ID NO: 41535 - DNA, 411 bp, Artificial Sequence
  Description of Artificial Sequence: Synthetic coding sequence
atgggagacagcagaagagatgtgctgcacgagcccgccatcgccctgctgagcagcccccagacccagagccggctgcagattgatgccttcatcgcccggcgctgctggggcagccagtgggacatcaccggctacatccaccagcaggacttccccacagctgtgttcatcggcttcagcaatgagttcaacatctgcatcccccaccccttcacagagtggctgcagtgtgtgaggaagtacagccagagctggggcgtgaggaagggccagaggcacatccgctatggcatgtgcagcgagaggacccaccacctgagcaggacctacagcagcctgctggagcgggaggagaagctggccttctacggcgtgctgaccatgtgccagatctggtgtgagacctag

SEQ ID NO: 41536 - DNA, 315 bp, Artificial Sequence
  Description of Artificial Sequence: Synthetic coding sequence
gaagatattgtgatgacccagacccccctgagcctgcctgtgaccccaggagagcccgccagcatcagctgccgcagcagccagagcctgctggacagtgatgatggcaacacctacctggactggtacctgcagaagccaggccagagcccccagctgctgatctacaccctgagctaccgggccagcggcgtgcctgaccgcttcagcggcagcggcagcggcacagacttcaccctgaagatcagccgggtggaggccgaggatgtgggcgtgtactactgcatgcagagaattgagttccccagcacctag

SEQ ID NO: 41537 - DNA, 345 bp, Artificial Sequence
  Description of Artificial Sequence: Synthetic coding sequence
atgggcacccggctgctgtgctgggtggtgctgggcttcctgggcacagaccacactggagctggggtgtcccagagcccccgctacaaggtggccaagaggggccaggatgtggccctgcgctgtgaccccatcagcggccacgtgtccctcttctggtaccagcaggccctgggccagggccctgagttcctgacctacttccagaatgaggcccagctggacaagagcggcctgcccagcgaccgcttctttgctgagaggcctgagggctctgtgtccaccctgaagatccagaggacccagcaggaggacagcgctgtgtacctgtgtgccagcagctag

SEQ ID NO: 41538 - DNA, 372 bp, Artificial Sequence
  Description of Artificial Sequence: Synthetic coding sequence
atgtgtggccagtgccagagcagcagcggccacatggaggaggaggcccaccctgagctgtgcccccactggcccctgcagttcagcccccagagccactgccggcaggcctacggccgggacacccacgccggcggccctggggcccgggtggacagcggccaccacctgggcctcttccctggcctgctgagcacctgcccagatggcctgtgtgtgtttcctgtgcccagccccaccttcagcaccagcctgcacgtgctgatggagtgcaaggtgcaccagcccggccccctgcccggccggggcagcgcagatgctggcctgcggggcctgccccagggccgcaccctgtgtgtgctgacagcctag

SEQ ID NO: 41539 - DNA, 528 bp, Artificial Sequence
  Description of Artificial Sequence: Synthetic coding sequence
atgcacggggagaagagccacggccggggccaggccggccggcaggtgcccctgaagcagcagagcgtgtctggagagagccagcagggcgcccggcagggcgccggccagagcacctgctacctgagcagcgccttcctgtgcaatggcagcttccctgctggctccatgagcctgtgggacccccagcccaagcaggccttccccagcgtgctgtggtgctcctgggccggcgtgcccggccgcaggacaggccagagggacccccgggtgcaggagcggcggggggactttgtgtccaagctgggcgctgctgtgggcggggagcccctggccctgtttggcccccacagctggccaggcatgggccaccgggtgcccggcctgggcgccggcttcctgctgtttgctggctttgccctggagccctgggacagctaccacgtggtgtttgagggctggaccatcgacatgagaagaaatgaacctgagaggaccaggagcctgagcgcccctggccccctgtag

SEQ ID NO: 41540 - DNA, 1671 bp, Artificial Sequence
  Description of Artificial Sequence: Synthetic coding sequence
atgcaccccatggccctgcacatggtgctgcctgcccacctgcccttcctgagccctgaggtgctgcggctgctggaggtgcacgtgaagaagtggatgcacttccagcgctggggcctgccccggcgggtggaggagagcctgcggcagctgatgcccaacccccccctgtactaccagcctggaaatgaccagcctgtgtccttcaacctgaacaacaccagccaggtgtccctgcacaggtctgagaccatcagcctgcagacctggtgcagctgtgtggccggccagcccatccagaccttctgggtgtctgagtggagcaccatgaaccctgagcagaggcaccactgccagcagacccccaaccccatggccctggccctgcccagccctgccctgaaggccctgagcggcccccacccccagagcggcggccaggacaatgattctggcagtgacctgcagcagaagtacagccagctgttctgtggcctgcccagcctgcacagcgagagcctggtggccaccttcatgggcagccagggcctgcccaagattgaaaatgtgcccaagccacccctgaaggaccccttcctgttcaatgacctgtccttcccccagctgctgcccaagaccagcccccagagcgccccacccagcagccccctgagccccaactgggtgagccccagcgaccaccagagggcccagatcaacgtgcccttcctgaccctggccgagtatgaggccctggagtggcacctgctgcagaggcagctgcagctgcagtggggctggccagctgccctgcagaggagccagcacacccagtgcctgatgcagcacgagccctgtgggaaggcccagagccctgagaccaccacagccagccagacaggcaagagcatctctgtgctgacccgggagctgctcttcttccctgagcacgccaggaagctgctggagttccacatccagaagcagagcatccgccaccgctggggcctgccccagaagatccagcagagcatccagctgctgctgaccagcacagaccagcagacagtgagcagcagcagcacagccctggccaacgtgtccatcccccagcctgtggccctggaggccaacggggcctgtgatgtgctgagccccatcgccgcccctgtgtccatcccccggccccacctgctgacccaggtgaaggccatcctgcagagccacatcgacagcaaatgtggccagatccaccagggcaagatcccagcctgtgtgcaccgctcctgggactgccgcatctctggagtgctggccgtggcccccttcccctgcatccctgagagccagttcctggtgctgcagacagccagtgaccctgacctgcaccacaaggtgatgccctggatgcccacagccctggaccagcagcagcaggccctgcccggcaccgtgacagagcaccccaagctgctgcgggtgctgtctgtggaggccatcgagaagctggagaccaccctgcggcacaagcacctggccttcctgagcggcctgcctgccctgtactacgtggccctgccccgggccctggccccagctgtgaccagccagagcgtcatcacagagatggagcccagccctgtggagatcccagctgagcccctcatctag

SEQ ID NO: 41541 - DNA, 624 bp, Artificial Sequence
  Description of Artificial Sequence: Synthetic coding sequence
atgggcatgaggctgcagctgctgcgggaccggcgcatcagcagccggggccctggcctgcaccgggccaaggctgacccccagcagcagaagaggctgaccaccggcctgatgacccaggccgagacccagaaggaggcccagcagaggcaggccgccatgaggaagacagccctgtggcacacaggccacctgcagcccaagacccacacccacacaggcatgcacacccagacccaccgggagcgggagaggaacacccagaggctgcgggaccgggagaggagagaaaatggccgccacacccaccgccacacccacaccctgacccacacccacacccaccgggacacccacacagccagctaccgccggggcatcgagacccacaccacccggcagcccctgcggctgcggggcagcgcccatgatgaaaatgacccccgggtgcgggagcagccccggggcacccaggccgacctgagcagccgcagcaggatggccgcccggctgctgggccgcctgacccccaccaacacagtgcgggccggcctgcggctgggcagcagagctgccagcccagaccctgcctggggcttcctgattgtggtgggccccctgtag

SEQ ID NO: 41542 - DNA, 381 bp, Artificial Sequence
  Description of Artificial Sequence: Synthetic coding sequence
atgggcatgaggctgcagctgctgcgggaccggcgcatcagcagccggggccctggcctgcaccgggccaaggctgacccccagcagcagaagaggctgaccaccggcctgatgacccaggccgagacccagaaggaggcccagcagaggcaggccgccatgaggaagacagccctgtggcacacaggccacctgcagcccaagacccacacccacacaggcatgcacacccagacccaccgggagcgggagaggaacacccagaggctgcgggaccgggagaggagagaaaatggccgccacacccacacccacacagagacccacacccagaggcacacagaggaggccctgaagcacaccccacctggcaacccctag

SEQ ID NO: 41543 - DNA, 693 bp, Artificial Sequence
  Description of Artificial Sequence: Synthetic coding sequence
atgaggctggccggccccctgagaattgtggtgctggtggtgtctgtgggcgtgacctggatcgtggtgtccatcctgctgggcggccctggcagcggcttcccccgcatccagcagctgttcaccagccctgagagctctgtgacagctgccccccgggccaggaagtacaagtgtggcctgccccagccctgcccagaggagcacctggccttccgggtggtgtctggggccgccaacgtcatcggccccaagatctgcctggaggacaagatgctgatgagctctgtgaaggacaacgtgggccggggcctgaacatcgccctggtgaatggagtgtctggagagctgattgaggcccgggcctttgacatgtgggccggagatgtgaatgacctgctgaagttcatccggcccctgcacgagggcaccctggtgtttgtggccagctatgatgatcctgccaccaagatgaatgaggagaccaggaagctgttcagcgagctgggcagcagaaatgccaaggagctggccttccgggacagctgggtgtttgtgggcgccaagggcgtgcagaacaagagcccctttgagcagcacgtgaagaacagcaagcacagcaacaagtatgagggctggccagaggccctggagatggagggctgcatccccaggaggagcacagccagctag

SEQ ID NO: 41544 - DNA, 840 bp, Artificial Sequence
  Description of Artificial Sequence: Synthetic coding sequence
atgggcaaaggaaatgaagacagcgacctgcactgcagcagcatccagtgcagcacagaccagccccccttccagcagatctccttcacagagaagggcagtgatgagaagaagcccttcaaggagaagggcaagacagccttcagccacagcagcgagaagcacatccagaggcaggccggcagcgagcccaaccccaacaaggaaaattctgaggagaccaagctgaaggccggcaacagcacagctggcagcgagcctgagagcagcagctaccgggagaactgcaggaagaggaagatgagcagcaaggacagctgccaggacacagctggcaactgcccagagaaggagtgcagcctgagcctgaacaagaagagccgcagcagcacagctgtgcacaacagcgagatccaggagacctgtgatgcccaccaccggggccacagccgggcctgcaccggccacagcaagaggcacaggagccgggccctgggcgtgcagacccccagcatcaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggagagagcgccctggaccgggaggcccaccccttccctggccaggagatcacagagaccgtgtctggcagtgatgaggccaagctgtag

SEQ ID NO: 41545 - DNA, 849 bp, Artificial Sequence; identical to SEQ ID NO: 38974
  Description of Artificial Sequence: Synthetic coding sequence

SEQ ID NO: 41546 - DNA, 903 bp, Artificial Sequence
  Description of Artificial Sequence: Synthetic coding sequence
atggccgccacagaagatgagcggctggccggcagcggggagggggagcggctggacttcctgcgggacagacatgtgcgcttcttccagcgctgcctgcaggtgctgcctgagcgctacagcagcctggagaccagccggctgaccatcgccttctttgccctgagcggcctggacatgctggacagcctggatgtggtgaacaaggatgacatcatcgagtggatctacagcctgcaggtgctgcccacagaagatagaagcaacctgaacagatgtggcttccggggcagcagctacctgggcatccccttcaaccccagcaaggcccctggaacagcccacccctatgattctggccacatcgccatgacctacacaggcctgagctgcctggtgatcctgggagatgacctgagccgggtgaacaaggaggcctgcctggccggcctgcgggccctgcagctggaggatggcagcttctgtgctgtgcctgagggctctgaaaatgacatgagatttgtgtactgtgccagctgcatctgctacatgctgaacaactggagcggcatggacatgaagaaggccatcacctacatcagaagatccatgctgctgaagatcttccagtacaccaactttgagaagaacagaaactacatcctgagcacccaggaccggctggtgggcggctttgccaagtggccagacagccacccagatgccctgcacgcctacttcggcatctgtggcctgagcctgatggaggagagcggcatctgcaaggtgcacccagccctgaatgtgtccaccaggaccagcgagcggctgctggacctgcaccagagctggaagaccaaggacagcaagcagtgcagtgaaaatgtgcacatcagcacctag

SEQ ID NO: 41547 - DNA, 1134 bp, Artificial Sequence
  Description of Artificial Sequence: Synthetic coding sequence
atggccgccacagaagatgagcggctggccggcagcggggagggggagcggctggacttcctgcgggacagacatgtgcgcttcttccagcgctgcctgcaggtgctgcctgagcgctacagcagcctggagaccagccggctgaccatcgccttctttgccctgagcggcctggacatgctggacagcctggatgtggtgaacaaggatgacatcatcgagtggatctacagcctgcaggtgctgcccacagaagatagaagcaacctgaacagatgtggcttccggggcagcagctacctgggcatccccttcaaccccagcaaggcccctggaacagcccacccctatgattctggccacatcgccatgacctacacaggcctgagctgcctggtgatcctgggagatgacctgagccgggtgaacaaggaggcctgcctggccggcctgcgggccctgcagctggaggatggcagcttctgtgctgtgcctgagggctctgaaaatgacatgagatttgtgtactgtgccagctgcatctgctacatgctgaacaactggagcggcatggacatgaagaaggccatcacctacatcagaagatccatgtcctatgacaatggcctggcccagggcgccggcctggagagccatggaggcagcaccttctgtggcatcgccagcctgtgcctgatgggcaagctggaggaggtgttttctgagaaggagctgaaccgcatcaagcgctggtgcatcatgaggcagcagaatggctaccacggccggcccaacaagcctgtggacacctgctacagcttctgggtgggcgccaccctgaagctgctgaagatcttccagtacaccaactttgagaagaacagaaactacatcctgagcacccaggaccggctggtgggcggctttgccaagtggccagacagccacccagatgccctgcacgcctacttcggcatctgtggcctgagcctgatggaggagagcggcatctgcaaggtgcacccagccctgaatgtgtccaccaggaccagcgagcggctgctggacctgcaccagagctggaagaccaaggacagcaagcagtgcagtgaaaatgtgcacatcagcacctag

SEQ ID NO: 41548 - DNA, 1011 bp, Artificial Sequence
  Description of Artificial Sequence: Synthetic coding sequence
atgtgggtgaggaccaccctgaccatcgagcgctggaccaaggagaagacagagcccaaggcccgctcctgggatgagagccgctgccgcggggactgcaaggagccagacaagtgctgctggaggcacaagcagtgcaccggccacatcatctacccctttgccagtgactgtgtgcgccacagcctgcacctgcacagcgtgaaccactgcaactgcaacagccggctgaaggacagcagcgaggacagcagcagcagcagaggagctggccccacctgcagccacgtgattgagagcccctgctttgagctgaccccagaggaggagcacgtggagcgcttccgctatggctggtgcaagagctacagacctgtgtctgtggccgtcatccaccaccccctgtaccatgaatgtggggctgatgacctgaatgaggaggaggaggaggaggaggaggagagcaagccacccatccccacccaggtgggccctgccacagccagcccagacctgggcacctccatggccaccggcaccccagacagcacagcccccatcaccatctggaggtctgagagccccaccgggaagggccagggcagcaaggtgatcaagaaggtgaagaagaagaaggagaaggagaaggacaaggaggagatggatgagaaggccaagctgaagaagaaggccaagaagggccagctgaccaagaagaagagccctgtgaagctggagcccagccccccagatgtgagccgcagcctgagcgcccggcagctggccaggatgtctgagagcagccctgagagccgggaggagctggagagcgaggacagctacaacggccggggccagggcgagctgagcagcgaggacatcgtggagagcagcagccccaggaagcgggagaacacagtgcaggccaagaagacaggagccaagcccagccaggccaggaaggtgaacaagaggaagagccccccaggcagcaaccccaacctgtcctag

SEQ ID NO: 41549 - DNA, 1095 bp, Artificial Sequence
  Description of Artificial Sequence: Synthetic coding sequence
atgtgggtgaggaccaccctgaccatcgagcgctggaccaaggagaagacagagcccaaggcccgctcctgggatgaggccctgagtgatgtgaaccggctgcccagctgggagcggggccacctgctggccggcgtggccagcagcacagatgtgtccaccttcagcgaggccggggactgcaaggagccagacaagtgctgctggaggcacaagcagtgcaccggccacatcatctacccctttgccagtgactgtgtgcgccacagcctgcacctgcacagcgtgaaccactgcaactgcaacagccggctgaaggacagcagcgaggacagcagcagcagcagaggagctggccccacctgcagccacgtgattgagagcccctgctttgagctgaccccagaggaggagcacgtggagcgcttccgctatggctggtgcaagagctacagacctgtgtctgtggccgtcatccaccaccccctgtaccatgaatgtggggctgatgacctgaatgaggaggaggaggaggaggaggaggagagcaagccacccatccccacccaggtgggccctgccacagccagcccagacctgggcacctccatggccaccggcaccccagacagcacagcccccatcaccatctggaggtctgagagccccaccgggaagggccagggcagcaaggtgatcaagaaggtgaagaagaagaaggagaaggagaaggacaaggaggagatggatgagaaggccaagctgaagaagaaggccaagaagggccagctgaccaagaagaagagccctgtgaagctggagcccagccccccagatgtgagccgcagcctgagcgcccggcagctggccaggatgtctgagagcagccctgagagccgggaggagctggagagcgaggacagctacaacggccggggccagggcgagctgagcagcgaggacatcgtggagagcagcagccccaggaagcgggagaacacagtgcaggccaagaagacaggagccaagcccagccaggccaggaaggtgaacaagaggaagagccccccaggcagcaaccccaacctgtcctag

SEQ ID NO: 41550 - DNA, 462 bp, Artificial Sequence
  Description of Artificial Sequence: Synthetic coding sequence
atgagcatcacctacgtgaaccggctgcccagctgggagcggggccacctgctggccggcgtggccagcagcacagatgtgtccaccttcagcgagggggactgcaaggagccagacaagtgctgctggaggcacaagcagtgcaccggccacatcatctacccctttgccagtgactgtgtgcgccacagcctgcacctgcacagcgtgaaccactgcaactgcaacagccggctgaaggacagcagcgaggacagcagcagcagcagaggagctggccccacctgcagccacgtgattgagagcccctgctttgagctgaccccagaggaggagcacgtggagcgcttccgctatggctggtgcaagagctacagacctgtgtctgtggccgtcatccaccaccccctgtaccatgaatgtggggctgatgacctgaatgaggaggaggaggaggagtag

SEQ ID NO: 41551 - DNA, 1017 bp, Artificial Sequence
  Description of Artificial Sequence: Synthetic coding sequence
atgagcatcacctacgtgaaccggctgcccagctgggagcggggccacctgctggccggcgtggccagcagcacagatgtgtccaccttcagcgagggggactgcaaggagccagacaagtgctgctggaggcacaagcagtgcaccggccacatcatctacccctttgccagtgactgtgtgcgccacagcctgcacctgcacagcgtgaaccactgcaactgcaacagccggctgaaggacagcagcgaggacagcagcagcagcagaggagctggccccacctgcagccacgtgattgagagcccctgctttgagctgaccccagaggaggagcacgtggagcgcttccgctatggctggtgcaagagctacagacctgtgtctgtggccgtcatccaccaccccctgtaccatgaatgtggggctgatgacctgaatgaggaggaggaggaggaggaggaggagagcaagccacccatccccacccaggtgggccctgccacagccagcccagacctgggcacctccatggccaccggcaccccagacagcacagcccccatcaccatctggaggtctgagagccccaccgggaagggccagggcagcaaggtgatcaagaaggtgaagaagaagaaggagaaggagaaggacaaggaggagatggatgagaaggccaagctgaagaagaaggccaagaagggccagctgaccaagaagaagagccctgtgaagctggagcccagccccccagatgtgagccgcagcctgagcgcccggcagctggccaggatgtctgagagcagccctgagagccgggaggagctggagagcgaggacagctacaacggccggggccagggcgagctgagcagcgaggacatcgtggagagcagcagccccaggaagcgggagaacacagtgcaggccaagaagacaggagccaagcccagccaggccaggaaggtgaacaagaggaagagccccccaggcagcaaccccaacctgtcctag

SEQ ID NO: 41552 - DNA, 303 bp, Artificial Sequence
  Description of Artificial Sequence: Synthetic coding sequence
atgggcatcagcgaggagggcaacctgctgagcacagtgagccccaccgtgaaggccctgtttgggaagaccagggtgagccccatcttccccttcagccccaggagccccttccagcccctcatccccaggaccccaggcagcccctggggccctgtgggccctgccagccccctgggccctggcttccccatcggccccatgggccctgggaagcctgtgggccccaagggccccatgctgcccctgggccccagcggccctgtgggccccaccagccccctcttccccttctgcccctag

SEQ ID NO: 41553 - DNA, 315 bp, Artificial Sequence
  Description of Artificial Sequence: Synthetic coding sequence
atgatgagcacagagcagatgcagcccctggagctgtctgaggaccggctggacaagctggacccccgctgcagccacctgggcgtcttcagcgagcacctgatcaagagatatgatgtgcaggagcggcaccccaagggcaagatgatccctgtgctgcacaacacagacctggagcagaagaagcccaggaggaaggacaccccagccctgcacatgagcccctttgctgctggggtgaccctgctgagagatgagcggcccaaggccatcgtggaggatgatgagaaggatggagacaagatcgccatctag

SEQ ID NO: 41554 - DNA, 2400 bp, Artificial Sequence
  Description of Artificial Sequence: Synthetic coding sequence
atggccaggacagcccctgtggagccccccctgcggcacagcgccccacccagccctgctgctggggagcccaggacctctgtggaggccgctgtggcccccaggagagtgctgtttgctgatgaggccctgggcctgcccctggcccagctgcggcgctaccggccctggggcggccctggggccggcaagatggctgctgctgctggccaggacggcggcggcggcggcggcgcagatgaagatgatgatggagaagatggagatgaaggagaggaggaggaggaggcctgcccagagcccagccccctgtgccctgtgcctgctgggggcggcttctacctggtgcccaccttcagcctgcccccagcccctggccgcctggagcggctgggccgggtgatggtggagctggaggccctgctgcccccacctggagctgtgcctggaggagctggggtgtgggtgcctgggggccggccccctgtgctgcggggcctggtgcgggtgctgaacagaagctttgagaaggctgtgcacgtgcgggccagccatgatggctgggccagcttctgtgaccacccagcccgctacgtgcccaggagccccccctgggccggggccggcggcactggagctggggaccccatcctggaccccggcctgggcctgggccctggccaggccagcgccagcagcccagatgatggcggccgcacagacagatttgccttccagctgccctttgctgagggcgctggagatggagcccggctggactttgtggtgcgctatgagaccccagagggcaccttctgggccaacaaccacggcaggaactacacagtgctgctgagaattgccccagcccccacccccacagatgctgagggcctgccccagcagcagcagctgccccagctggagccccagcctgagtgccagggccctgtggaggccgaggcccggcagctgaagagctgcatgaagcctgtgagaagaagacctgctgaggaggagctgaagaccaagaacatggatgacaacacctttgccatggccgagcacccagatgtgcaggagagcgtgggccccctggtggcccccacccccctgcggccctggccccagatgaccctgcaggtgtctgatgtgcccatgacaggcaacccagctgaggagggagatgtgcccaggagcagcccccctgtggccttcacagaggtgctgcaggccccagccatccgcatcccccccagcagccccctgtgtggcctgggcggcagcccccgggaccaggccagcggcccagatgccagcgagggcgccaccggccccttcctggagcccagccagcagcaggccgaggccacctggggcgtgtccagtgaaaatggaggcggcctggaggccgtgtctggcagcgaggagctgctgggggaggacaccatcgaccaggagctggagcagctgtacctgagccacctgagccggctgcgggctgctgtggccgccggcggggccggcggcggcggggagggcagcacagatggcggcatgagccccagccaccccctgggcatcctgacagaccgggacctgatcctgaagtggccaggccctgagcgggccctgaacagcgccctggccgaggagatcaccctgcactacgcccggctgggccggggcgtggagctgatcaaggacacagaagatcctgatgatgaaggagagggggaggagggcctgtctgtgacccccagcagccctgagggggacagccccaaggagagccccccagagatcctgagcggggcccggtctgtggtggccaccatgggagatgtgtggctgccctgggccgagggcagcggctgtgatggccctgtggtgctgggcacagagggccagttcatcggggaccctgagaagggcatgggcaaggacaccagcagcctgcacatgaacagagtgattgctggggtgacagagagcctgggggaggccggcacagaggcccagatcgaggtgaccagcgagtgggccggcagcctggaccccatcagcggcaaggagcccgccagccctgtgctgctgcagggccagaaccccaccctgctgagccccctgggcgctgaggtgtgcctgagctctgtggcccggccccacgtgagcagccaggatgagaaggatgctggccccagcctggagccccccaagaagagccccaccctggccgtgcctgcagaatgtgtgtgtgccctgcccccccagctgcggggccccctgacccagaccctgggcgtgctggccggcctggtggtggtgcctgtggccctgaacagcggcgtgtccctgctggtgctggccctgtgcctgagcctggcctggttctcctag

SEQ ID NO: 41555 - DNA, 468 bp, Artificial Sequence
  Description of Artificial Sequence: Synthetic coding sequence
atgatgagcacagagcagatgcagcccctggagctgtctgaggaccggctggacaagctggacccccgctgcagccacctggatgacctgagtgaccagttcatcaaggactgtgacctgaagaagaagcccaggaagggcaagaatgtgcaggccaccctgaatgtggagagtgaccagaagaagcccaggaggaaggacaccccagccctgcacatcccccccttcatccctggggtcttcagcgagcacctgatcaagagatatgatgtgcaggagcggcaccccaagggcaagatgatccctgtgctgcacaacacagacctggagcagaagaagcccaggaggaaggacaccccagccctgcacatgagcccctttgctgctggggtgaccctgctgagagatgagcggcccaaggccatcgtggaggatgatgagaaggatggagacaagatcgccatctag

SEQ ID NO: 41556 - DNA, 1842 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagcggcctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctgaacagcggcaaggcccgggagtggaccccccgggacatcgaggcccagacccagaagccagagcccccagagagcgctgagaagctgctggagagccctggggtggaggccggggagggggaggccgagaaggaggaggccggggcccagggccggcccctgcgggccctgcagaactgctgcagcgtgcccagccccctgcccccagaagatgctggcaccggcggcctgcggcagcaggaggaggaggccgtggagctgcagcccccacctccagcccccctgagccccccacctccagcccccacagccccccagcccccaggggaccccctgatgagccgcctcttctacggcgtgaaggccggccctggggtgggcgccccccggcgcagcggccacaccttcaccgtgaaccccaggagatctgtgcccccagccaccccagccacccccaccagccctgccaccgtggatgctgctgtgcctggagctgggaagaagcgctaccccacagctgaggagatcctggtgctgggcggctacctgcggctgagccgcagctgcctggccaagggcagccctgagcggcaccacaagcagctgaagatctccttcagcgagacagccctggagaccacctaccagtaccccagcgagagctctgtgctggaggagctgggccctgagcctgaggtgcccagcgcccccaaccccccagctgcccagccagatgatgaggaggatgaggaggagctgctgctgctgcagcctgagctgcagggcggcctgcggaccaaggccctgattgtggatgagagctgcagaagatag

SEQ ID NO: 41557 - DNA, 1842 bp, Artificial Sequence; identical to SEQ ID NO: 41556
  Description of Artificial Sequence: Synthetic coding sequence

SEQ ID NO: 41558 - DNA, 1842 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagccggctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctgaacagcaggaaggcccgggagtggaccccccgggacatcgaggcccagacccagaagccagagcccccagagagcgctgagaagctgctggagagccctggggtggaggccggggagggggaggccgagaaggaggaggccggggcccagggccggcccctgcgggccctgcagaactgctgcagcgtgcccagccccctgcccccagaagatgctggcaccggcggcctgcggcagcaggaggaggaggccgtggagctgcagcccccacctccagcccccctgagccccccacctccagcccccacagccccccagcccccaggggaccccctgatgagccgcctcttctacggcgtgaaggccggccctggggtgggcgccccccggcgcagcggccacaccttcaccgtgaaccccaggagatctgtgcccccagccaccccagccacccccaccagccctgccaccgtggatgctgctgtgcctggagctgggaagaagcgctaccccacagctgaggagatcctggtgctgggcggctacctgcggctgagccgcagctgcctggccaagggcagccctgagcggcaccacaagcagctgaagatctccttcagcgagacagccctggagaccacctaccagtaccccagcgagagctctgtgctggaggagctgggccctgagcctgaggtgcccagcgcccccaaccccccagctgcccagccagatgatgaggaggatgaggaggagctgctgctgctgcagcctgagctgcagggcggcctgcggaccaaggccctgattgtggatgagagctgcagaagatag

SEQ ID NO: 41559 - DNA, 231 bp, Artificial Sequence
  Description of Artificial Sequence: Synthetic coding sequence
ctgaagatctccttcagcgagacagccctggagaccacctaccagtaccccagcgagagctctgtgctggaggagctgggccctgagcctgaggtgcccagcgcccccaaccccccagctgcccagccagatgatgaagaagatgaggaggagctgctgctgctgcagcctgagctgcagggcggcctgcggaccaaggccctgattgtggatgagagctgcagaagatag

SEQ ID NO: 41560 - DNA, 1842 bp, Artificial Sequence; identical to SEQ ID NO: 41558
  Description of Artificial Sequence: Synthetic coding sequence

SEQ ID NO: 41561 - DNA, 231 bp, Artificial Sequence; identical to SEQ ID NO: 41559
  Description of Artificial Sequence: Synthetic coding sequence

SEQ ID NO: 41562 - DNA, 1134 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagccggctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctcatcatgagcctggccgggaaaggaaaccagcacctggtgacctgcttcccccaccctgtgtctgggggccgggccaactgccccatcagcaccctcatccagagcccctggtgtggctggggctag

SEQ ID NO: 41563 - DNA, 1134 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagcggcctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctcatcatgagcctggccgggaaaggaaaccagcacctggtgacctgcttcccccaccctgtgtctgggggccgggccaactgccccatcagcaccctcatccagagcccctggtgtggctggggctag

SEQ ID NO: 41564 - DNA, 2310 bp, Artificial Sequence
  Description of Artificial Sequence: Synthetic coding sequence
atggccagcgctgagctgcagggcaagtaccagaagctggcccaggagtacagcaagctgcgggcccagaaccaggtgctgaagaagggcgtggtggatgagcaggccaacagcgctgccctgaaggagcagctgaagatgaaggaccagagcctgaggaagctgcagcaggagatggacagcctgaccttcaggaacctgcagctggccaagagggtggagctgctgcaggatgagctggccctgtctgagccccggggcaagaagaacaagaagtctggagagagcagcagccagctgagccaggagcagaagtctgtgtttgatgaggacctgcagaagaagattgaggagaatgaaaggctgcacatccagttctttgaagcagatgagcagcacaagcacgtggaggccgagctgcggagccggctggccaccctggagacagaagctgcccagcaccaggccgtggtggatggcctgaccaggaagtacatggagaccatcgagaagctgcagaatgacaaggccaagctggaggtgaagagccagaccctggagaaggaggccaaggagtgccgcctgaggacagaggagtgccagctgcagctgaagaccctgcacgaggacctgagcggccgcctggaggagagcctgagcatcatcaatgagaaggtgcccttcaatgacaccaagtacagccagtacaatgccctgaatgtgcccctgcacaacagaagacaccagctgaagatgagggacattgctggccaggccctggcctttgtgcaggacctggtgacagccctgctgaacttccacacctacacagagcagaggatccagatcttccctgtggacagcgccatcgacaccatcagccccctgaaccagaagttcagccagtacctgcatgaaaatgccagctatgtgcggcccctggaggagggcatgctgcacctgtttgagagcatcacagaagatactgtgacagtgctggagaccaccgtgaagctgaagaccttcagcgagcacctgaccagctacatctgcttcctgaggaagatcctgccctaccagctgaagagcctggaggaggagtgtgagagcagcctgtgcaccagcgccctgcgggccaggaacctggagctgagccaggacatgaagaagatgacagctgtgtttgagaagctgcagacctacatcgccctgctggccctgcccagcacagagccagatggcctgctgcggaccaactacagctctgtgctgaccaacgtgggcgccgccctgcacggcttccatgatgtgatgaaggacatcagcaagcactacagccagaaggccgccattgaacatgagctgcccacagccacccagaagctgatcaccaccaatgactgcatcctgagctctgtggtggccctgaccaacggggccggcaagatcgccagcttcttcagcaacaacctggactacttcatcgccagcctgtcctatggccccaaggccgccagcggcttcatcagccccctgtctgctgagtgcatgctgcagtacaagaagaaggctgctgcctacatgaagagcctgaggaagcccctgctggagagcgtgccctatgaggaggccctggccaacagacgcatcctgctgagcagcacagagagccgggagggcctggcccagcaggtgcagcagagcctggagaagatcagcaagctggagcaggagaaggagcactggatgctggaggcccagctggccaagatcaagctggagaaggagaaccagagaattgctgacaagctgaagaacacaggcagcgcccagctggtgggcctggcccaggagaatgctgctgtgagcaacacagctggccaggatgaggccacagccaaggctgtgctggagcccatccagagcaccagcctggtgcctgatgtggagagcagagaagatctcatcaagaaccactacatggcccgcatcgtggagctgaccagccagctgcagctggccgacagcaagtctgtgcacttctatgcagagtgccgggccctgagcaagaggctggccctggccgagaagagcaaggaggccctgacagaggagatgaagctggccagccagaacatcagccggctgcaggatgagctgaccaccaccaagaggagctatgaggaccagctgtccatgatgtctgaccacctgtgcagcatgaatgagaccctgagcaagcagcgggaggagattgacaccctgaagatgagcagcaagggcaacagcaagaagaacaagagcaggtag

SEQ ID NO: 41565 - DNA, 2343 bp, Artificial Sequence
  Description of Artificial Sequence: Synthetic coding sequence
atggccagcgctgagctgcagggcaagtaccagaagctggcccaggagtacagcaagctgcgggcccagaaccaggtgctgaagaagggcgtggtggatgagcaggccaacagcgctgccctgaaggagcagctgaagatgaaggaccagagcctgaggaagctgcagcaggagatggacagcctgaccttcaggaacctgcagctggccaagagggtggagctgctgcaggatgagctggccctgtctgagccccggggcaagaagaacaagaagtctggagagagcagcagccagctgagccaggagcagaagtctgtgtttgatgaggacctgcagaagaagattgaggagaatgaaaggctgcacatccagttctttgaagcagatgagcagcacaagcacgtggaggccgagctgcggagccggctggccaccctggagacagaagctgcccagcaccaggccgtggtggatggcctgaccaggaagtacatggagaccatcgagaagctgcagaatgacaaggccaagctggaggtgaagagccagaccctggagaaggaggccaaggagtgccgcctgaggacagaggagtgccagctgcagctgaagaccctgcacgaggacctgagcggccgcctggaggagagcctgagcatcatcaatgagaaggtgcccttcaatgacaccaagtacagccagtacaatgccctgaatgtgcccctgcacaacagaagacaccagctgaagatgagggacattgctggccaggccctggcctttgtgcaggacctggtgacagccctgctgaacttccacacctacacagagcagaggatccagatcttccctgtggacagcgccatcgacaccatcagccccctgaaccagaagttcagccagtacctgcatgaaaatgccagctatgtgcggcccctggaggagggcatgctgcacctgtttgagagcatcacagaagatactgtgacagtgctggagaccaccgtgaagctgaagaccttcagcgagcacctgaccagctacatctgcttcctgaggaagatcctgccctaccagctgaagagcctggaggaggagtgtgagagcagcctgtgcaccagcgccctgcgggccaggaacctggagctgagccaggacatgaagaagatgacagctgtgtttgagaagctgcagacctacatcgccctgctggccctgcccagcacagagccagatggcctgctgcggaccaactacagctctgtgctgaccaacgtgggcgccgccctgcacggcttccatgatgtgatgaaggacatcagcaagcactacagccagaaggccgccattgaacatgagctgcccacagccacccagaagctgatcaccaccaatgactgcatcctgagctctgtggtggccctgaccaacggggccggcaagatcgccagcttcttcagcaacaacctggactacttcatcgccagcctgtcctatggccccaaggccgccagcggcttcatcagccccctgtctgctgagtgcatgctgcagtacaagaagaaggctgctgcctacatgaagagcctgaggaagcccctgctggagagcgtgccctatgaggaggccctggccaacagacgcatcctgctgagcagcacagagagccgggagggcctggcccagcaggtgcagcagagcctggagaagatcagcaagctggagcaggagaaggagcactggatgctggaggcccagctggccaagatcaagctggagaaggagaaccagagaattgctgacaagctgaagaacacaggcagcgcccagctggtgggcctggcccaggagaatgctgctgtgagcaacacagctggccaggatgaggccacagccaaggctgtgctggagcccatccagagcaccagcctcatcggcaccctgaccaggaccagtgacagcgaggtgcctgatgtggagagccgggaggacctgatcaagaaccactacatggccagaattgtggagctgaccagccagctgcagctggccgacagcaagtctgtgcacttctatgcagaatgtcgggccctgagcaagaggctggccctggccgagaagagcaaggaggccctgacagaggagatgaagctggccagccagaacatcagccggctgcaggatgagctgaccaccaccaagaggagctatgaggaccagctgtccatgatgtctgaccacctgtgcagcatgaatgagaccctgagcaagcagcgggaggagattgacaccctgaagatgagcagcaaaggaaacagcaagaagaacaagagcaggtag

SEQ ID NO: 41566 - DNA, 2217 bp, Artificial Sequence
  Description of Artificial Sequence: Synthetic coding sequence
atggccagcgctgagctgcagggcaagtaccagaagctggcccaggagtacagcaagctgcgggcccagaaccaggtgctgaagaagggcgtggtggatgagcaggccaacagcgctgccctgaaggagcagctgaagatgaaggaccagagcctgaggaagctgcagcaggagatggacagcctgaccttcaggaacctgcagctggccaagagggtggagctgctgcaggatgagctggccctgtctgagccccggggcaagaagaacaagaagtctggagagagcagcagccagctgagccaggagcagaagtctgtgtttgatgaggacctgcagaagaagattgaggagaatgaaaggctgcacatccagttctttgaagcagatgagcagcacaagcacgtggaggccgagctgcggagccggctggccaccctggagacagaagctgcccagcaccaggccgtggtggatggcctgaccaggaagtacatggagaccatcgagaagctgcagaatgacaaggccaagctggaggtgaagagccagaccctggagaaggaggccaaggagtgccgcctgaggacagaggagtgccagctgcagctgaagaccctgcacgaggacctgagcggccgcctggaggagagcctgagcatcatcaatgagaaggtgcccttcaatgacaccaagtacagccagtacaatgccctgaatgtgcccctgcacaacagaagacaccagctgaagatgagggacattgctggccaggccctggcctttgtgcaggacctggtgacagccctgctgaacttccacacctacacagagcagaggatccagatcttccctgtggacagcgccatcgacaccatcagccccctgaaccagaagttcagccagtacctgcatgaaaatgccagctatgtgcggcccctggaggagggcatgctgcacctgtttgagagcatcacagaagatactgtgacagtgctggagaccaccgtgaagctgaagaccttcagcgagcacctgaccagctacatctgcttcctgaggaagatcctgccctaccagctgaagagcctggaggaggagtgtgagagcagcctgtgcaccagcgccctgcgggccaggaacctggagctgagccaggacatgaagaagatgacagctgtgtttgagaagctgcagacctacatcgccctgctggccctgcccagcacagagccagatggcctgctgcggaccaactacagctctgtgctgaccaacgtgggcgccgccctgcacggcttccatgatgtgatgaaggacatcagcaagcactacagccagaaggccgccattgaacatgagctgcccacagccacccagaagctgatcaccaccaatgactgcatcctgagctctgtggtggccctgaccaacggggccggcaagatcgccagcttcttcagcaacaacctggactacttcatcgccagcctgtcctatggccccaaggccgccagcggcttcatcagccccctgtctgctgagtgcatgctgcagtacaagaagaaggctgctgcctacatgaagagcctgaggaaggtgcagcagagcctggagaagatcagcaagctggagcaggagaaggagcactggatgctggaggcccagctggccaagatcaagctggagaaggagaaccagagaattgctgacaagctgaagaacacaggcagcgcccagctggtgggcctggcccaggagaatgctgctgtgagcaacacagctggccaggatgaggccacagccaaggctgtgctggagcccatccagagcaccagcctggtgcctgatgtggagagccgggaggacctgatcaagaaccactacatggccagaattgtggagctgaccagccagctgcagctggccgacagcaagtctgtgcacttctatgcagaatgtcgggccctgagcaagaggctggccctggccgagaagagcaaggaggccctgacagaggagatgaagctggccagccagaacatcagccggctgcaggatgagctgaccaccaccaagaggagctatgaggaccagctgtccatgatgtctgaccacctgtgcagcatgaatgagaccctgagcaagcagcgggaggagattgacaccctgaagatgagcagcaaaggaaacagcaagaagaacaagagcaggtag

SEQ ID NO: 41567 - DNA, 465 bp, Artificial Sequence
  Description of Artificial Sequence: Synthetic coding sequence
atgcccagcaggacagcccgctatgcccgctacagcccccggcagaggagaagaaggatgctggccgacagatctgtgcgcttccccaatgatgtgctcttcctggaccacatccggcagggcgacctggagcaggtgggccgcttcatccgcaccaggaaggtgtccctggccaccatccaccccagcggcctggccgccctgcatgaagctgtgctgagcggcaacctggagtgtgtgaagctgctggtgaagtacggggctgacatccaccagagagatgaggccggctggacccccctgcacatcgcctgcagtgatggctacccagacatcgcccgctacctgatcagcctgggcgctgacagagatgccaccaatgatgatggagacctgcccagcgacctgattgatcctgactacaaggagctggtggagctgttcaagggcaccaccatggactag

SEQ ID NO: 41568 - DNA, 1278 bp, Artificial Sequence
  Description of Artificial Sequence: Synthetic coding sequence
atgatgggcaagctgcccctgggcgtggtgagcccctacgtgaagatgagcagcggcggctacacagaccccctgaagttctacgccaccagctactgcacagcctacggccgggaggacttcaagccccgggtgggcagccacgtgggcaccggctacaagagcaacttccagcctgtggtgtcctgccaggccagcctggaggccctggacaacccagcccggggggagcaggcccaggaccacttccagagcgtggccagccagagctaccggcccctggaggtgcctgatggcaagcaccccctgccctggagcatgaggcagaccagcagcggctacggccgggagaagcccagcgctggcccccccaccaaggaggtgaggaaggtgcactttgacacccaggagcacggcccccaggccatcaccggcctggagccccgggaggtgcccctgctgcaccagcagcagggccaggaccccctggagcgggagaacttccgccacggcccccgcttcatgaccagcgagtacaacagcaagtacctgcgggaccccctggaccagcctgacttcctgcagaagaagagcattggagccaaggagggcagcggcttcaccaagcagagccaccagagccccatcgtgttccagccccccagccaggccctgcccggggaccctgccctgctgcccggccagagcgtgaccaagagtgacttcctgcccaagacccacctgcatggagatgagttcctgcctgtgctggcccggggcagcaagcgggagacagccttcagcagaggaaatgaaagaatcctgaacccccgggtgcccccaccctgcccagagcccagctctgtgagccaccagcagttccagcccctgcacaggatgcagcagaccaacgtggccctgctgggccgggagaccgtgggcaagaaggagcccaccggcttcagcctgaacaaccccatgtatgtgcgcagcccctgtgaccctgaccgggaccagcgctacctgaccacctacaaccagggctactttgagaacatccccaagggcctggaccaggagggctggacccggggcggcatccagccccagatgcctgggggctacgccctgagccagcctgtgtcctgcatggaggccacccccaaccccatggagagcctgcggcacctgcacccccacgtgggccgcaccctgaccagcgctgaccccttctaccagaacaccccccacagcagccgctgtgtggcccacagctag

SEQ ID NO: 41569 - DNA, 1218 bp, Artificial Sequence
  Description of Artificial Sequence: Synthetic coding sequence
atgatgggcaagctgcccctgggcgtggtgagcccctacgtgaagatgagcagcggcggctacacagaccccctgaagttctacgccaccagctactgcacagcctacggccgggaggacttcaagccccgggtgggcagccacgtgggcaccggctacaagagcaacttccagcctgtggtgtcctgccaggccagcctggaggccctggacaacccagcccggggggagcaggcccaggaccacttccagagcgtggccagccagagctaccggcccctggaggtgcctgatggcaagcaccccctgccctggagcatgaggcagaccagcagcggctacggccgggagaagcccagcgctggcccccccaccaaggaggtgaggaaggtgcactttgacacccaggagcacggcccccaggccatcaccggcctggagccccgggaggtgcccctgctgcaccagcagcagggccaggaccccctggagcgggagaacttccgccacggcccccgcttcatgaccagcgagtacaacagcaagtacctgcgggaccccctggaccagcctgacttcctgcagaagaagagcattggagccaaggagggcagcggcttcaccaagcagagccaccagagccccatcgtgttccagccccccagccaggccctgcccggggaccctggagatgagttcctgcctgtgctggcccggggcagcaagcgggagacagccttcagcagaggaaatgaaagaatcctgaacccccgggtgcccccaccctgcccagagcccagctctgtgagccaccagcagttccagcccctgcacaggatgcagcagaccaacgtggccctgctgggccgggagaccgtgggcaagaaggagcccaccggcttcagcctgaacaaccccatgtatgtgcgcagcccctgtgaccctgaccgggaccagcgctacctgaccacctacaaccagggctactttgagaacatccccaagggcctggaccaggagggctggacccggggcggcatccagccccagatgcctgggggctacgccctgagccagcctgtgtcctgcatggaggccacccccaaccccatggagagcctgcggcacctgcacccccacgtgggccgcaccctgaccagcgctgaccccttctaccagaacaccccccacagcagccgctgtgtggcccacagctag

SEQ ID NO: 41570 - DNA, 762 bp, Artificial Sequence
  Description of Artificial Sequence: Synthetic coding sequence
atgatgatgggctgtggggagagcgagctgaagtctgcagatggagaggaggccgctgctgtgcccggccccccacctgagccccaggtgccccagctgcgggcccctgtgcctgagcccggcctggacctgagcctgagccccaggccagacagcccccagcccaggcatggcagccctggccgcaggaagggccgggcagagaggagaggagctgcccggcagaggcggcaggtgcgcttccggctgaccccacccagccctgtgcgctctgagccccagcctgctgtgccccaggagctggagatgcctgtgctgaagagcagcctggccctgggcctggagctgcgggctgctgctggcagccactttgatgctgccaaggctgtggaggagcagctgaggaagagcttccagatccgctgtggcctggaggagagcgtgtctgagggcctgaatgtgcccaggagcaagaggctcttccgggacctggtgtccctgcaggtgcctgaggagcaggtgctgaatgctgccctgcgggagaagctggccctgctgcccccccaggcccgggccccccaccccaaggagcccccaggccctggccctgacatgaccatcctgtgtgaccctgagaccctcttctatgagagcccccacctgaccctggatggcctgccccccctgcggctgcagctgcggccccggcccagcgaggacaccttcctgatgcacaggaccctgcggcgctgggaggcctag

SEQ ID NO: 41571 - DNA, 1269 bp, Artificial Sequence
  Description of Artificial Sequence: Synthetic coding sequence
atgtacagagtgcctgagttctacgcccggaggaagaggctgggcggccagaccccctacctgatggaccagctgggcctgcggctgggcatgtggtactggaaggatgagaccaggaccctggagttccgccgctttgctgctgaagattctgtgcagtggctgctgaagcaccacccccacttcaccccagctgctgaggtgaaggagaagggcaagaagggcaaggctgtgcactttgctgagacagatggccctgccagtgaccggctgacagacaagaggctggccgccaaggatgacaagagcgccaaggctgtggagaagaggggccagcagggcaccatcaccctggatgatgtgaagtttgtgaccctgctgctgctgcaggacacagagatgcagaggatctgcagcttcaccaccttcatgaggaacaagaacctggacaacttcctgatggccctgctgtactacctgagccactacctggagaagaacagcctggagaagaagcccaagagctacatggtgggcctggtggagaagaaggagatggagctggtgctgtctgagctggaggccgcccagcgctacctggcccagaagtactgcatcctggtgctgggcctggccgtgcctgacaagcaccacatgtgctgcggcaaggagaagatcagtgacacccagaaggactggaagttctttgagagcttctacaccttctgcacctacgtggcctggatcgtgttccggcggcagcacctgacagaaattgaggaggaggtgggccgcctcttccgcaccaacatgttcaacatccccaggagaagaagagaagatgaggagagcggcggggagaagaagaggatgacctttgtgcagttccggaggatgatggccaagaggcctgccatcaagaaggccatcaacatgaggagccctgtgatgagcaccctgctgcccagcctgcgggagaaggcccagaatgtgtttgagaagaagtaccaccaggtggatgtgcgcttccctgctgagatgcagaagcacgtgggcaccctggacagcgtgcccatgcctgtggtgggcatcctgggggagccccgctgcctcttcaacccccacaccctgcaccccctggaccctgaggagaacaccaagagctttggccgctaccccagcctgatggagaacaacaacatgaggatccaggacaccctggacctggtgatgaagaccctgagcagccacaccagctgccccaagtag

SEQ ID NO: 41572 - DNA, 624 bp, Artificial Sequence
  Description of Artificial Sequence: Synthetic coding sequence
atggccgccctggtggagcccctgggcctggagagagatgtgtccagagctgtggagctgctggagcggctgcagaggtctggagagctgcccccccagaagctgcaggccctgcagagggtgctgcagagccgcttctgcagcgccatccgggaggtgtatgagcagctgtatgacaccctggacatcaccggcagcgctgagatccgggcccacgccacagccaaggccaccgtggccgccttcaccgccagcgagggccacgcccacccccgggtggtggagctgcccaagacagatgagggcctgggcttcaacatcatgggcggcaaggagcagaacagccccatctacatcagcagggtcatccctgggggcgtggccgacagacatggaggcctgaagagaggagaccagctgctgtctgtgaatggagtgtctgtggagggggagcagcacgagaaggctgtggagctgctgaaggccgcccagggctctgtgaagctggtggtgcgctacaccccccgggtgctggaggagatggaggccaggtttgagaagatgaggtctgcccggcggcggcagcagcaccagagctacagcagcctggagagccggggctag

SEQ ID NO: 41573 - DNA, 2064 bp, Artificial Sequence
  Description of Artificial Sequence: Synthetic coding sequence
atggagatcgccccccaggaggcccctcctgtgcctggagcagatggagacatcgaggaggccccagctgaggccggcagccccagccctgccagccccccagcagatggccgcctgaaggccgccgccaagagggtgaccttccccagtgatgaggacatcgtgtctggagctgtggagcccaaggacccctggaggcatgcccagaatgtgacagtggatgaggtgattggagcctacaagcaggcctgccagaagctgaactgccggcagatccccaagctgctgcggcagctgcaggagttcacagacctgggccaccggctggactgcctggacctgaagggggagaagctggactacaagacctgtgaggccctggaggaggtgttcaagaggctgcagttcaaggtggtggacctggagcagaccaacctggatgaagatggagccagcgccctgtttgacatgattgagtactatgaaagtgccacccacctgaacatctccttcaacaagcacatcggcacccggggctggcaggccgccgcccacatgatgaggaagaccagctgcctgcagtacctggatgccaggaacacccccctgctggaccacagcgccccctttgtggcccgggccctgcgcatccgcagcagcctggccgtgctgcacctggagaatgccagcctgagcggccggcccctgatgctgctggccacagccctgaagatgaacatgaacctgcgggagctgtacctggccgacaacaagctgaatggcctgcaggacagcgcccagctgggcaacctgctgaagttcaactgcagcctgcagatcctggacctgaggaacaaccacgtgctggacagcggcctggcctacatctgtgagggcctgaaggagcagaggaagggcctggtgaccctggtgctgtggaacaaccagctgacccacacaggcatggccttcctgggcatgaccctgagcctggagaccctgaacctgggccacaaccccatcggaaatgaaggagtgcgccacctgaagaatggcctcatcagcaacagatctgtgctgcggctgggcctggccagcaccaagctgacctgtgagggcgctgtggccgtggccgagttcatcgccgagagcccccggctgctgcggctggacctgcgggagaatgagatcaagacaggaggcctgatggccctgagcctggccctgaaggtgaaccacagcctgctgcggctggacctggaccgggagcccaagaaggaggccgtgaagagcttcatcgagacccagaaggccctgctggccgagatccagaatggctgcaagaggaacctggtgctggcccgggagcgggaggagaaggagcagcccccccagctgagcgcctccatgcctgagaccacagccacagagccccagccagatgatgagcctgctgctggggtgcagaatggagcccccagccctgcccccagcccagacagcgacagcgacagcgacagtgatggagaggaggaggaggaggaggagggggagagagatgagaccccctgcccagccctggtgcccccaacagacagcctgggccctggggacaggagccccccaggcagccccagcacccccacagagcagaggatctctgtgagcagccctggccggggccacaaggtgtttgtggtgaccagggtggagagccccccagagagagctgagcccccagccagccccaccccacccagccccccacctccacccagccccccagccagccccagcctgcccccagctggggccatcgacacccgggacaccggcagcagcgagccccagcccccacctgagccccccaggagcggcccccccctgcccaacggcctgaagccagagtttgccctggccctgcccccagagcccccacctggccctgaggtgaagggcggcagctgtggcctggagcacgagctgagctgcagcaagaatgagaaggagctggaggagctgctgctggaggccagccaggagagcggccaggagaccctgtag

SEQ ID NO: 41574 - DNA, 858 bp, Artificial Sequence
  Description of Artificial Sequence: Synthetic coding sequence
atgatggctgtggacatcgagtaccgctacaactgcatggcccccagcctgcggcaggagagatttgccttcaagatcagccccaagcccagcaagcccctgcggccctgcatccagctgagcagcaagaatgaggccagcggcatggtggccccagctgtgcaggagaagaaggtgaagaagagggtgtcctttgctgacaaccagggcctggccctgaccatggtgaaggtgttcagcgagtttgatgaccccctggacatgcccttcaacatcacagagctgctggacaacatcgtgtccctgaccacagctgagagcgagagctttgtgctggacttcagccagcccagcgctgactacctggacttcaggaaccggctgcaggccgaccacgtgtgcctggagaactgtgtgctgaaggacaaggccatcgccggcaccgtgaaggtgcagaacctggcctttgagaagacagtgaagatccgcatgacctttgacacctggaagagctacacagacttcccctgccagtatgtgaaggacacctacgccggcagtgaccgggacaccttctcctttgacatcagcctgcctgagaagatccagagctatgaaagaatggagtttgctgtgtactatgaatgtaatggccagacctactgggacagcaacagaggcaagaactaccgcatcatccgggcagagctgaagagcacccagggcatgaccaagccccacagcggccctgacctgggcatcagctttgaccagtttggcagcccccgctgcagctatggcctcttccctgagtggcccagctacctgggctatgagaagctgggcccctactactag

SEQ ID NO: 41575 - DNA, 858 bp, Artificial Sequence; identical to SEQ ID NO: 41574
  Description of Artificial Sequence: Synthetic coding sequence

SEQ ID NO: 41576 - DNA, 687 bp, Artificial Sequence
  Description of Artificial Sequence: Synthetic coding sequence
atggtgcggctgaccctggacctgattgccaggaacagcaacctgaagcccaggaaggaggagaccatcagccagtgcctgaagaagatcacccacatcaacttcagtgacaagaacattgatgccatcgaggacctgagcctgtgcaagaacctgtctgtgctgtacctgtatgacaactgcatcagccagatcaccaacctgaactatgccaccaacctgacccacctgtacctgcagaacaactgcatcagctgcatcgagaacctgcggagcctgaagaagctggagaagctgtacctgggcggcaactacatcgctgtgattgagggcctggagggcctgggggagctgcgggagctgcacgtggagaaccagaggctgcccctgggggagaagctgctgtttgaccccaggaccctgcacagcctggccaagagcctgtgcatcctgaacatcagcaacaacaacattgatgacatcacagacctggagctgctggagaacctgaaccagctgattgctgtggacaaccagctgctgcacgtgaaggacctggagttcctgctgaacaagctgatgaagctgtggaagattgacctgaatggaaatcctgtgtgcctgaagcccaagtacagagacaggctcatcctggtgtccaagagcctgggcacctacctgtactag

SEQ ID NO: 41577 - DNA, 1068 bp, Artificial Sequence
  Description of Artificial Sequence: Synthetic coding sequence
atggtgcggctgaccctggacctgattgccaggaacagcaacctgaagcccaggaaggaggagaccatcagccagtgcctgaagaagatcacccacatcaacttcagtgacaagaacattgatgccatcgaggacctgagcctgtgcaagaacctgtctgtgctgtacctgtatgacaactgcatcagccagatcaccaacctgaactatgccaccaacctgacccacctgtacctgcagaacaactgcatcagctgcatcgagaacctgcggagcctgaagaagctggagaagctgtacctgggcggcaactacatcgctgtgattgagggcctggagggcctgggggagctgcgggagctgcacgtggagaaccagaggctgcccctgggggagaagctgctgtttgaccccaggaccctgcacagcctggccaagagcctgtgcatcctgaacatcagcaacaacaacattgatgacatcacagacctggagctgctggagaacctgaaccagctgattgctgtggacaaccagctgctgcacgtgaaggacctggagttcctgctgaacaagctgatgaagctgtggaagattgacctgaatggaaatcctgtgtgcctgaagcccaagtacagagacaggctcatcctggtgtccaagagcctggagttcctggatggcaaggagatcaagaacatcgagcggcagttcctgatgaactggaaggccagcaaggatgccaagaagatcagcaagaagaggagcagcaagaatgaagatgccagcaacagcctcatcagcaacttcaagaccatgcaccacatcgtgcctgtgtactacccccaggtgggcaagcccaagctggccttcttcagcgagatccagcgctaccctgtgaatgccaatgccagccctgagagcagctgccccttctggcccaacatcgagaggaagaacctgagcctgaagcagagcgagagcctgctgaccaagaatgatgtgcatgagccccacctgttccacaaccctgaggagaaggagaacctgtttgtggagaatgaatag

SEQ ID NO: 41578 - DNA, 930 bp, Artificial Sequence
  Description of Artificial Sequence: Synthetic coding sequence
atggtgcggctgaccctggacctgattgccaggaacagcaacctgaagcccaggaaggaggagaccatcagccagtgcctgaagaagatcacccacatcaacttcagtgacaagaacattgatgccatcgaggacctgagcctgtgcaagaacctgtctgtgctgtacctgtatgacaactgcatcagccagatcaccaacctgaactatgccaccaacctgacccacctgtacctgcagaacaactgcatcagctgcatcgagaacctgcggagcctgaagaagctggagaagctgtacctgggcggcaactacatcgctgtgattgagggcctggagggcctgggggagctgcgggagctgcacgtggagaaccagaggctgcccctgggggagaagctgctgtttgaccccaggaccctgcacagcctggccaagagcctgtgcatcctgaacatcagcaacaacaacattgatgacatcacagacctggagctgctggagaacctgaaccagctgattgctgtggacaaccagctgctgcacgtgaaggacctggagttcctgctgaacaagctgatgaagctgtggaagattgacctgaatggaaatcctgtgtgcctgaagcccaagtacagagacaggctcatcctggtgtccaagagcctggagttcctggatggcaaggagatcaagaacatcgagcggcagttcctgatgaactggaaggccagcaaggatgccaagaagatcagcaagaagaggagcagcaagaatgaagatgccagcaacagcctcatcagcaacttcaagaccatgcaccacatcgtgcctgtgtactacccccaggtgggcaagcccaagctggccttcttcagcgagatccagcgctaccctgtgaatgccaatgccagccctgagagcagctag

SEQ ID NO: 41579 - DNA, 1245 bp, Artificial Sequence
  Description of Artificial Sequence: Synthetic coding sequence
atggacatcgaggagcagaaggctgacatctatgagatgggcaagatcgccaaggtgtgtggctgccccctgtactggaaggcccccatgttccgggccgccggcggggagaagacaggctttgtgacagcccagagcttcatcgccatgtggaggaagctgctgaacaaccaccatgatgatgccagcaagttcatctgcctgctggccaagcccaactgcagcagcctggagcaggaggacttcatccccctgctgcaggatgtggtggacacccaccctggcctgaccttcctgaaggatgcccctgagttccacagccgctacatcaccaccgtcatccagaggatcttctacacagtgaacagatcctggagcggcaagatcaccagcacagagatcaggaagagcaacttcctgcagaccctggccctgctggaggaggaggaggacatcaaccagatcacagactacttctcctatgagcacttctacgtgatctactgcaagttctgggagctggacacagaccatgacctgtacatcagccaggccgacctgagccgctacaatgaccaggccagcagcagccgcatcatcgagcgcatcttctctggagctgtgacccggggcaagaccatccagaaggagggccgcatgtcctatgctgactttgtgtggttcctgatcagcgaggaggacaagaggaaccccaccagcattgagtactggttccgctgcatggatgtggatggagatggagtgctgtccatgtatgagctggagtacttctatgaggagcagtgtgagaggatggaggccatgggcatcgagcccctgcccttccatgacctgctgtgccagatgctggacctggtgaagccagctgtggatggcaagatcaccctgcgggacctgaagcgctgcaggatggcccacatcttctatgacaccttcttcaacctggagaagtacctggaccacgagcagagggacccctttgctgtgcagaaggatgtggagaatgatggccctgagcccagcgactgggacagatttgctgctgaggagtatgagaccctggtggccgaggagagcgcccaggcccagttccaggagggctttgaggactatgaaacagatgagcccgccagccccagcgagtttggaaacaagagcaacaagatcctgagcgccagcctgcctgagaagtgtgggaagctgcagagcgtggatgaggagtag

SEQ ID NO: 41580 - DNA, 3453 bp, Artificial Sequence
  Description of Artificial Sequence: Synthetic coding sequence
atggccgccacctaccgcctggtggtgtccacagtgaaccactacagctctgtggtgattgacagaagatttgagcaggccatccactactgcaccggcacctgccacaccttcacccacggcatcgactgcatcgtggtgcaccacagcgtgtgtgccgacctgctgcacatccctgtgtcccagttcaaggatgctgacctgaacagcatgttcctgccccatgaaaatggcctgagcagcgctgagggggactacccccagcaggccttcaccggcatcccccgggtgaagaggggcagcaccttccagaacacctacaacctgaaggacattgctggggaggccatcagctttgccagcggcaagatcaaggagttctcctttgagaagctgaagaacagcaaccacgccgcctacaggaagggcaggaaggtgaagagtgacagcttcaacagaagatctgtggacctggacctgctgtgtggccactacaacaatgatggaaatgcccccagctttggcctgctgcggagcagctctgtggaggagaagcccctgagccacaggaacagcctggacaccaacctgacctccatgttcctgcagaacttcagcgaggaggacctggtgacccagatcctggagaagcacaagattgacaacttcagcagcggcacagacatcaagatgtgcctggacatcctgctgaagtgcagcgaggacctgaagaagtgcacagacatcatcaagcagtgcatcaagaagaagagcggcagcagcatcagcgagggcagcggaaatgacaccatcagcagcagcgagaccgtgtacatgaatgtgatgacccggctggccagctacctgaagaagctgccctttgagttcatgcagagcggcaacaatgaggccctggacctgacagagctgatcagcaacatgcccagcctgcagctgacccccttcagccctgtgtttggaacagagcagccccccaagtatgaagatgtggtgcagctgagcgccagtgacagcggccgcttccagaccatcgagctgcagaatgacaagcccaacagcaggaagatggacacagtgcagagcatccccaacaacagcaccaacagcctgtacaacctggaggtgaatgaccccaggaccctgaaggctgtgcaggtgcagagccagagcctgaccatgaaccccctggagaatgtgtccagtgatgacctgatggagaccctgtacatcgaggaggagagtgatggcaagaaggccctggacaagggccagaagacagaaaatggccccagccatgagctgctgaaggtgaatgagcacagagctgagttccctgagcacgccacccacctgaagaagtgccccacccccatgcagaatgaaattggcaagatctttgagaagagctttgtgaacctgcccaaggaggactgcaagagcaaggtgtccaagtttgaggagggggaccagagggacttcaccaacagcagcagccaggaggagattgacaagctgctgatggacctggagagcttcagccagaagatggagaccagcctgcgggagcccctggccaagggcaagaacagcaacttcctgaacagccacagccagctgaccggccagaccctggtggacctggagcccaagagcaaggtgagcagccccatcgagaaggtgagccccagctgcctgacccgcatcatcgagaccaacggccacaagattgaggaggaggaccgggccctgctgctgcgcatcctggagagcattgaagattttgcccaggagctggtggagtgcaagagcagccggggcagcctgagccaggagaaggagatgatgcagatcctgcaggagaccctgaccaccagcagccaggccaacctgtctgtgtgccgcagccctgtgggggacaaggccaaggacaccaccagcgctgtgctgatccagcagaccccagaggtgatcaagatccagaacaagccagagaagaagccaggcacccccctgcccccaccagccaccagccccagcagcccccggcccctgagccctgtgccccacgtgaacaacgtggtgaatgcccccctgagcatcaacatcccccgcttctacttccctgagggcctgcctgacacctgcagcaaccacgagcagaccctgagccgcatcgagacagccttcatggacatcgaggagcagaaggctgacatctatgagatgggcaagatcgccaaggtgtgtggctgccccctgtactggaaggcccccatgttccgggccgccggcggggagaagacaggctttgtgacagcccagagcttcatcgccatgtggaggaagctgctgaacaaccaccatgatgatgccagcaagttcatctgcctgctggccaagcccaactgcagcagcctggagcaggaggacttcatccccctgctgcaggatgtggtggacacccaccctggcctgaccttcctgaaggatgcccctgagttccacagccgctacatcaccaccgtcatccagaggatcttctacacagtgaacagatcctggagcggcaagatcaccagcacagagatcaggaagagcaacttcctgcagaccctggccctgctggaggaggaggaggacatcaaccagatcacagactacttctcctatgagcacttctacgtgatctactgcaagttctgggagctggacacagaccatgacctgtacatcagccaggccgacctgagccgctacaatgaccaggccagcagcagccgcatcatcgagcgcatcttctctggagctgtgacccggggcaagaccatccagaaggagggccgcatgtcctatgctgactttgtgtggttcctgatcagcgaggaggacaagaggaaccccaccagcattgagtactggttccgctgcatggatgtggatggagatggagtgctgtccatgtatgagctggagtacttctatgaggagcagtgtgagaggatggaggccatgggcatcgagcccctgcccttccatgacctgctgtgccagatgctggacctggtgaagccagctgtggatggcaagatcaccctgcgggacctgaagcgctgcaggatggcccacatcttctatgacaccttcttcaacctggagaagtacctggaccacgagcagagggacccctttgctgtgcagaaggatgtggagaatgatggccctgagcccagcgactgggacagatttgctgctgaggagtatgagaccctggtggccgaggagagcgcccaggcccagttccaggagggctttgaggactatgaaacagatgagcccgccagccccagcgagtttggaaacaagagcaacaagatcctgagcgccagcctgcctgagaagtgtgggaagctgcagagcgtggatgaggagtag

SEQ ID NO: 41581 - DNA, 1590 bp, Artificial Sequence
  Description of Artificial Sequence: Synthetic coding sequence
atgatgatcaaggagaccagcctgcggcgggaccctgacctgcggggggagctggccttcctggcccggggctgtgactttgtgctgcccagccgcttcaagaagaggctgaagagcttccagcagacccagatccagaacaagccagagaagaagccaggcacccccctgcccccaccagccaccagccccagcagcccccggcccctgagccctgtgccccacgtgaacaacgtggtgaatgcccccctgagcatcaacatcccccgcttctacttccctgagggcctgcctgacacctgcagcaaccacgagcagaccctgagcagaattgaaacagccttcatggacatcgaggagcagaaggctgacatctatgagatgggcaagatcgccaaggtgtgtggctgccccctgtactggaaggcccccatgttccgggctgctggaggagagaagacaggctttgtgacagcccagagcttcatcgccatgtggaggaagctgctgaacaaccaccatgatgatgccagcaagttcatctgcctgctggccaagcccaactgcagcagcctggagcaggaggacttcatccccctgctgcaggatgtggtggacacccaccctggcctgaccttcctgaaggatgcccctgagttccacagccgctacatcaccaccgtcatccagaggatcttctacacagtgaacagatcctggagcggcaagatcaccagcacagagatcaggaagagcaacttcctgcagaccctggccctgctggaggaggaggaggacatcaaccagatcacagactacttctcctatgagcacttctacgtgatctactgcaagttctgggagctggacacagaccatgacctgtacatcagccaggccgacctgagccgctacaatgaccaggccagcagcagccgcatcatcgagcgcatcttcagcggggctgtgacccggggcaagaccatccagaaggagggccgcatgtcctatgctgactttgtgtggttcctgatcagcgaggaggacaagaggaaccccaccagcattgagtactggttccgctgcatggatgtggatggagatggagtgctgtccatgtatgagctggagtacttctatgaggagcagtgtgagaggatggaggccatgggcatcgagcccctgcccttccatgacctgctgtgccagatgctggacctggtgaagccagctgtggatggcaagatcaccctgcgggacctgaagcgctgcaggatggcccacatcttctatgacaccttcttcaacctggagaagtacctggaccacgagcagagggacccctttgctgtgcagaaggatgtggagaatgatggccctgagcccagcgactgggacagatttgctgctgaggagtatgagaccctggtggccgaggagagcgcccaggcccagttccaggagggctttgaagattatgaaacagatgagcccgccagccccagcgagtttggaaacaagagcaacaagatcctgagcgccagcctgcctgagaagtgtgggaagctgcagagcgtggatgaggagtag

SEQ ID NO: 41582 - DNA, 486 bp, Artificial Sequence
  Description of Artificial Sequence: Synthetic coding sequence
atggacatcgaggagcagaaggctgacatctatgagatgggcaagatcgccaaggtgtgtggctgccccctgtactggaaggcccccatgttccgggccgccggcggggagaagacaggctttgtgacagcccagagcttcatcgccatgtggaggaagctgctgaacaaccaccatgatgatgccagcaagttcatctgcctgctggccaagcccaactgcagcagcctggagcaggaggacttcatccccctgctgcaggatgtggtggacacccaccctggcctgaccttcctgaaggatgcccctgagttccacagccgctacatcaccaccgtcatccagaggatcttctacacagtgaacagatcctggagcggcaagatcaccagcacagagatcaggaagagcaacttcctgcagagcaatgaagacctggccaagctggccgtgcatgatggctacaccaacatcttcctgttctag

SEQ ID NO: 41583 - DNA, 1893 bp, Artificial Sequence
  Description of Artificial Sequence: Synthetic coding sequence
atgagcaccaacaatgccctgcgggtcttctggaagagccgggagtggaacatgaagaccagcacctttgacagtgatgaggacatcctgctgctgcccaagaggaagcgcttcaggaagaagaagagcaggcctgtgcgccacaccaagagacatgaggaggagcaggtgtatgagcagggcaccaccctgccctgcagcatctgcaagcatgaaattgacctgaccggcatcttcctgcacaagaagcagcacgtggccctggccaccctgggcttccagtggatgggcaggaagaagccccagcccagcgtgattgctgtgcagaggcagttcatgatcagcaagctgctgagcagcttcatgttcacagagaagaccctgcagagcatcaacaatgcctttgagctgctgtggaagaagcagatcccagcctactacaagatctttgacaacatcgacaggagcgtcatctacagccagaagatctgccacctgctgatcaagggcgtgggcatctgtgaagatagaaacagcacctggaaggctgacatgaatgacaagttcaccgtggtgagcaactttggaaacaagcccaacgtgtgcttcttcggcctgtttgatggccaccacggggccagcgctgctgagctgacctccatggagctgcctgtgctgctgctgcaccagctgagcaagtttgaccccagctaccagatgaccacagatgagcagcagatcatcaacagcttctacacagtgttccgggaggagtatgctgccattgaagatctcttcagcgccatcaacaagacagaggccgtgcgctgtgaatatgaggacacccacaaggcctttgccaaggccttctggaggatggaccggctgctgggcctgggcaggaaggaggtgtcccgggtgcagtggagcggctgcagcgctgtgacctgcatcctggagggcaagcccaagagcccctatgcccacaagaactggaagaggaagaacacccatgatggcctggccgagagcagccccagccaggagatgcccaagatcatcagcggcatcctgcacgtggccaacacaggaaatgtgcaggccgtgctgtgcagaaatggcaagggcttctgcctgaccaaggagcacaccaccaggaacaccaatgaaagaagacgcatcctgcagaatggagctgtgatcagcagcaatgagccctacggcctggtggagggccaggtgaagaccacccggggcctgggcttccacggcaacctgaagctgaagaagagcatcatcccagccccccagaccatctctgtgcccattgatgacctgtgccagttcctgattgtggccaccaacggcctgtgggaggtgctggacaaggaggaggtgacagccctggccatgaccaccttccacatgtacaaggagacctactgccccatcatccccaacaagagccccagcaagggccccctgctcttcagcaccagcgagcccaacctgaccaagagccagagcaacatccacgtgctcttccagtacaagtctgtgtctgaggtgcgggtgtccaccaccaacagcaaggagaacctgagtgacagcaactacagcaagtactgcatctacaacccagaaaatgtggagaccttccctgctgagaccacccacaggaagccctgcagcgagaaggtgacagaccggcccacctctgtgaatgatgtggccaccaatgagaaggagagtgacaccaagagcttctatgagggcgctgctgaatatgtgtcccatgagctggtgaatgctgccctgctggccggcagccgggacaacatcaccgtgatggtgatcttcctgaatggcagcgagtaccagctgctgacctag

SEQ ID NO: 41584 - DNA, 1248 bp, Artificial Sequence
  Description of Artificial Sequence: Synthetic coding sequence
atggccgagatccccctgtactttgtggacctgcaggatgacctggatgattatggctttgaagattatggaacagactgtgacaacatgagggtgacagccttcctggacatccctggccaggacaacctgccccccctgacccggctggagaagtatgccttcagcgagaacaccttcaaccggcagatcatcgcccggggcctgctggacatcttccgggactttggaaataatgaggaggacttcctgactgtgatggagatcgtggtgcggctgtctgaagatgctgagcccaccgtgaggacagagctgatggagcagatcccccccatcgccatcttcctgcaggagaacagaagcaacttccctgtggtgctgtctgagtacctgatccccatcgtggtgcgctacctgacagaccccaacaaccagatcatctgcaagatggcctccatgctgagcaagagcacagtggagcggctgctgctgccccgcttctgtgagctgtgtggggacaggaagctgttccaggtgaggaaggtgtgtgccgccaactttggagacatctgccacgctgtgggccaggaggccacagagaagttcctgatccccaagttctttgagctgtgcagtgatgctgtgtggggcatgaggaaggcctgtgccgagtgcttcaccgctgtgagccacagcagcagccctggggtgcggaggacccagctgttccccctcttcatccggctggtgtctgacccctgccgctgggtgcaccaggccgccttccagagcctgggccccttcaccagcacctttgccaaccccagccgggccggcctgtacctgcgggaggatggagccctgagcatctggcccctgacccaggacctggacagcggctttgccagcggcagccctgcccccagcagcggcggcaacaccagccctgccagcctgaccaggtctgccaagcctgtgcgctctgagcctgagctgcctgtggagggcaccagcgccaagaccagtgactgcccccacagcagcagcagcagtgatggccctgctgagagccctgtggagagctgtgtgtctgctggagctgagtggaccagggtgtccccagagaccagcgcctgcagcaagctgagtgacatgaatgacctgcccatcagcagctacccaggcagtgacagctgggcctgccccggcaacacagaagatgtgttcagccacttcctgtactggtag

SEQ ID NO: 41585 - DNA, 1365 bp, Artificial Sequence
  Description of Artificial Sequence: Synthetic coding sequence
atgagcagcggggccccccagaagagcagccccatggccagcggggctgaggagaccccaggcttcctggacaccctgctgcaggacttccctgccctgctgaaccctgaggaccccctgccctggaaggcccctggcaccgtgctgagccaggaggaggtggagggggagctggccgagctggccatgggcttcctgggcagcaggaaggcccccccacccctggccgccgccctggcccatgaagctgtgtcccagctgctgcagacagacctgtctgagttcaggaagctgccccgggaggaggaggaggaggaggaggatgatgatgaggaggagaaggcccctgtgaccctgctggatgcccagagcctggcccagagcttcttcaaccggctgtgggaggtggccggccagtggcagaagcaggtgcccctggccgcccgggccagccagaggcagtggctggtgtccatccacgccatccggaacaccaggaggaagatggaggacagacatgtgtccctgcccagcttcaaccagctgtttggcctgagtgaccctgtgaacagagcctactttgctgtgtttgatggccacggcggcgtggatgctgcccgctatgctgctgtgcacgtgcacaccaatgctgcccggcagcctgagctgcccacagatcctgagggcgccctgcgggaggccttccggaggacagaccagatgttcctgaggaaggccaagcgggagcggctgcagagcggcaccaccggggtgtgtgccctgattgctggggccaccctgcacgtggcctggctgggggacagccaggtgatcctggtgcagcagggccaggtggtgaagctgatggagccccacaggcctgagcggcaggatgagaaggccagaattgaggccctgggcggctttgtgagccacatggactgctggagggtgaatggcaccctggccgtgtcccgggccatcggagatgtgttccagaagccctacgtgtctggagaggctgatgctgccagccgggccctgactggaagtgaggactacctgctgctggcctgtgatggcttctttgatgtggtgccccaccaggaggtggtgggcctggtgcagagccacctgacccggcagcagggcagcggcctgcgggtggccgaggagctggtggccgccgcccgggagcggggcagccatgacaacatcaccgtgatggtggtgttcctgcgggacccccaggagctgctggagggcggcaaccagggcgagggggacccccaggccgagggccggcggcaggacctgcccagcagcctgcctgagcctgagacccaggccccacccaggagctag

SEQ ID NO: 41586 - DNA, 1086 bp, Artificial Sequence
  Description of Artificial Sequence: Synthetic coding sequence
atgagcagcggggccccccagaagagcagccccatggccagcggggctgaggagaccccaggcttcctggacaccctgctgcaggacttccctgccctgctgaaccctgaggaccccctgccctggaaggcccctggcaccgtgctgagccaggaggaggtggagggggagctggccgagctggccatgggcttcctgggcagcaggaaggcccccccacccctggccgccgccctggcccatgaagctgtgtcccagctgctgcagacagacctgtctgagttcaggaagctgccccgggaggaggaggaggaggaggaggatgatgatgaggaggagaaggcccctgtgaccctgctggatgcccagagcctggcccagagcttcttcaaccggctgtgggaggtggccggccagtggcagaagcaggtgcccctggccgcccgggccagccagaggcagtggctggtgtccatccacgccatccggaacaccaggaggaagatggaggacagacatgtgtccctgcccagcttcaaccagctgtttggcctgagtgaccctgtgaacagagcctactttgctgtgtttgatggccacggcggcgtggatgctgcccgctatgctgctgtgcacgtgcacaccaatgctgcccggcagcctgagctgcccacagatcctgagggcgccctgcgggaggccttccggaggacagaccagatgttcctgaggaaggccaagcgggagcggctgcagagcggcaccaccggggtgtgtgccctgattgctggggccaccctgcacgtggcctggctgggggacagccaggtgatcctggtgcagcagggccaggtggtgaagctgatggagccccacaggcctgagcggcaggatgagaaggccagaattgaggccctgggcggctttgtgagccacatggactgctggagggtgaatggcaccctggccgtgtcccgggccatcggggagagccagaggggccggcccaagtgggagaaggtgtccaggaagccccggccccgggtgtggccagctgcccaccagggcttccgggaggccgtgtag

SEQ ID NO: 41587 - DNA, 861 bp, Artificial Sequence
  Description of Artificial Sequence: Synthetic coding sequence
atggaggacagacatgtgtccctgcccagcttcaaccagctgtttggcctgagtgaccctgtgaacagagcctactttgctgtgtttgatggccacggcggcgtggatgctgcccgctatgctgctgtgcacgtgcacaccaatgctgcccggcagcctgagctgcccacagatcctgagggcgccctgcgggaggccttccggaggacagaccagatgttcctgaggaaggccaagcgggagcggctgcagagcggcaccaccggggtgtgtgccctgattgctggggccaccctgcacgtggcctggctgggggacagccaggtgatcctggtgcagcagggccaggtggtgaagctgatggagccccacaggcctgagcggcaggatgagaaggccagaattgaggccctgggcggctttgtgagccacatggactgctggagggtgaatggcaccctggccgtgtcccgggccatcggagatgtgttccagaagccctacgtgtctggagaggctgatgctgccagccgggccctgactggaagtgaggactacctgctgctggcctgtgatggcttctttgatgtggtgccccaccaggaggtggtgggcctggtgcagagccacctgacccggcagcagggcagcggcctgcgggtggccgaggagctggtggccgccgcccgggagcggggcagccatgacaacatcaccgtgatggtggtgttcctgcgggacccccaggagctgctggagggcggcaaccagggcgagggggacccccaggccgagggccggcggcaggacctgcccagcagcctgcctgagcctgagacccaggccccacccaggagctag

SEQ ID NO: 41588 - DNA, 861 bp, Artificial Sequence; identical to SEQ ID NO: 41587
  Description of Artificial Sequence: Synthetic coding sequence

SEQ ID NO: 41589 - DNA, 1053 bp, Artificial Sequence
  Description of Artificial Sequence: Synthetic coding sequence
atgggcctgtgccccagcacccgggagacagcccccccagctgtgctggatgcccagagcctggcccagagcttcttcaaccggctgtgggaggtggccggccagtggcagaagcaggtgcccctggccgcccgggccagccagaggcagtggctggtgtccatccacgccatccggaacaccaggaggaagatggaggacagacatgtgtccctgcccagcttcaaccagctgtttggcctgagtgaccctgtgaacagagcctactttgctgtgtttgatggccacggcggcgtggatgctgcccgctatgctgctgtgcacgtgcacaccaatgctgcccggcagcctgagctgcccacagatcctgagggcgccctgcgggaggccttccggaggacagaccagatgttcctgaggaaggccaagcgggagcggctgcagagcggcaccaccggggtgtgtgccctgattgctggggccaccctgcacgtggcctggctgggggacagccaggtgatcctggtgcagcagggccaggtggtgaagctgatggagccccacaggcctgagcggcaggatgagaaggccagaattgaggccctgggcggctttgtgagccacatggactgctggagggtgaatggcaccctggccgtgtcccgggccatcggagatgtgttccagaagccctacgtgtctggagaggctgatgctgccagccgggccctgactggaagtgaggactacctgctgctggcctgtgatggcttctttgatgtggtgccccaccaggaggtggtgggcctggtgcagagccacctgacccggcagcagggcagcggcctgcgggtggccgaggagctggtggccgccgcccgggagcggggcagccatgacaacatcaccgtgatggtggtgttcctgcgggacccccaggagctgctggagggcggcaaccagggcgagggggacccccaggccgagggccggcggcaggacctgcccagcagcctgcctgagcctgagacccaggccccacccaggagctag

SEQ ID NO: 41590 - DNA, 3321 bp, Artificial Sequence
  Description of Artificial Sequence: Synthetic coding sequence
atgttcaacagcatgaccccaccacccatcagcagctatggagagccctgctgcctgcggcccctgcccagccagggcgcccccagcgtgggcacagagggcctgagcggcccccccttctgccaccaggccaacctgatgagcggcccccacagctatggccctgcccgggagaccaacagctgcacagagggccccctcttcagcagccccaggtctgctgtgaagctgaccaagaagagggccctgagcatcagccccctgagtgatgccagcctggacctgcagaccgtcatccgcaccagccccagcagcctggtggccttcatcaacagccgctgcaccagccctgggggcagctatggccacctgagcatcggcaccatgagccccagcctgggcttccctgcccagatgaaccaccagaagggccccagccccagctttggagtgcagccctgtggcccccatgattctgcccggggcggcatgatcccccacccccagagccggggccccttccccacctgccagctgaagtctgagctggacatgctggtgggcaaatgtcgggaggagcccctggagggggacatgagcagccccaacagcacaggcatccaggaccccctgctgggcatgctggatggaagagaggacctggagcgggaggagaagcgggagcctgagagcgtgtatgaaacagactgccgctgggatggctgcagccaggagtttgacagccaggagcagctggtgcaccacatcaacagcgagcacatccacggggagaggaaggagtttgtgtgccactggggcggctgcagccgggagctgcggcccttcaaggcccagtacatgctggtggtgcacatgagaagacacactggagagaagccccacaagtgcacctttgagggctgcaggaagagctacagccggctggagaacctgaagacccacctgcggagccacactggagagaagccctacatgtgtgaacatgagggctgcagcaaggccttcagcaatgccagtgaccgggccaagcaccagaacagaacccacagcaatgagaagccctacgtgtgcaagctgcccggctgcaccaagcgctacacagaccccagcagcctgaggaagcacgtgaagacagtgcacggcccagatgcccacgtgaccaagaggcacagaggagatggccccctgccccgggcccccagcatcagcacagtggagcccaagcgggagcgggagggcggccccatccgggaggagagccggctgactgtgcctgagggcgccatgaagccccagcccagccctggggcccagagcagctgcagcagtgaccacagccctgctggcagcgctgccaacacagattctggagtggagatgactggaaatgccggcggcagcacagaggacctgagcagcctggatgagggcccctgcatcgccggcaccggcctgagcaccctgcggcggctggagaacctgcggctggaccagctgcaccagctgcggcccatcggcacccggggcctgaagctgcccagcctgagccacacaggcaccaccgtgtccagaagagtgggcccccctgtgtccctggagaggaggagcagcagcagcagcagcatcagcagcgcctacacagtgtccagaagaagcagcctggccagccccttccccccaggcagccccccagaaaatggagccagcagcctgcccggcctgatgcctgcccagcactacctgctgcgggcccgctatgccagcgcccggggcggcggcaccagccccacagctgccagcagcctggaccgcatcggcggcctgcccatgccaccctggaggagcagagctgagtacccaggctacaaccccaatgctggggtgacccggcgggccagtgaccctgcccaggccgctgacaggcctgccccagcccgggtgcagcgcttcaagagcctgggctgtgtgcacaccccacccaccgtggccggcggcggccagaactttgacccctacctgcccacctctgtgtacagcccccagcccccatccatcacagaaaatgctgccatggatgcccggggcctgcaggaggagcctgaggtgggcacctccatggtgggcagcggcctgaacccctacatggacttccccccaacagacaccctgggctacggcggccctgagggcgctgctgctgagccctatggagcccggggccctggcagcctgcccctgggccctggcccccccaccaactacggccccaacccctgcccccagcaggccagctacccagaccccacccaggagacctggggcgagttccccagccacagcggcctgtacccaggccccaaggccctgggcggcacctacagccagtgcccccggctggagcactacggccaggtgcaggtgaagccagagcagggctgccctgtgggcagtgacagcacaggcctggccccctgcctgaatgcccaccccagcgagggccccccccacccccagcccctcttcagccactacccccagcccagccccccccagtacctgcagagcggcccctacacccagcccccaccagactacctgcccagcgagccccggccctgcctggactttgacagccccacccacagcacaggccagctgaaggcccagctggtgtgcaactacgtgcagagccagcaggagctgctgtgggagggcggcggccgggaggatgccccagcccaggagcccagctaccagagccccaagttcctgggcggcagccaggtgagccccagccgggccaaggcccctgtgaacacctacggccctggcttcggccccaacctgcccaaccacaagagcggcagctaccccacccccagcccctgccacgagaactttgtggtgggcgccaacagagccagccacagagctgctgccccaccccggctgctgccccccctgcccacctgctacggccccctgaaggtgggcggcaccaaccccagctgtggccaccctgaggtgggccgcctgggcggcggccctgccctgtacccacctcctgagggccaggtgtgcaaccccctggacagcctggacctggacaacacccagctggactttgtggccatcctggatgagccccagggcctgagccccccacccagccatgaccagaggggcagcagcggccacaccccaccacccagcggcccccccaacatggctgtgggcaacatgtctgtgctgctgcggagcctgcccggggagacagagttcctgaacagcagcgcctag

SEQ ID NO: 41591 - DNA, 1023 bp, Artificial Sequence
  Description of Artificial Sequence: Synthetic coding sequence
atggaggatgcccactgcacctggctgagcctgcccggcctgcccccaggctgggccctgtttgctgtgctggatggccatggaggagcccgggccgccaggtttggagcccggcacctgcccggccacgtgctgcaggagctgggccctgagcccagcgagcctgagggcgtgcgggaggccctgcggcgggccttcctgtctgcagatgagcggctgcggagcctgtggccccgggtggagaccggcggctgcacagctgtggtgctgctggtgagcccccgcttcctgtacctggcccactgtggggacagcagagctgtgctgagccgggccggggctgtggccttcagcacagaggaccaccggcccctgcggccccgggagcgggagcgcatccatgctgctgggggcaccatcagaagaagaagagtggagggcagcctggccgtgtcccgggccctgggggacttcacctacaaggaggcccctggccggcccccagagctgcagctggtgtctgctgagcctgaggtggccgccctggcccggcaggctgaagatgagttcatgctgctggccagtgatggagtgtgggacacagtgtctggagctgccctggccggcctggtggccagccggctgcggctgggcctggcccctgagctgctgtgtgcccagctgctggacacctgcctgtgcaaggtgctgggcgcctggaggggcaccttcggggcctggtgcagccggggccgggagccccggggctttggagaggagggctttgaccgggaggcccgggtgaagctggccaaggagggcatcggcctgaagagaagagcctggccagaggtgggccgggccaagatccagggccgcagcctgagagatgccctgcggcacggccgggtgtctggccgggacctgcgggagcgggcctggagctttgggaagggccgcttctgggtggtgggcgccggccctgaggtgctgatctctgctggccgctggaagagcaggtag

SEQ ID NO: 41592 - DNA, 1293 bp, Artificial Sequence
  Description of Artificial Sequence: Synthetic coding sequence
atggctgtgctggcccggcagctgcagaggctgctgtggacagcctgcaagaagaaggagcgggagaaggagggccgggaggaggaggaggaggaggaggccggccggcgggcccctgagggccccaggagcctgctgacagccccccggcgggcccagaggccccacggcggcgctgaggccagcggcggcctgcgctttggagccagcgctgcccagggctggagggccaggatggaggatgcccactgcacctggctgagcctgcccggcctgcccccaggctgggccctgtttgctgtgctggatggccatggaggagcccgggccgccaggtttggagcccggcacctgcccggccacgtgctgcaggagctgggccctgagcccagcgagcctgagggcgtgcgggaggccctgcggcgggccttcctgtctgcagatgagcggctgcggagcctgtggccccgggtggagaccggcggctgcacagctgtggtgctgctggtgagcccccgcttcctgtacctggcccactgtggggacagcagagctgtgctgagccgggccggggctgtggccttcagcacagaggaccaccggcccctgcggccccgggagcgggagcgcatccatgctgctgggggcaccatcagaagaagaagagtggagggcagcctggccgtgtcccgggccctgggggacttcacctacaaggaggcccctggccggcccccagagctgcagctggtgtctgctgagcctgaggtggccgccctggcccggcaggctgaagatgagttcatgctgctggccagtgatggagtgtgggacacagtgtctggagctgccctggccggcctggtggccagccggctgcggctgggcctggcccctgagctgctgtgtgcccagctgctggacacctgcctgtgcaagggcagcctggacaacatgacctgcatcctggtgtgcttccctggggccccccggcccagcgaggaggccatccggcgggagctggccctggatgctgccctgggctgcagaattgctgagctgtgtgccagcgcccagaagccacccagcctgaacacagtgttccgcaccctggccagcgaggacatcccagacctgcccccaggcggcggcctggactgcaaggccaccgtgattgctgaggtgtacagccagatctgccaggtgtctgaagaatgtggggagaagggccaggatggagctgggaagagcaaccccacccacctgggcagcgccctggacatggaggcctag

SEQ ID NO: 41593 - DNA, 1209 bp, Artificial Sequence
  Description of Artificial Sequence: Synthetic coding sequence
atggccgagaccagcgaggaggtggccgtgctggtgcagagggtggtgaaggacatcaccaatgccttcagaagaaacccccacattgatgagatcggcctcatcccctgcccagaggcccgctacaacagaagccccatcgtgctggtggagaacaagctgggcgtggagagctggtgtgtgaagttcctgctgccctacgtgcacaacaagctgctgctgtaccgcaccaggaagcagtggctgaacagagatgagctgattgatgtgacctgcaccctgctgctgctgaacccagacttcaccacagcctggaatgtgaggaaggagctgatcctgagcggcaccctgaaccccatcaaggacctgcacctgggcaagctggccctgaccaagttccccaagagccctgagacctggatccaccggcgctgggtgctgcagcagctgatccaggagaccagcctgcccagctttgtgaccaagggcaacctgggcaccatccccacagagcgggcccagaggctcatccaggaggagatggaggtgtgtggggaggccgccggccgctaccccagcaactacaatgcctggagccaccgcatctgggtgctgcagcacctggccaagctggatgtgaagatcctgctggatgagctgagcagcaccaagcactgggcctccatgcacgtgtctgaccacagcggcttccactaccggcagttcctgctgaagagcctcatcagccagacagtgattgacagctctgtgatggagcagaaccccctgcggtctgagcccgccctggtgccccccaaggatgaggaggccgctgtgtccacagaggagccccgcatcaacctgccccacctgctggaggaggaggtggagttcagcacagacctgattgacagctacccaggccacgagaccctgtggtgccaccggcggcacatcttctacctgcagcaccacctgaatgccggcagccagctgagccaggccatggaggtggatggcctgaatgacagcagcaagcagggctacagccaggagaccaagaggctgaagaggacccctgtgcctgacagcctgggcctggagatggagcaccgcttcatcgaccaggtgctgagcacctgcagaaatgtggagcaggccaggtttgccagcgcctacaggaagtggctggtgaccctgagccagtag

SEQ ID NO: 41594 - DNA, 1158 bp, Artificial Sequence
  Description of Artificial Sequence: Synthetic coding sequence
atgggctgtggggccagcaggaaggtggtgcccggccccccagccctggcctgggccaagcatgagggccagaaccaggccggcgtgggcggggccggccctggccctgaggccgccgcccaggccgcccagaggatccaggtggcccgcttccgggccaagtttgacccccgggtgctggcccgctatgacatcaaggccctgattggaacaggcagcttcagccgggtggtgcgggtggagcagaagaccaccaagaagccctttgccatcaaggtgatggagacccgggagcgggagggccgggaggcctgtgtgtctgagctgtctgtgctgcggcgggtgagccaccgctacatcgtgcagctgatggagatctttgaaacagaggaccaggtgtacatggtgatggagctggccactggaggagagctgtttgacaggctcatcgcccagggcagcttcacagaaagagatgctgtgcgcatcctgcagatggtggctgatggcatccgctacctgcacgccctgcagatcacccacaggaacctgaagccagagaacctgctgtactaccaccctggagaggagagcaagatcctgatcacagactttggcctggcctacagcggcaagaagagcggggactggaccatgaagaccctgtgtggcaccccagagtacatcgcccctgaggtgctgctgaggaagccctacaccagcgctgtggacatgtgggccctgggcgtcatcacctacgccctgctgagcggcttcctgccctttgatgatgagagccagacccggctgtacaggaagatcctgaagggcaagtacaactacaccggggagccctggcccagcatcagccacctggccaaggacttcatcgacaagctgctgatcctggaggccggccacaggatgtctgctggccaggccctggaccacccctgggtgatcaccatggctgctggcagctccatgaagaacctgcagagggccatcagcaggaacctgatgcagagggccagcccccacagccagagccctggcagcgcccagagcagcaagagccactacagccacaagagccgccacatgtggagcaagaggaacctgcgcatcgtggagagccccctgagcgccctgctgtag

SEQ ID NO: 41595 - DNA, 2265 bp, Artificial Sequence
  Description of Artificial Sequence: Synthetic coding sequence
atggctgctggggtgctgccccagaatgagcagccctacagcaccctggtgaacaacagtgaatgtgtggccaacatgaagggcaacctggagcggcccacccccaagtacaccaaggtgggggagcggctgcggcacgtgattcctggccacatggcctgcagcatggcctgtggcggccgggcctgcaagtatgagaacccagcccgctggagcgagcaggagcaggccatcaagggcgtgtacagctcctgggtgacagacaacatcctggccatggcccggcccagcagcgagctgctggagaagtaccacatcatcgaccagttcctgagccacggcatcaagaccatcatcaacctgcagaggcctggagaacatgccagctgtggcaaccccctggagcaggagagcggcttcacctacctgcctgaggccttcatggaggccggcatctacttctacaactttggctggaaggactatggagtggccagcctgaccaccatcctggacatggtgaaggtgatgacctttgccctgcaggagggcaaggtggccatccactgccacgccggcctgggccgcactggagtgctgattgcctgctacctggtgtttgccaccaggatgacagctgaccaggccatcatctttgtgcgggccaagaggcccaacagcatccagacccggggccagctgctgtgtgtgcgggagttcacccagttcctgacccccctgaggaacatcttcagctgctgtgaccccaaggcccatgctgtgaccctgccccagtacctgatccggcagaggcacctgctgcacggctatgaggcccggctgctgaagcacgtgcccaagatcatccacctggtgtgcaagctgctgctggacctggctgaaaatagacctgtgatgatgaaggatgtgtctgagggccctggcctgtctgctgagattgagaagaccatgtctgagatggtgaccatgcagctggacaaggagctgctgcggcatgacagtgatgtgagcaacccccccaaccccacagctgtggccgctgactttgacaacagaggcatgatcttcagcaatgagcagcagtttgaccccctgtggaagagaagaaatgtggagtgcctgcagcccctgacccacctgaagaggcggctgagctacagcgacagcgacctgaagagagctgagaacctgctggagcagggcgagaccccccagacagtgcctgcccagatcctggtgggccacaagccccggcagcagaagctgatcagccactgctacatcccccagagccctgagccagacctgcacaaggaggccctggtgcgcagcaccctgtccttctggagccagagcaagtttggaggcctggagggcctgaaggacaatggcagccccatcttccacggccgcatcatccccaaggaggcccagcagagcggggccttcagcgcagatgtgtctggcagccacagccctggagagcctgtgagccccagctttgccaacgtgcacaaggaccccaacccagcccaccagcaggtgagccactgccagtgcaagacccacggcgtgggcagccctggctctgtgcggcagaacagcaggacccccaggagccccctggactgtggcagcagccccaaggcccagttcctggtggagcacgagacccaggacagcaaggacctgtctgaggccgccagccacagcgccctgcagagcgagctgtctgctgaggcccggcgcatcctggccgccaaggccctggccaacctgaatgaatctgtggagaaggaggagctgaagaggaaggtggagatgtggcagaaggagctgaacagcagagatggagcctgggagcgcatctgtggggagcgggaccccttcatcctgtgcagcctgatgtggagctgggtggagcagctgaaggagcctgtgatcaccaaggaggatgtggacatgctggtggaccggcgggcagatgctgctgaggccctcttcctgctggagaagggccagcaccagaccatcctgtgtgtgctgcactgcatcgtgaacctgcagaccatccctgtggatgtggaggaggccttcctggcccacgccatcaaggccttcaccaaggtgaactttgattctgaaaatggccccaccgtgtacaacaccctgaagaagatcttcaagcacaccctggaggagaagaggaagatgaccaaggatggccccaagccaggcctgtag

SEQ ID NO: 41596 - DNA, 2421 bp, Artificial Sequence
  Description of Artificial Sequence: Synthetic coding sequence
atgcaggtgcaggatgccacccggcggcccagcgctgtgcgcttcctgagcagcttcctgcagggcagaagacacagcaccagtgaccctgtgctgcggctgcagcaggcccggcggggcagcggcctgggcagcggcagcgccaccaagctgctgagcagcagcagcctgcaggtgatggtggccgtgtcctctgtgtcccatgctgagggcaaccccaccttccctgagaggaagaggaacctggagcggcccacccccaagtacaccaaggtgggggagcggctgcggcacgtgattcctggccacatggcctgcagcatggcctgtggcggccgggcctgcaagtatgagaacccagcccgctggagcgagcaggagcaggccatcaagggcgtgtacagctcctgggtgacagacaacatcctggccatggcccggcccagcagcgagctgctggagaagtaccacatcatcgaccagttcctgagccacggcatcaagaccatcatcaacctgcagaggcctggagaacatgccagctgtggcaaccccctggagcaggagagcggcttcacctacctgcctgaggccttcatggaggccggcatctacttctacaactttggctggaaggactatggagtggccagcctgaccaccatcctggacatggtgaaggtgatgacctttgccctgcaggagggcaaggtggccatccactgccacgccggcctgggccgcactggagtgctgattgcctgctacctggtgtttgccaccaggatgacagctgaccaggccatcatctttgtgcgggccaagaggcccaacagcatccagacccggggccagctgctgtgtgtgcgggagttcacccagttcctgacccccctgaggaacatcttcagctgctgtgaccccaaggcccatgctgtgaccctgccccagtacctgatccggcagaggcacctgctgcacggctatgaggcccggctgctgaagcacgtgcccaagatcatccacctggtgtgcaagctgctgctggacctggctgaaaatagacctgtgatgatgaaggatgtgtctgagggccctggcctgtctgctgagattgagaagaccatgtctgagatggtgaccatgcagctggacaaggagctgctgcggcatgacagtgatgtgagcaacccccccaaccccacagctgtggccgctgactttgacaacagaggcatgatcttcagcaatgagcagcagtttgaccccctgtggaagagaagaaatgtggagtgcctgcagcccctgacccacctgaagaggcggctgagctacagcgacagcgacctgaagagagctgagaacctgctggagcagggcgagaccccccagacagtgcctgcccagatcctggtgggccacaagccccggcagcagaagctgatcagccactgctacatcccccagagccctgagccagacctgcacaaggaggccctggtgcgcagcaccctgtccttctggagccagagcaagtttggaggcctggagggcctgaaggacaatggcagccccatcttccacggccgcatcatccccaaggaggcccagcagagcggggccttcagcgcagatgtgtctggcagccacagccctggagagcctgtgagccccagctttgccaacgtgcacaaggaccccaacccagcccaccagcaggtgagccactgccagtgcaagacccacggcgtgggcagccctggctctgtgcggcagaacagcaggacccccaggagccccctggactgtggcagcagccccaaggcccagttcctggtggagcacgagacccaggacagcaaggacctgtctgaggccgccagccacagcgccctgcagagcgagctgtctgctgaggcccggcgcatcctggccgccaaggccctggccaacctgaatgaatctgtggagaaggaggagctgaagaggaaggtggagatgtggcagaaggagctgaacagcagagatggagcctgggagcgcatctgtggggagcgggaccccttcatcctgtgcagcctgatgtggagctgggtggagcagctgaaggagcctgtgatcaccaaggaggatgtggacatgctggtggaccggcgggcagatgctgctgaggccctcttcctgctggagaagggccagcaccagaccatcctgtgtgtgctgcactgcatcgtgaacctgcagaccatccctgtggatgtggaggaggccttcctggcccacgccatcaaggccttcaccaaggtgaactttgattctgaaaatggccccaccgtgtacaacaccctgaagaagatcttcaagcacaccctggaggagaagaggaagatgaccaaggatggccccaagccaggcctgtag

SEQ ID NO: 41597 - DNA, 438 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 41598 - DNA, 681 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcccggggagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 41599 - DNA, 1020 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgccctatgacagcaccagggtgcccctgggcaagagcaaggactacatcaatgccagctacatcagaattgtgaactgtggggaggagtacttctacatcgccacccagggccccctgctgagcaccattgatgacttctggcagatggtgctggagaacaacagcaatgtcatcgccatgatcacccgggagattgaaggaggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 41600 - DNA, 1137 bp, Artificial Sequence
  Description of Artificial Sequence: Synthetic coding sequence
tccttcagcccccggctgtgcagcgtgaatgactatgagggcaatgattctgaggccgaggacctgaacttccgggaggccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcggccgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgccctatgacagcaccagggtgcccctgggcaagagcaaggactacatcaatgccagctacatcagaattgtgaactgtggggaggagtacttctacatcgccacccagggccccctgctgagcaccattgatgacttctggcagatggtgctggagaacaacagcaatgtcatcgccatgatcacccgggagattgaaggaggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcgtgtctgtgtag

SEQ ID NO: 41601 - DNA, 279 bp, Artificial Sequence
  Description of Artificial Sequence: Synthetic coding sequence
tgaggacccaactggaggggctgctggggctgcagcggcaccgtgggcgccgccccccaggcccaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcggccgggaccgctggagcagtgaagatgaggaggccgccggccccagccaggccctgagccccctgctgtcctag

SEQ ID NO: 41602 - DNA, 342 bp, Artificial Sequence
  Description of Artificial Sequence: Synthetic coding sequence
atgagcagcccccgggacttccgggcagagagcgtgaatgactatgagggcaatgacagcgaggccgaggacctgaacttccgggaggccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcggccgggaccgctggagcagtgaagatgaggaggccgccggccccagccaggccctgagccccctgctgtcctag

SEQ ID NO: 41603 - DNA, 924 bp, Artificial Sequence
  Description of Artificial Sequence: Synthetic coding sequence
atggagaaccaggtgctgacccctcatgtgtactgggcccagaggcaccgggagctgtacctgcgggtggagctgagtgatgtgcagaacccagccatcagcatcacagaaaatgtgctgcacttcaaggcccagggccatggagccaagggggacaacgtgtatgagttccacctggagttcctggacctggtgaagccagaggaggaggagcggctgaacaagctgcggctggagagcgagggcagccctgagaccctgaccaacctgaggaagggctacctgttcatgtacaacctggtgcagttcctgggcttctcctggatctttgtgaacctgactgtgcgcttctgcatcctgggcaaggagagcttctatgacaccttccacacagtggccgacatgatgtacttctgccagatgctggccgtggtggagaccatcaatgctgccatcggcgtgaccaccagccctgtgctgcccagcctcatccagctgctgggcaggaacttcatcctcttcatcatcttcggcaccatggaggagatgcagaacaaggctgtggtgttctttgtgttctacctgtggagcgccatcgagatcttccgctacagcttctacatgctgacctgcatcgacatggactggaaggtgctgacctggctgcgctacaccctgtggatccccctgtaccccctgggctgcctggccgaggccgtgtctgtcatccagagcatccccatcttcaatgagaccggccgcttctccttcaccctgccctaccctgtgaagatcaaggtgcgcttctccttcttcctgcagatctacctgatcatgatcttcctgggcctgtacatcaacttccgccacctgtacaagcagaggagaagaagatatggccagaagaagaagaagatccactag

SEQ ID NO: 41604 - DNA, 1932 bp, Artificial Sequence
  Description of Artificial Sequence: Synthetic coding sequence
atgaggaccctgcggcggctgaagttcatgagcagccccagcctgagtgacctgggcaagcgggagcctgctgctgctgctgatgagcggggcacccagcagaggcgggcctgtgccaatgccacctggaacagcatccacaacggggtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagccggggcgtgacagaggactacctgcggctggagaccctggtgcagaaggtggtgagcccctacctgggcacctacggcctgcacagcagcgagggccccttcacccacagctgcatcctggagctgcagagggacaaggctgctgctgctgctgtgctgggcgctgtgaggaagaggccttctgtggtgcccatggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagagcacggcctggccccctgggagcagggcagcagagctgcccccctgcaggaggccgtgcccaggacccaggccaccggcctgaccaagcccaccctgccccccagccccctgatggccgcccggcggcggctgtag

SEQ ID NO: 41605 - DNA, 1695 bp, Artificial Sequence
  Description of Artificial Sequence: Synthetic coding sequence
atgaggaccctgcggcggctgaagttcatgagcagccccagcctgagtgacctgggcaagcgggagcctgctgctgctgctgatgagcggggcacccagcagaggcgggcctgtgccaatgccacctggaacagcatccacaacggggtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgaggagctgcagagggacaaggctgctgctgctgctgtgctgggcgctgtgaggaagaggcccagcgtggtgcccatggccggccaggaccctgccctgagcaccagccaccccttctatgatgtggcccggcacggcatcctgcaggtggccggagatgaccgcttcggccggcgggtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgatccccccagaggtgctgcgctatgatgagaagctgcagagcctgcacgagggccgcaccccaccacccaccaagaccccaccacccaggcctcccctgcccacccagcagtttggagtgtccctgcagtacctgaaggacaagaaccagggcgagctgatcccccctgtgctgcgcttcaccgtgacctacctgcgggagaagggcctgaggacagagggcctcttcagaagaagtgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagaacatggcctggccccctgggagcagggcagccgggccgcccccctgcaggaggccgtgcccaggacccaggccaccggcctgaccaagcccaccctgccccccagccccctgatggccgcccggcggcggctgtag

SEQ ID NO: 41606 - DNA, 1515 bp, Artificial Sequence
  Description of Artificial Sequence: Synthetic coding sequence
tgactgggcagcttcttcacagagtacctgcagaaccagctgctgaccaagggcatggtgatcctgcgggacaagatccgcttctatgaggagctgcagagggacaaggctgctgctgctgctgtgctgggcgctgtgaggaagaggccttctgtggtgcccatggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcaccagcctgcccctggcccccctggagctgagccgggagccccacgccctgcccggggtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagaacatggcctggccccctgggagcagggcagccgggccgcccccctgcaggaggccgtgcccaggacccaggccaccggcctgaccaagcccaccctgccccccagccccctgatggccgcccggcggcggctgtag

SEQ ID NO: 41607 - DNA, 1590 bp, Artificial Sequence
  Description of Artificial Sequence: Synthetic coding sequence
atgttccccctgacagaggagaacaagcacgtggcccagctgctgctgaacacaggcacctgcccccgctgcatcttccgcttctgtggggtggacttccacgccccctacaagctgccctacaaggagctgctgaatgagctgcagaagttcctggagacagagaaggatgagctgatcctggaggtgatgaaccccccacccaagaagatccggctgcaggagctggaggacagcattgacaacctgagccagaatggagagggccgcatctctgtgagccacgtgggcagcacagccagcaagaacagcaacctgaatgtgtgcaatgtgtgcctgggcatcctgcaggagttctgtgagaaggacttcatcaagaaggtgtgccagaaggtggaggccagcggctttgagttcaccagcctggtgttttctgtgtccttccccccccagctgtctgtgcgggagcacgccgcctggctgctggtgaagcaggagatgggcaagcagagcctgagcctgggcagagatgacatcgtgcagctgaaggaggcctacaagtggatcacccaccccctcttcagcgaggagctgggcgtgcccattgatggcaagagcctgtttgaggtgtctgtggtgtttgcccaccctgagaccgtggaggactgccacttcctggccgccatctgcccagactgcttcaagccagccaagaacaagcagagcgtcttcaccaggatggctgtgatgaaggccctgaacaagatcaaggaggaggacttcctgaagcagttcccctgcccccccaacagccccaaggctgtgtgtgctgtgctggagattgaatgtgcccatggagctgtgtttgtggccggccgctacaacaagtacagcaggaacctgccccagaccccctggatcattgatggagagaggaagctggagagctctgtggaggagctgatcagtgaccacctgctggccgtgttcaaggccgagagcttcaacttcagcagcagcggcagagaagatgtggatgtgaggaccctgggcaatggccggccctttgccatcgagctggtgaacccccaccgggtgcacttcaccagccaggagatcaaggagctgcagcagaagatcaacaacagcagcaacaagatccaggtgcgggacctgcagctggtgacccgggaggccatcggccacatgaaggagggggaggaggagaagaccaagacctacagcgccctgatctggaccaacaaggccatccagaagaaggacatcgagttcctgaatgacatcaaggacctgaagattgaccagaagacccccctgcgggtgctgcacagaagacccctggccgtgcgggcccgggtcatccacttcatggagacccagtatgtggatgagcaccacttccggctgcacctgaagacccaggccggcacctacatcaaggagtttgtgcatggagactttggccgcaccaagcccaacatcggcagcctgatgaatgtgacagctgacatcctggagctggatgtggagagcgtggatgtggactggcccccagccctggatgactag

SEQ ID NO: 41608 - DNA, 1590 bp, Artificial Sequence; identical to SEQ ID NO: 41607
  Description of Artificial Sequence: Synthetic coding sequence

SEQ ID NO: 41609 - DNA, 363 bp, Artificial Sequence
  Description of Artificial Sequence: Synthetic coding sequence
atgttccccctgacagaggagaacaagcacgtggcccagctgctgctgaacacaggcacctgcccccgctgcatcttccgcttctgtggggtggacttccacgccccctacaagctgccctacaaggagctgctgaatgagctgcagaagttcctggagacagagaaggatgagctgatcctggaggtgatgaaccccccacccaagaagatccggctgcaggagctggaggacagcattgacaacctgagccagaatggagagggccgcatctctgtgagccacgtgggcagcacagccagcaagaacagcaacctgaatgtgtgcaatgtgtgcctgggcatcctgcaggagttctgctag

SEQ ID NO: 41610 - DNA, 1986 bp, Artificial Sequence
  Description of Artificial Sequence: Synthetic coding sequence
atggagatgacagagatgactggagtgtccctgaagagaggagccctggtggtggaggacaatgattctggagtgcctgtggaggagaccaagaagcagaagctgtctgaatgttccctgaccaagggccaggacggcctgcagaatgacttcctgagcatcagtgaagatgtgccccggcccccagacacagtgtccactggaaaaggaggcaagaacagcgaggcccagctggaggatgaggaggaggaggaggaggatggcctgtctgaggagtgtgaggaggaggagagcgagagctttgctgacatgatgaagcacggcctgacagaagcagatgtgggcatcaccaagtttgtgagcagccaccagggcttcagcggcatcctgaaggagcgctacagcgactttgtggtgcatgagatcggcaaggatggccgcatcagccacctgaatgacctgagcatccctgtggatgaggaggaccccagcgaggacatcttcaccgtgctgacagctgaggagaagcagaggctggaggagctgcagctgttcaagaacaaggagacctctgtggccatcgaggtgattgaggacaccaaggagaagaggaccatcatccaccaggccatcaagagcctcttccctggcctggagaccaagacagaagatcgggagggcaagaagtacatcgtggcctaccacgccgccggcaagaaggccctggccaaccccaggaagcacagctggcccaagagccggggcagctactgccactttgtgctgtacaaggagaacaaggacaccatggatgccatcaacgtgctgagcaagtacctgcgggtgaagcccaacatcttctcctacatgggcaccaaggacaagagggccatcaccgtgcaggagattgctgtgctgaagatcacagcccagaggctggcccacctgaacaagtgcctgatgaacttcaagctgggcaacttctcctaccagaagaaccccctgaagctgggggagctgcagggcaaccacttcaccgtggtgctgaggaacatcactggaacagatgaccaggtgcagcaggccatgaacagcctgaaggagatcggcttcatcaactactacggcatgcagcgcttcggcaccacagctgtgcccacctaccaggtgggccgggccatcctgcagaacagctggacagaggtgatggacctgatcctgaagcccaggtctggagctgagaagggctacctggtgaagtgccgggaggagtgggccaagaccaaggaccccacagctgccctgaggaagctgcctgtgaagagatgtgtggagggccagctgctgcggggcctgagcaaatatggcatgaagaacatcgtgtctgccttcggcatcatccccaggaacaaccggctgatgtacatccacagctaccagagctatgtgtggaacaacatggtgtccaagagaattgaagattatggcctgaagcctgtgcctggggacctggtgctgaagggggccacagccacctacatcgaggaggatgatgtgaacaactacagcatccatgatgtggtgatgcccctgcccggctttgatgtgatctaccccaagcacaagatccaggaggcctaccgggagatgctgacagctgacaacctggacatcgacaacatgaggcacaagatccgggactacagcctgagcggggcctacaggaagatcatcatccggccccagaatgtgtcctgggaggtggtggcctatgatgaccccaagatccccctcttcaacacagatgtggacaacctggagggcaagaccccacctgtgtttgccagcgagggcaagtaccgggccctgaagatggacttcagcctgccccccagcacctacgccaccatggccatccgggaggtgctgaagatggacaccagcatcaagaaccagacccagctgaacaccacctggctgaggtag

SEQ ID NO: 41611 - DNA, 1986 bp, Artificial Sequence; identical to SEQ ID NO: 41610
  Description of Artificial Sequence: Synthetic coding sequence

SEQ ID NO: 41612 - DNA, 1986 bp, Artificial Sequence; identical to SEQ ID NO: 41610
  Description of Artificial Sequence: Synthetic coding sequence

SEQ ID NO: 41613 - DNA, 2106 bp, Artificial Sequence
  Description of Artificial Sequence: Synthetic coding sequence
atggaggaggacacagactaccgcatccgcttcagcagcctgtgcttcttcaatgaccacgtgggcttccacggcaccatcaagagcagccccagcgacttcatcgtgattgaaattgatgagcagggccagctggtgaacaagaccattgatgagcccatcttcaagatcagcgagatccagctggagcccaacaacttccccaagaagcccaagctggacctgcagaacctgagcctggaggatggcaggaaccaggaggtgcacaccctcatcaagtacacagatggagaccagaaccaccagagcggcagcgagaaggaggacaccatcgtggatggcaccagcaaatgtgaggagaaggcagatgtgctgagcagcttcctggatgagaagacccatgagctgctgaacaactttgcctgtgatgtgcgggagaagtggctgagcaagacagagctgattggcctgcccccagagttcagcatcggccgcatcctggacaagaaccagagggccagcctgcacagcgccatccggcagaagttccccttcctggtgacagtgggcaagaacagcgagatcgtggtgaagcccaacctggagtacaaggagctgtgccacctggtgtctgaggaggaggcctttgacttcttcaagtacctggatgccaagaaggagaacagcaagttcaccttcaagccagacaccaacaaggaccacaggaaggctgtgcaccactttgtgaacaagaagtttggaaacctggtggagaccaagagcttcagcaagatgaactgcagcgctggcaaccccaacgtggtggtgacagtgcgcttccgggagaaggcccacaagaggggcaagaggcccctgtctgagtgccaggagggcaaggtgatctacacagccttcaccctgaggaaggagaacctggagatgtttgaggccatcggcttcctggccatcaagctgggcgtcatccccagcgacttctcctatgccggcctgaaggacaagaaggccatcacctaccaggccatggtggtgaggaaggtgaccccagagcggctgaagaacatcgagaaggagattgagaagaagaggatgaatgtgttcaacatccgctctgtggatgacagcctgcggctgggccagctgaagggcaaccactttgacatcgtcatccggaacctgaagaagcagatcaatgacagcgccaacctgcgggagcgcatcatggaggccattgaaaatgtgaagaagaagggctttgtgaactactacggcccccagagatttgggaagggcaggaaggtgcacacagaccagatcggcctggccctgctgaagaatgagatgatgaaggccatcaagctgttcctgaccccagaggacctggatgatcctgtgaacagagccaagaagtacttcctgcagacagaagatgccaagggcaccctgagcctgatgcctgagttcaaggtgcgggagcgggccctgctggaggccctgcaccgcttcggcatgacagaggagggctgcatccaggcctggttcagcctgccccacagcatgaggatcttctacgtgcacgcctacaccagcaagatctggaatgaggccgtgtcctaccgcctggagacctacggggcccgggtggtgcagggcgacctggtgtgcctggatgaggacattgatgatgagaacttccccaacagcaagatccacctggtgacagaggaggagggcagcgccaacatgtatgccatccaccaggtggtgctgcctgtgctgggctacaacatccagtaccccaagaacaaggtgggccagtggtaccatgacatcctgagcagagatggcctgcagacctgccgcttcaaggtgcccaccctgaagctgaacatccctggctgctaccggcagatcctgaagcacccctgcaacctgagctaccagctgatggaggaccatgacattgatgtgaagaccaagggcagccacattgatgaaacagccctgagcctgctgatcagctttgacctggatgccagctgctacgccaccgtgtgcctgaaggagatcatgaagcatgatgtgtag

SEQ ID NO: 41614 - DNA, 2106 bp, Artificial Sequence; identical to SEQ ID NO: 41613
  Description of Artificial Sequence: Synthetic coding sequence

SEQ ID NO: 41615 - DNA, 381 bp, Artificial Sequence
  Description of Artificial Sequence: Synthetic coding sequence
atggaggaggacacagactaccgcatccgcttcagcagcctgtgcttcttcaatgaccacgtgggcttccacggcaccatcaagagcagccccagcgacttcatcgtgattgaaattgatgagcagggccagctggtgaacaagaccattgatgagcccatcttcaagatcagcgagatccagctggagcccaacaacttccccaagaagcccaagctggacctgcagaacctgagcctggaggatggcaggaaccaggaggtgcacaccctcatcaagtacacagatggagaccagaaccaccagagcggcagcgagaaggaggacaccatcgtggatggcaccagcaaatgtgaggagaaggcagatgtgctgtcctag

SEQ ID NO: 41616 - DNA, 2106 bp, Artificial Sequence; identical to SEQ ID NO: 41613
  Description of Artificial Sequence: Synthetic coding sequence

SEQ ID NO: 41617 - DNA, 1098 bp, Artificial Sequence
  Description of Artificial Sequence: Synthetic coding sequence
atggaggaggacacagactaccgcatccgcttcagcagcctgtgcttcttcaatgaccacgtgggcttccacggcaccatcaagagcagccccagcgacttcatcgtgattgaaattgatgagcagggccagctggtgaacaagaccattgatgagcccatcttcaagatcagcgagatccagctggagcccaacaacttccccaagaagcccaagctggacctgcagaacctgagcctggaggatggcaggaaccaggaggtgcacaccctcatcaagtacacagatggagaccagaaccaccagagcggcagcgagaaggaggacaccatcgtggatggcaccagcaaatgtgaggagaaggcagatgtgctgagcagcttcctggatgagaagacccatgagctgctgaacaactttgcctgtgatgtgcgggagaagtggctgagcaagacagagctgattggcctgcccccagagttcagcatcggccgcatcctggacaagaaccagagggccagcctgcacagcgccatccggcagaagttccccttcctggtgacagtgggcaagaacagcgagatcgtggtgaagcccaacctggagtacaaggagctgtgccacctggtgtctgaggaggaggcctttgacttcttcaagtacctggatgccaagaaggagaacagcaagttcaccttcaagccagacaccaacaaggaccacaggaaggctgtgcaccactttgtgaacaagaagtttggaaacctggtggagaccaagagcttcagcaagatgaactgcagcgctggcaaccccaacgtggtggtgacagtgcgcttccgggagaaggcccacaagaggggcaagaggcccctgtctgagtgccaggagggcaaggtgatctacacagccttcaccctgaggaaggagaacctggagatgtttgaggccatcggcttcctggccatcaagctgggcgtcatccccagcgacttctcctatgccggcctgaaggacaagaaggccatcacctaccaggccatggtggtgaggaaggtgaccccagagcggctgaagaacatcgagaaggagatctag

SEQ ID NO: 41618 - DNA, 912 bp, Artificial Sequence
  Description of Artificial Sequence: Synthetic coding sequence
atgagcagcgccccagccagcggctctgtgcgggcccgctacctggtgtacttccagtatgtgggcacagacttcaacggggtggccgctgtgcggggcacccagagagctgtgggcgtgcagaactacctggaggaggccgctgagcggctgaacagcgtggagcctgtgcgcttcaccatcagcagcaggacagatgctggggtgcacgccctgagcaatgctgcccacctggatgtgcagaggaggagcggccggccccccttccccccagaggtgctggccgaggccctgaacacccacctgcggcacccagccatccgggtgctgcgggccttccgggtgcccagcgacttccacgcccggcatgctgccaccagcaggacctacctgtaccgcctggccaccggctgccacagaagagatgagctgcctgtgtttgaaagaaacctgtgctggaccctgcctgctgactgcctggacatggtggccatgcaggaggccgcccagcacctgctgggcacccatgacttcagcgccttccagagcgctggcagccctgtgcccagccctgtgaggaccctgcggcgggtgtctgtgtccccaggccaggccagccccctggtgaccccagaggagagcaggaagctgcgcttctggaacctggagtttgagagccagagcttcctgtaccggcaggtgcggaggatgacagctgtgctggtggccgtgggcctgggcgccctggccccagcccaggtgaagaccatcctggagagccaggaccccctgggcaagcaccagaccagggtggccccagcccacggcctcttcctgaagtctgtgctgtatggcaacctgggcgccgccagctgcaccctgcagggcccccagtttggcagccacggctag

SEQ ID NO: 41619 - DNA, 216 bp, Artificial Sequence
  Description of Artificial Sequence: Synthetic coding sequence
atgggcgccaccggcctgggcttcctgctgtcctggaggcaggacaacctgaatggaacagactgccagggctgcaacatcctgtacttcagcgagaccaccggctccatgtgcagcgagctgagcctgaacagaggcctggaggcccggaggaagaaggacctgaaggacagcttcctgtggagagatggagtgagcccctgcctgccctgctag

SEQ ID NO: 41620 - DNA, 444 bp, Artificial Sequence
  Description of Artificial Sequence: Synthetic coding sequence
atgggcgccaccggcctgggcttcctgctgtcctggaggcaggacaacctgaatggaacagactgccagggctgcaacatcctgtacttcagcgagaccaccggctccatgtgcagcgagctgagcctgaacagaggcctggaggcccggaggaagaaggacctgaaggacagcttcctgtggaggtatggcaaggtgggctgcatcagcctgcccctgcgggagatgacagcctggatcaaccccccccagatcagcgagatcttccagggctaccaccagagggtgcatggagcagatgccctgagcctgcagaccaacagcctgcggagccggctgagcagccagtgcctgggccagagcttcctgctgcggaccctggagcggggccggggcttccgggccctgggggacatctgtggccacgtgcatgaggaggactag

SEQ ID NO: 41621 - DNA, 444 bp, Artificial Sequence; identical to SEQ ID NO: 41620
  Description of Artificial Sequence: Synthetic coding sequence

SEQ ID NO: 41622 - DNA, 216 bp, Artificial Sequence; identical to SEQ ID NO: 41619
  Description of Artificial Sequence: Synthetic coding sequence

SEQ ID NO: 41623 - DNA, 2202 bp, Artificial Sequence
  Description of Artificial Sequence: Synthetic coding sequence
atgggcaagctgatcaccaggatgtggaagctgctgcggcggcgcagcgcccccaaggagctgctgagcaggaccagcctggagacccagaagctggacctgatgacagaggtgtctgagctgaagctgaagctggtgggcatggagaaggagcagcgggagcaggaggagaagcagaggaaggccgaggagctgctgcaggagctgcggcacctgaagatcaaggtggaggagctggagaatgaaagaaaccagtatgagtggaagctgaaggccaccaaggccgaggtggcccagctgcaggagcaggtggccctgaaggatgctgagattgagcggctgcacagccagctgagcaggacagctgccctgcacagcgagagccacacagagcgggaccaggagatccagaggctgaagatgggcatggagaccctgctgctggccaatgaagacaaggacagaagaattgaggagctgaccggcctgctgaaccagtacaggaaggtgaaggagatcgtgatggtgacccagggccccagcgagaggaccctgagcatcaatgaggaggagcctgagggcggcttcagcaagtggaatgccaccaacaaggaccctgaggagctgttcaagcaggagatgccaccccgctgcagcagccccaccgtgggccccccacccctgccccagaagagcctggagacccgggcccagaagaagctgagctgcagcctggaggacctgcggtctgagagcgtggacaagtgcatggatggcaaccagcccttccctgtgctggagcccaaggacagccccttcctggccgagcacaagtaccccaccctgcccgggaagctgagcggggccacccccaacggggaggccgccaagagcccccccaccatctgccagccagatgccaccggcagcagcctgctgcggctgcgggacacagagagcggctgggatgacacagctgtggtgaatgacctgagcagcaccagcagcggcacagagagcggcccccagagccccctgaccccagatggcaagaggaaccccaagggcatcaagaagttctggggcaagatccggaggacccagagcggcaacttctacacagacaccctgggcatggccgagttcagaagaggaggcctgcgggccacagctggcccccggctgagcaggacccgggacagcaagggccagaagagtgatgccaatgccccctttgcccagtggagcacagagcgggtgtgtgcctggctggaggactttggcctggcccagtatgtgatctttgcccggcagtgggtgagcagcggccacaccctgctgacagccaccccccaggacatggagaaggagctgggcatcaagcaccccctgcacaggaagaagctggtgctggccgtgaaggccatcaacaccaagcaggaggagaagagcgccctgctggaccacatctgggtgacccgctggctggatgacatcggcctgccccagtacaaggaccagttccacgagagccgggtggacaggaggatgctgcagtacctgactgtgaatgacctgctcttcctgaaggtgaccagccagctgcaccacctgagcatcaagtgtgccatccacgtgctgcacgtgaacaagttcaacccccactgcctgcacagaagaccagcagatgagagcaacctgagccccagcgaggtggtgcagtggagcaaccaccgggtgatggagtggctgcggtctgtggacctggccgagtatgcccccaacctgcggggcagcggcgtgcacggcggcctcatcatcctggagccccgcttcaccggggacaccctggccatgctgctgaacatccccccccagaagaccctgctgcggcggcacctgaccaccaagttcaatgccctgattggccctgaggccgagcaggagaagcgggagaagatggccagccctgcctacacccccctgaccaccacagccaaggtgcggcccaggaagctgggcttcagccacttcggcaacatcaggaagaagaagtttgatgagagcacagactacatctgccccatggagcccagtgatggagtgtctgacagccaccgggtgtacagcggctaccggggcctgagccccctggatgcccctgagctggatggcctggaccaggtgggccagatctcctag

SEQ ID NO: 41624 - DNA, 2157 bp, Artificial Sequence
  Description of Artificial Sequence: Synthetic coding sequence
atgctgcagcaggagctgctgagcaggaccagcctggagacccagaagctggacctgatgacagaggtgtctgagctgaagctgaagctggtgggcatggagaaggagcagcgggagcaggaggagaagcagaggaaggccgaggagctgctgcaggagctgcggcacctgaagatcaaggtggaggagctggagaatgaaagaaaccagtatgagtggaagctgaaggccaccaaggccgaggtggcccagctgcaggagcaggtggccctgaaggatgctgagattgaaaggctgcacagccagctgagcaggacagctgccctgcacagcgagagccacacagagcgggaccaggagatccagaggctgaagatgggcatggagaccctgctgctggccaatgaagacaaggaccggcgcatcgaggagctgaccggcctgctgaaccagtacaggaaggtgaaggagatcgtgatggtgacccagggccccagcgagaggaccctgagcatcaatgaggaggagcctgagggcggcttcagcaagtggaatgccaccaacaaggaccctgaggagctgttcaagcaggagatgccaccccgctgcagcagccccaccgtgggccccccacccctgccccagaagagcctggagacccgggcccagaagaagctgagctgcagcctggaggacctgcggtctgagagcgtggacaagtgcatggatggcaaccagcccttccctgtgctggagcccaaggacagccccttcctggccgagcacaagtaccccaccctgcccgggaagctgagcggggccaccccaaatggagaggccgccaagagcccccccaccatctgccagccagatgccaccggcagcagcctgctgcggctgcgggacacagaaagtggctgggatgacacagctgtggtgaatgacctgagcagcaccagcagcggcacagaaagtggcccccagagccccctgaccccagatggcaagaggaaccccaagggcatcaagaagttctggggcaagatccggaggacccagagcggcaacttctacacagacaccctgggcatggccgagttccggcggggcggcctgcgggccacagctggcccccggctgagcaggacccgggacagcaagggccagaagagtgatgccaatgccccctttgcccagtggagcacagagcgggtgtgtgcctggctggaggactttggcctggcccagtatgtgatctttgcccggcagtgggtgagcagcggccacaccctgctgacagccaccccccaggacatggagaaggagctgggcatcaagcaccccctgcacaggaagaagctggtgctggccgtgaaggccatcaacaccaagcaggaggagaagagcgccctgctggaccacatctgggtgacccgctggctggatgacatcggcctgccccagtacaaggaccagttccacgagagccgggtggacaggaggatgctgcagtacctgactgtgaatgacctgctcttcctgaaggtgaccagccagctgcaccacctgagcatcaagtgtgccatccacgtgctgcacgtgaacaagttcaacccccactgcctgcaccggcggccagcagatgagagcaacctgagccccagcgaggtggtgcagtggagcaaccaccgggtgatggagtggctgcggtctgtggacctggccgagtatgcccccaacctgcggggcagcggcgtgcatggaggcctcatcatcctggagccccgcttcaccggggacaccctggccatgctgctgaacatccccccccagaagaccctgctgcggcggcacctgaccaccaagttcaatgccctgattggccctgaggccgagcaggagaagcgggagaagatggccagccctgcctacacccccctgaccaccacagccaaggtgcggcccaggaagctgggcttcagccactttggaaacatcaggaagaagaagtttgatgagagcacagactacatctgccccatggagcccagtgatggagtgtctgacagccaccgggtgtacagcggctaccggggcctgagccccctggatgcccctgagctggatggcctggaccaggtgggccagatctcctag

SEQ ID NO: 41625 - DNA, 2631 bp, Artificial Sequence
  Description of Artificial Sequence: Synthetic coding sequence
atggccagtgatgccagccacgccctggaggccgccctggagcagatggatggcatcatcgccggcaccaagacaggagctgacctgagtgatggcacctgtgagcccggcctggccagccctgccagctacatgaaccccttccctgtgctgcacctgattgaggacctgcggctggccctggagatgctggagctgccccaggagagagctgccctgctgagccagatccctggccccacagctgcctacatcaaggagtggtttgaggagagcctgagccaggtgaaccaccacagcgctgccagcaatgagacctaccaggagcggctggcccggctggagggggacaaggagagcctcatcctgcaggtgtctgtgctgacagaccaggtggaggcccagggcgagaagatccgggacctggaggtgtgcctggagggccaccaggtgaagctgaatgctgctgaggagatgctgcagcaggagctgctgagcaggaccagcctggagacccagaagctggacctgatgacagaggtgtctgagctgaagctgaagctggtgggcatggagaaggagcagcgggagcaggaggagaagcagaggaaggccgaggagctgctgcaggagctgcggcacctgaagatcaaggtggaggagctggagaatgaaagaaaccagtatgagtggaagctgaaggccaccaaggccgaggtggcccagctgcaggagcaggtggccctgaaggatgctgagattgaaaggctgcacagccagctgagcaggacagctgccctgcacagcgagagccacacagagcgggaccaggagatccagaggctgaagatgggcatggagaccctgctgctggccaatgaagacaaggaccggcgcatcgaggagctgaccggcctgctgaaccagtacaggaaggtgaaggagatcgtgatggtgacccagggccccagcgagaggaccctgagcatcaatgaggaggagcctgagggcggcttcagcaagtggaatgccaccaacaaggaccctgaggagctgttcaagcaggagatgccaccccgctgcagcagccccaccgtgggccccccacccctgccccagaagagcctggagacccgggcccagaagaagctgagctgcagcctggaggacctgcggtctgagagcgtggacaagtgcatggatggcaaccagcccttccctgtgctggagcccaaggacagccccttcctggccgagcacaagtaccccaccctgcccgggaagctgagcggggccaccccaaatggagaggccgccaagagcccccccaccatctgccagccagatgccaccggcagcagcctgctgcggctgcgggacacagaaagtggctgggatgacacagctgtggtgaatgacctgagcagcaccagcagcggcacagaaagtggcccccagagccccctgaccccagatggcaagaggaaccccaagggcatcaagaagttctggggcaagatccggaggacccagagcggcaacttctacacagacaccctgggcatggccgagttccggcggggcggcctgcgggccacagctggcccccggctgagcaggacccgggacagcaagggccagaagagtgatgccaatgccccctttgcccagtggagcacagagcgggtgtgtgcctggctggaggactttggcctggcccagtatgtgatctttgcccggcagtgggtgagcagcggccacaccctgctgacagccaccccccaggacatggagaaggagctgggcatcaagcaccccctgcacaggaagaagctggtgctggccgtgaaggccatcaacaccaagcaggaggagaagagcgccctgctggaccacatctgggtgacccgctggctggatgacatcggcctgccccagtacaaggaccagttccacgagagccgggtggacaggaggatgctgcagtacctgactgtgaatgacctgctcttcctgaaggtgaccagccagctgcaccacctgagcatcaagtgtgccatccacgtgctgcacgtgaacaagttcaacccccactgcctgcaccggcggccagcagatgagagcaacctgagccccagcgaggtggtgcagtggagcaaccaccgggtgatggagtggctgcggtctgtggacctggccgagtatgcccccaacctgcggggcagcggcgtgcatggaggcctcatcatcctggagccccgcttcaccggggacaccctggccatgctgctgaacatccccccccagaagaccctgctgcggcggcacctgaccaccaagttcaatgccctgattggccctgaggccgagcaggagaagcgggagaagatggccagccctgcctacacccccctgaccaccacagccaaggtgcggcccaggaagctgggcttcagccactttggaaacatcaggaagaagaagtttgatgagagcacagactacatctgccccatggagcccagtgatggagtgtctgacagccaccgggtgtacagcggctaccggggcctgagccccctggatgcccctgagctggatggcctggaccaggtgggccagatctcctag

SEQ ID NO: 41626 - DNA, 213 bp, Artificial Sequence
  Description of Artificial Sequence: Synthetic coding sequence
atggccagtgatgccagccacgccctggaggccgccctggagcagatggatggcatcatcgccggcaccaagacaggagctgacctgagtgatggcacctgtgagcccggcctggccagccctgccagctacatgaaccccttccctgtgctgcacctgattgaggacctgcggctggccctggagatgctggagctgccccaggagaggtag

SEQ ID NO: 41627 - DNA, 270 bp, Artificial Sequence
  Description of Artificial Sequence: Synthetic coding sequence
atggccagtgatgccagccacgccctggaggccgccctggagcagatggatggcatcatcgccggcaccaagacaggagctgacctgagtgatggcacctgtgagcccggcctggccagccctgccagctacatgaaccccttccctgtgctgcacctgattgaggacctgcggctggccctggagatgctggagctgccccaggagagagctgccctgctgagccagatccctggccccacagctgcctacatcaaggagtggttctag

SEQ ID NO: 41628 - DNA, 513 bp, Artificial Sequence
  Description of Artificial Sequence: Synthetic coding sequence
atggccagtgatgccagccacgccctggaggccgccctggagcagatggatggcatcatcgccggcaccaagacaggagctgacctgagtgatggcacctgtgagcccggcctggccagccctgccagctacatgaaccccttccctgtgctgcacctgattgaggacctgcggctggccctggagatgctggagctgccccaggagagagctgccctgctgagccagatccctggccccacagctgcctacatcaaggagtggtttgaggagagcctgagccaggtgaaccaccacagcgctgccagcaatgagacctaccaggagcggctggcccggctggagggggacaaggagagcctcatcctgcaggtgtctgtgctgacagaccaggtggaggcccagggcgagaagatccgggacctggaggtgtgcctggagggccaccaggtgaagctgaatgctgctgaggagatgctgcagcaggagctgctgagcaggaccagcctgtag

SEQ ID NO: 41629 - DNA, 270 bp, Artificial Sequence; identical to SEQ ID NO: 41627
  Description of Artificial Sequence: Synthetic coding sequence

SEQ ID NO: 41630 - DNA, 654 bp, Artificial Sequence
  Description of Artificial Sequence: Synthetic coding sequence
atgctgcagtacctgactgtgaatgacctgctcttcctgaaggtgaccagccagctgcaccacctgagcatcaagtgtgccatccacgtgctgcacgtgaacaagttcaacccccactgcctgcacagaagaccagcagatgagagcaacctgagccccagcgaggtggtgcagtggagcaaccaccgggtgatggagtggctgcggtctgtggacctggccgagtatgcccccaacctgcggggcagcggcgtgcacggcggcctcatcatcctggagccccgcttcaccggggacaccctggccatgctgctgaacatccccccccagaagaccctgctgcggcggcacctgaccaccaagttcaatgccctgattggccctgaggccgagcaggagaagcgggagaagatggccagccctgcctacacccccctgaccaccacagccaaggtgcggcccaggaagctgggcttcagccacttcggcaacatcaggaagaagaagtttgatgagagcacagactacatctgccccatggagcccagtgatggagtgtctgacagccaccgggtgtacagcggctaccggggcctgagccccctggatgcccctgagctggatggcctggaccaggtgggccagatctcctag

SEQ ID NO: 41631 - DNA, 1203 bp, Artificial Sequence
  Description of Artificial Sequence: Synthetic coding sequence
atgctgcagcaggagctgctgagcaggaccagcctggagacccagaagctggacctgatgacagaggtgtctgagctgaagctgaagctggtgggcatggagaaggagcagcgggagcaggaggagaagcagaggaaggccgaggagctgctgcaggagctgcggcacctgaagatcaaggtggaggagctggagaatgaaagaaaccagtatgagtggaagctgaaggccaccaaggccgaggtggcccagctgcaggagcaggtggccctgaaggatgctgagattgaaaggctgcacagccagctgagcaggacagctgccctgcacagcgagagccacacagagcgggaccaggagatccagaggctgaagatgggcatggagaccctgctgctggccaatgaagacaaggaccggcgcatcgaggagctgaccggcctgctgaaccagtacaggaaggtgaaggagatcgtgatggtgacccagggccccagcgagaggaccctgagcatcaatgaggaggagcctgagggcggcttcagcaagtggaatgccaccaacaaggaccctgaggagctgttcaagcaggagatgccaccccgctgcagcagccccaccgtgggccccccacccctgccccagaagagcctggagacccgggcccagaagaagctgagctgcagcctggaggacctgcggtctgagagcgtggacaagtgcatggatggcaaccagcccttccctgtgctggagcccaaggacagccccttcctggccgagcacaagtaccccaccctgcccgggaagctgagcggggccaccccaaatggagaggccgccaagagcccccccaccatctgccagccagatgccaccggcagcagcctgctgcggctgcgggacacagaaagtggctgggatgacacagctgtggtgaatgacctgagcagcaccagcagcggcacagaaagtggcccccagagccccctgaccccagatggcaagaggaaccccaagggcatcaagaagttctggggcaagatccggaggacccagagcggcaacttctacacagacaccctgggcatggccgagttccggcggggcggcctgcgggccacagctggcccccggctgagcaggacccgggacagcaagggccagggcctgcagtggctgcccggcccccagcccccatag

SEQ ID NO: 41632 - DNA, 2277 bp, Artificial Sequence
  Description of Artificial Sequence: Synthetic coding sequence
atggatggagacattgatgtgtacaagcacttctcctggctgaagaggagccaggtgaaccaccacagcgctgccagcaatgagacctaccaggagcggctggcccggctggagggggacaaggagagcctcatcctgcaggtgtctgtgctgacagaccaggtggaggcccagggcgagaagatccgggacctggaggtgtgcctggagggccaccaggtgaagctgaatgctgctgaggagatgctgcagcaggagctgctgagcaggaccagcctggagacccagaagctggacctgatgacagaggtgtctgagctgaagctgaagctggtgggcatggagaaggagcagcgggagcaggaggagaagcagaggaaggccgaggagctgctgcaggagctgcggcacctgaagatcaaggtggaggagctggagaatgaaagaaaccagtatgagtggaagctgaaggccaccaaggccgaggtggcccagctgcaggagcaggtggccctgaaggatgctgagattgagcggctgcacagccagctgagcaggacagctgccctgcacagcgagagccacacagagcgggaccaggagatccagaggctgaagatgggcatggagaccctgctgctggccaatgaagacaaggacagaagaattgaggagctgaccggcctgctgaaccagtacaggaaggtgaaggagatcgtgatggtgacccagggccccagcgagaggaccctgagcatcaatgaggaggagcctgagggcggcttcagcaagtggaatgccaccaacaaggaccctgaggagctgttcaagcaggagatgccaccccgctgcagcagccccaccgtgggccccccacccctgccccagaagagcctggagacccgggcccagaagaagctgagctgcagcctggaggacctgcggtctgagagcgtggacaagtgcatggatggcaaccagcccttccctgtgctggagcccaaggacagccccttcctggccgagcacaagtaccccaccctgcccgggaagctgagcggggccacccccaacggggaggccgccaagagcccccccaccatctgccagccagatgccaccggcagcagcctgctgcggctgcgggacacagagagcggctgggatgacacagctgtggtgaatgacctgagcagcaccagcagcggcacagagagcggcccccagagccccctgaccccagatggcaagaggaaccccaagggcatcaagaagttctggggcaagatccggaggacccagagcggcaacttctacacagacaccctgggcatggccgagttcagaagaggaggcctgcgggccacagctggcccccggctgagcaggacccgggacagcaagggccagaagagtgatgccaatgccccctttgcccagtggagcacagagcgggtgtgtgcctggctggaggactttggcctggcccagtatgtgatctttgcccggcagtgggtgagcagcggccacaccctgctgacagccaccccccaggacatggagaaggagctgggcatcaagcaccccctgcacaggaagaagctggtgctggccgtgaaggccatcaacaccaagcaggaggagaagagcgccctgctggaccacatctgggtgacccgctggctggatgacatcggcctgccccagtacaaggaccagttccacgagagccgggtggacaggaggatgctgcagtacctgactgtgaatgacctgctcttcctgaaggtgaccagccagctgcaccacctgagcatcaagtgtgccatccacgtgctgcacgtgaacaagttcaacccccactgcctgcacagaagaccagcagatgagagcaacctgagccccagcgaggtggtgcagtggagcaaccaccgggtgatggagtggctgcggtctgtggacctggccgagtatgcccccaacctgcggggcagcggcgtgcacggcggcctcatcatcctggagccccgcttcaccggggacaccctggccatgctgctgaacatccccccccagaagaccctgctgcggcggcacctgaccaccaagttcaatgccctgattggccctgaggccgagcaggagaagcgggagaagatggccagccctgcctacacccccctgaccacccgctgggaccggctggctgatgccctggtgacctgccccctgtgcaccctgcgggcccacagcaacacagtgtgtgtgaccatctag

SEQ ID NO: 41633 - DNA, 411 bp, Artificial Sequence
  Description of Artificial Sequence: Synthetic coding sequence
atgatggaccaggaggagaagacagaggagggcagcggcccctgtgccgaggccggcagcccagaccaggagggcttcttcaacctgctgagccacgtgcagggcgacaggatggagggccagcgctgcagcctgcaggccggccctggccagaccaccaagagccagagcgaccccaccccagagatggacagcctgatggacatgctggccagcacccagggccgcaggatggatgaccagagggtgacagtgagcagcctgcccggcttccagcctgtgggcagcaaggatggagcccagaagagagctggcaccctgagcccccagcccctgctgaccccccaggaccccacagccctgggcttcagaagaaacagcagcccccagccccccacccaggccccctag

SEQ ID NO: 41634 - DNA, 207 bp, Artificial Sequence
  Description of Artificial Sequence: Synthetic coding sequence
atgtctgagctgaacaccaagaccagccctgccaccaaccaggccgccggccaggaggagaagggcaaggctggaaatgtgaagaaggccgaggaggaggaggagattgacatcgacctgacagcccctgagacagagaaggccgccctggccatccagggcaagttccgccgcttccagaagaggaagaaggaccccagcagctag

SEQ ID NO: 41635 - DNA, 1437 bp, Artificial Sequence
  Description of Artificial Sequence: Synthetic coding sequence
atgtggctggccgccgccgcccccagcctggcccggcggctgctcttcctgggccccccacctccacccctgctgctgctggtgttcagccgcagcagcagaagaaggctgcacagcctgggcctggccgccatgcctgagaagaggccctttgagcggctgcctgcagatgtgagccccatcaactgcagcctgtgcctgaagccagacctgctggacttcacctttgagggcaagctggaggccgccgcccaggtgcggcaggccaccaaccagatcgtgatgaactgtgccgacatcgacatcatcacagccagctatgccccagaaggagatgaggagatccacgccaccggcttcaactaccagaatgaagatgagaaggtgaccctgtccttccccagcaccctgcagacaggaacaggcaccctgaagattgactttgtgggggagctgaatgacaagatgaagggcttctaccgcagcaagtacaccacccccagcggggaggtgcgctatgctgctgtgacccagtttgaggccacagatgcccggcgggccttcccctgctgggatgagcccgccatcaaggccacctttgacatcagcctggtggtgcccaaggacagagtggccctgagcaacatgaatgtgattgacaggaagccctacccagatgatgagaacctggtggaggtgaagtttgcccggacccctgtgaccagcacctacctggtggcctttgtggtgggggagtatgactttgtggagaccaggagcaaggatggagtgtgtgtgtgtgtgtacacccctgtgggcaaggccgagcagggcaagtttgccatcgaggtggccgccaagaccctgcccttctacaaggactacttcaacgtgccctaccccctgcccaagattgacctgattgccatcgctgactttgctgctggggccatggagaactgggacctggtgacctaccgggagacagccctgctgattgaccccaagaacagctgcagcagcagccggcagtgggtggccctggtggtgggccacgagctggcccaccagtggtttggaaacctggtgaccatggagtggtggacccacctgtggctgaatgaaggatttgcctcctggattgagtacctgtgtgtggaccactgcttcccagaatatgacatctggacccagtttgtgtctgctgactacacccgggcccaggagctggatgccctggacaacagccaccccatcgaggtgtctgtgggccaccccagcgaggtggatgagatctttgatgccatctcctacagcaagggggccagcgtcatccgcatgctgcatgactacatcggggacaaggacttcaagaagggcatgaacatgtacctgaccaagttccagcagaagaatgctgctgctggcaacctgtag

SEQ ID NO: 41636 - DNA, 975 bp, Artificial Sequence
  Description of Artificial Sequence: Synthetic coding sequence
atgaagggcttctaccgcagcaagtacaccaccccatctggagaggtgcgctatgctgctgtgacccagtttgaggccacagatgcccggcgggccttcccctgctgggatgagcccgccatcaaggccacctttgacatcagcctggtggtgcccaaggacagagtggccctgagcaacatgaatgtcatcgacaggaagccctacccagatgatgagaacctggtggaggtgaagtttgcccggacccctgtgaccagcacctacctggtggcctttgtggtgggggagtatgactttgtggagaccaggagcaaggatggagtgtgtgtgtgtgtgtacacccctgtgggcaaggccgagcagggcaagtttgccatcgaggtggccgccaagaccctgcccttctacaaggactacttcaacgtgccctaccccctgcccaagattgacctgattgccatcgctgactttgctgctggggccatggagaactgggacctggtgacctaccgggagacagccctgctgattgaccccaagaacagctgcagcagcagccggcagtgggtggccctggtggtgggccacgagctggcccaccagtggtttggaaacctggtgaccatggagtggtggacccacctgtggctgaatgaaggatttgcctcctggattgagtacctgtgtgtggaccactgcttcccagaatatgacatctggacccagtttgtgtctgctgactacacccgggcccaggagctggatgccctggacaacagccaccccatcgaggtgtctgtgggccaccccagcgaggtggatgagatctttgatgccatctcctacagcaaaggagccagcgtcatccgcatgctgcatgactacatcggggacaaggacttcaagaagggcatgaacatgtacctgaccaagttccagcagaagaatgctgctgctggctggacctggtag

SEQ ID NO: 41637 - DNA, 729 bp, Artificial Sequence
  Description of Artificial Sequence: Synthetic coding sequence
ctggtgaagacagccaagctgggcacctcctggaactacctgtttgacttccacccccaccgggtgctggtggtgggcgcctttgccaacttctgcacagagcccaccggctgcagctgcctcttccccaagctgcccccccacctgctgatgctgccctgctggttccacctgctcttcttccaggactacatcatgtctggggccagcgccctgcccccaggcctggtgtcctttgtgaaggcccccctgccccagtggtggccaggcggctgccctggggtgggcggccccctgcaggccctggaggccaagccaggccagctgagcctgcccatccggaaccagaagaggctggtgaagagcgccctggagctgggggagaatgaactcttccagcagttccccaacccccagagctcctgggtgcagaggacccaggaggccctgcggcccctgctgtctgtggccctgcagctgttcctgggccggcggggcctgcccctgcccttccgggcccccatcagaacagtggtgggcagcgccatccctgtgcagcagagccccccacccagccctgcccaggtggacaccctgcaggcccgctacgtgggccgcctgacccagctgtttgaggagcaccaggcccgctatggagtgcctgctgacagacacctggtgctgacagaggcccggcccacagcctggccccggctgtctgctggatag

SEQ ID NO: 41638 - DNA, 1419 bp, Artificial Sequence
  Description of Artificial Sequence: Synthetic coding sequence
atggccggcggggaggccggcgtgaccctgggccagccccacctgagccggcaggacctgaccaccctggatgtgaccaagctgacccccctgagccatgaagtcatcagccggcaggccaccatcaacatcggcaccatcggccacgtggcccacggcaagagcacagtggtgaaggccatcagcggcgtgcacacagtgcgcttcaagaatgagctggagaggaacatcaccatcaagctgggctacgccaatgccaagatctaccagctggatgaccccagctgccccaggcctgagtgctaccgcagctgtggcagctccatgccagatgagttccccacagacatccctggcaccaagggcaacttccggctggtgagacatgtgtcctttgtggactgccccggccatgacatcctgatggccaccatgctgaatggagctgctgtgatggatgctgccctgctgctgattgctggaaatgaaagctgcccccagccccagaccagcgagcacctggccgccatcgagatcatgaagctgaagcacatcctgatcctgcagaacaagattgacctggtgaaggagcggcaggccaaggagcagtatgagcagatcctggcctttgtgcagggcaccgtggccgagggcgcccccatcatccccatcagcgcccagctgaagtacaacatcgaggtggtgtgtgagtacatcgtgaagaagatccctgtgcccccccgggacttcaccagcgagccccggctgattgtcatccgcagctttgatgtgaacaagccaggctgtgaggtggatgacctgaagggcggcgtggccggcggcagcatcctgaagggcgtgctgaaggtgggccaggagacagaggtgcggcccggcatcgtgtccaaggacagcgagggcaagctgatgtgcaagagcatcttcagcaagatcgtgtccctgtttgctgagcacaatgacctgcagtatgctgcccctgggggcctgattggagtgggcaccaagattgaccccaccctgtgcagagctgacaggatggtgggccagatcctgggcgctgtgggcgccctgcctgagatcttcacagagctggagatctcctacttcctgctgcggcggctgctgggcgtgaggacagaaggagacaagaaggccgccaaggtgcagaagctgagcaagaatgaggtgctgatggtgaacatcggcagcctgagcactggaggccgggtgtctgctgtgaaggctgacctgggcaagatcgtgctgaccaaccctgtgtgcacagaggtgggggagaagatcgccctgagcagaagagtggagaagcactggaggctcatcggctggggccagatccggcggggcgtgaccatcaagcccaccgtggatgatgactag

SEQ ID NO: 41639 - DNA, 543 bp, Artificial Sequence
  Description of Artificial Sequence: Synthetic coding sequence
atggaggaggccggcctgtgtggcctgcgggagaaggctgacatgctgtgcaacagcgagagccatgacatcctgcagcaccaggacagcaactgcagcgccaccagcaacaagcacctgctggaggatgaggagggccgggacttcatcaccaagaacagatcctgggtgtcccctgtgcactgcacccaggagagcagaagagagctgcctgagcaggaggtggcccctccttctggccagcaggccctgcagcagcaggagcagaggaagagcctgaggaagaggagcttcatcattgatgccagccccaagcacttccggctgcagaggaggtcctggcagctgtctgtgaggaacatgctgatcctggagatccacctgttctacagaagagtgtgctttgagctgtatgacctgaagcagaacagcttcttcggggactatggcaacatcctgaaccgggagaccctgctggactttgtgaagcagatcatggagaagatccagaacttcctgaagaaccacggcaagttcctgtag

SEQ ID NO: 41640 - DNA, 396 bp, Artificial Sequence
  Description of Artificial Sequence: Synthetic coding sequence
atggaggaggccggcctgtgtggcctgcgggagaaggctgacatgctgtgcaacagcgagagccatgacatcctgcagcaccaggacagcaactgcagcgccaccagcaacaagcacctgctggaggatgaggagggccgggacttcatcaccaagaacagatcctgggtgtcccctgtgcactgcacccaggagagcagaagagagctgcctgagcaggaggtggcccctccttctggccagcaggccctgcagtgcaacagaaacaaggagaaggtgctgggcaaggaggtgctgctgctgatgcaggccctgaacaccctgagcaccccagaggagaagctggccgccctgtgcaagaagtatgctgacctgggcaacagccccctgctgtag

SEQ ID NO: 41641 - DNA, 423 bp, Artificial Sequence
  Description of Artificial Sequence: Synthetic coding sequence
atggaggaggccggcctgtgtggcctgcgggagaaggctgacatgctgtgcaacagcgagagccatgacatcctgcagcaccaggacagcaactgcagcgccaccagcaacaagcacctgctggaggatgaggagggccgggacttcatcaccaagaacagatcctgggtgtcccctgtgcactgcacccaggagagcagaagagagctgcctgagcaggaggtggcccctccttctggccagcaggccctgcagtgcaacagaaacaaggagaaggtgctgggcaacaacctgtgcagcgtggtgggctgctgccacatcctggtgttcctgttctacatcttctgcagcatgtctgactatgagctgggcctgtttggaggcaagtgctgcctggtgaacctcttcctgcacctggtgtag

SEQ ID NO: 41642 - DNA, 513 bp, Artificial Sequence
  Description of Artificial Sequence: Synthetic coding sequence
tgaacatcctggaggagaggagaggtgaccccccggcggggcagcggcggcggggccaagaccatcggggccaagcagggccgcacccagctgagcagcggctttgtgaacagcaccatggaggaggccggcctgtgtggcctgcgggagaaggctgacatgctgtgcaacagcgagagccatgacatcctgcagcaccaggacagcaactgcagcgccaccagcaacaagcacctgctggaggatgaggagggccgggacttcatcaccaagaacagatcctgggtgtcccctgtgcactgcacccaggagagccggcgggagctgcctgagcaggaggtggccccacccagcggccagcaggccctgcagtgcaacagaaacaaggagaaggtgctgggcaaggaggtgctgctgctgatgcaggccctgaacaccctgagcaccccagaggagaagctggccgccctgtgcaagaagtatgctgacctgggcaacagccccctgctgtag

SEQ ID NO: 41643 - DNA, 396 bp, Artificial Sequence
  Description of Artificial Sequence: Synthetic coding sequence
atggaggaggccggcctgtgtggcctgcgggagaaggctgacatgctgtgcaacagcgagagccatgacatcctgcagcaccaggacagcaactgcagcgccaccagcaacaagcacctgctggaggatgaggagggccgggacttcatcaccaagaacagatcctgggtgtcccctgtgcactgcacccaggagagcagaagagagctgcctgagcaggaggtggcccctccttctggccagcaggccctgcagtgcaacagaaacaaggagaaggtgctggagcggcagggcctgagcctgagcccccggctggagcggggcggcaccttcatgggccacggcagcctgaagctgcctgagctggtgatcctgagcctgcagaccctggagtag

SEQ ID NO: 41644 - DNA, 546 bp, Artificial Sequence
  Description of Artificial Sequence: Synthetic coding sequence
atgaagcaggaggaggcccagctgaaggagcagctgttcctgtacatggacaagtttgaggagttccagaccaccatggccaagaccaatgagctgttcaccgccttcaagcaggagacagagaagctgaccaagaagatcaagaagctggagaaggagatggtgatctggtacaccaagtgggagaacaacaacaccaccctgctgcagatggccgaggagaagaccatccgggacaagaactacaaggtgttccagatcaagctggagcggctggagaagctgtacaaggccctgcagattgaaagaaatgagctgtctgagaagctgggcatcctgaagggccaggtgtctgtgaaggtggctgatgtggacctggccgtgcctgtgacccacagctgtgccgacctggacagcagcaacatgctgaacaccagcagcaagagggcccctggggtgcacctggaggccgaccccaagggcatgaatgaggtgaagtgctacagcaaggccctgagcacaggcagccccctgggcatcgactag

SEQ ID NO: 41645 - DNA, 546 bp, Artificial Sequence; identical to SEQ ID NO: 41644
  Description of Artificial Sequence: Synthetic coding sequence

SEQ ID NO: 41646 - DNA, 792 bp, Artificial Sequence
  Description of Artificial Sequence: Synthetic coding sequence
atggaccgggccaagcagcagcaggccctgctgctgctgcctgtgtgcctggccctgaccttcagcctgacagctgtggtgagcagccactggtgtgagggcacccggcgggtggtgaagcccctgtgccaggaccagcccggcggccagcactgcatccacttcaagagggacaacagcagcaatggccgcatggacaacaacagccaggccgtgctgtacatctgggagctgggagatgacaagttcatccagaggggcttccacgtgggcctgtggcagagctgtgaggagagcctgaatggagaagatgagaagtgccgctccttccgctctgtggtgcctgctgaggagcagggcgtgctgtggctgagcatcggcggggaggtgctggacatcgtgctgatcctgaccagcgccatcctgctgggcagccgggtgtcctgccgcagccctggcttccactggctgcgggtggatgccctggtggccatcttcatggtgctggccggcctgctgggcatggtggcccacatgatgtacaccaccatcttccagatcaccgtgaacctgggccctgaggactggaagccccagacctgggactatggctggagctactgcctggcctggggcagctttgccctgtgcctggccgtgtctgtgtctgccatgagccgcttcaccgctgcccggctggagttcacagagaagcagcaggcccagaatggcagccgccacagccagcacagcttcctggagcctgaggccagcgagagcatctggaagtag

SEQ ID NO: 41647 - DNA, 888 bp, Artificial Sequence
  Description of Artificial Sequence: Synthetic coding sequence
atggccgaggagacccagcacaacaagctggccgccgccaagaagaagctgaaggagtactggcagaagaaccggccccgggtgcctgctggggtgaacagaaacaggaagaccaacggcagcatccctgagacagccaccagcggcggctgccagcccccaggggacagcgccaccggcttccaccgggagggccccaccagcagcgccaccctgaaggacctggagagcccctgccaggagagagctgtggtgctggacagcacctctgtgaagatcagccggctgaagaacaccatcaagagcctcatctgcaccctgaagaaggagaagcagcaggacatgagaagagtggaggagctggagaggagcctgagcaagctgaagaaccagatggccgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggtgaaggagacagagaccagcacccccagcaagaagggctgggaggccggcagcagcctgctgggcggggaggtgcccggccagaggcagctgcctgcctggggcctggtgaccacagcccccaggagagctgtgctgcggctcttcctggccagctgcctgtag

SEQ ID NO: 41648 - DNA, 888 bp, Artificial Sequence; identical to SEQ ID NO: 41647
  Description of Artificial Sequence: Synthetic coding sequence

SEQ ID NO: 41649 - DNA, 720 bp, Artificial Sequence
  Description of Artificial Sequence: Synthetic coding sequence
tctgccaccggcttccaccgggagggccccaccagcagcgccaccctgaaggacctggagagcccctgccaggagagagctgtggtgctggacagcacctctgtgaagatcagccggctgaagaacaccatcaagagcctcatctgcaccctgaagaaggagaagcagcaggacatgagaagagtggaggagctggagaggagcctgagcaagctgaagaaccagatggccgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggtgaaggagacagagaccagcacccccagcaagaagggctgggaggccggcagcagcctgctgggcggggaggtgcccggccagaggcagctgcctgcctggggcctggtgaccacagcccccaggagagctgtgctgcggctcttcctggccagctgcctgtag

SEQ ID NO: 41650 - DNA, 1899 bp, Artificial Sequence
  Description of Artificial Sequence: Synthetic coding sequence
atggccgaggagacccagcacaacaagctggccgccgccaagaagaagctgaaggagtactggcagaagaaccggccccgggtgcctgctggggtgaacagaaacaggaagaccaacggcagcatccctgagacagccaccagcggcggctgccagcccccaggggacagcgccaccggcttccaccgggagggccccaccagcagcgccaccctgaaggacctggagagcccctgccaggagagagctgtggtgctggacagcacctctgtgaagatcagccggctgaagaacaccatcaagagcctgaagcagcagaagaagcaggtggagcaccagctggaggaggagaagaaggccaacaatgaaaggcagaaggccgagcgggagctggaggtgcagatccagaccctcatcatccagaaggaggagctgaacacagacctgtaccacatggagaggagcctgcgctactttgaggaggagagcaaggacctggccgtgcggctgcagcacagcctgcagtgcaagggggagctggagagcgccctgtctgctgtgattgccacagagaagaagaaggccaaccagctgagcagctgcagcaaggcccacacagagtgggagctggagcagagcctgcaggaccaggccctgctgaaggcccagctgacccagctgaaggagagcttccagcagctgcagctggagagagatgaatgtgccgagcacattgaaggagagcgggcccgctggcaccagaggatgagcaagatgagccaggagatctgcaccctgaagaaggagaagcagcaggacatgagaagagtggaggagctggagaggagcctgagcaagctgaagaaccagatggccgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggagcacctggaggccgccagccagcagaaccagcagctgacagcccagctgagcctgatggccctgcctggagagggccatggaggagagcacctggacagcgagggggaggaggccccccagcccatgcccagcgtgcctgaggacctggagagccgggaggccatgagcagcttcatggaccacctgaaggagaaggctgacctgtctgagctggtgaagaagcaggagctgcgcttcatccagtactggcaggagcgctgccaccagaagatccaccacctgctgtctgagcccggcggccgggccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacagcgcagatgagcccggccctggggccccagccccccaggagctgggcgctgctgacaagcatggagacctgcgggaggtgaccctgaccagcagcgcccagggcgaggcccgggaggaccccctgctggacaagcccacagcccagcccatcgtgcaggaccaccaggagcaccctggcctgggcagcaactgctgcgtgcccctcttctgctgggcctggctgcccaggagaagaagatag

SEQ ID NO: 41651 - DNA, 1899 bp, Artificial Sequence
  Description of Artificial Sequence: Synthetic coding sequence
atggccgaggagacccagcacaacaagctggccgccgccaagaagaagctgaaggagtactggcagaagaaccggccccgggtgcctgctggggtgaacagaaacaggaagaccaacggcagcatccctgagacagccaccagcggcggctgccagcccccaggggacagcgccaccggcttccaccgggagggccccaccagcagcgccaccctgaaggacctggagagcccctgccaggagagagctgtggtgctggacagcacctctgtgaagatcagccggctgaagaacaccatcaagagcctgaagcagcagaagaagcaggtggagcaccagctggaggaggagaagaaggccaacaatgaaaggcagaaggccgagcgggagctggaggtgcagatccagaccctcatcatccagaaggaggagctgaacacagacctgtaccacatggagaggagcctgcgctactttgaggaggagagcaaggacctggccgtgcggctgcagcacagcctgcagtgcaagggggagctggagagcgccctgtctgctgtgattgccacagagaagaagaaggccaaccagctgagcagctgcagcaaggcccacacagagtgggagctggagcagagcctgcaggaccaggccctgctgaaggcccagctgacccagctgaaggagagcttccagcagctgcagctggagagagatgaatgtgccgagcacattgaaggagagcgggcccgctggcaccagaggatgagcaagatgagccaggagatctgcaccctgaagaaggagaagcagcaggacatgagaagagtggaggagctggagaggagcctgagcaagctgaagaaccagatggccgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggagcacctggaggccgccagccagcagaaccagcagctgacagcccagctgagcctgatggccctgcctggagagggccatggaggagagcacctggacagcgagggggaggaggccccccggcccatgcccagcgtgcctgaggaccctgagagccgggaggccatgagcagcttcatggaccacctgaaggagaaggctgacctgtctgagctggtgaagaagcaggagctgcgcttcatccagtactggcaggagcgctgccaccagaagatccaccacctgctgtctgagcccggcggccgggccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacagcgcagatgagcccggccctggggccccagccccccaggagctgggcgctgctgacaagcatggagacctgcgggaggtgaccctgaccagcagcgcccagggcgaggcccgggaggaccccctgctggacaagcccacagcccagcccatcgtgcaggaccaccaggagcaccctggcctgggcagcaactgctgcgtgcccctcttctgctgggcctggctgcccaggagaagaagatag

SEQ ID NO: 41652 - DNA, 690 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatctttggacatggagacacctacctgcgctgcatcgaggtgcacagccacaccctcatccagctggagagctggttcaccgccaccggccagaccagggtgacagtggtgggcccccaccgggcccggcagtggctgctgcacatgttctgctgcgtgggcagccaggacagctaccaccacgcccggggcggcagcacagcctggccctgggagcgggtgctgagcgcccggagccggggcggcccctgccccaagaccttcatcctgcagtggtgcagcacctggaagaggaccaggaggagcagcagcagtgacctgatgaccaggacctttgctgccctgagctgcacagccacccccctcttctcctggtgcttcaccgccaccggccagaccagggtgacagtggtgggcccccccatggccaagcagtggctgctgctgatgttccactgtgtgggcagccaggacagcaaatgtcatgcccggggcctgaagatgctggagcgggtgcgcagccagcccctgaccaatgatgacctggtgacctctgtgtccctgcccccctacacaggagactag

SEQ ID NO: 41653 - DNA, 492 bp, Artificial Sequence
  Description of Artificial Sequence: Synthetic coding sequence
atgagcagctgccctgtgcatgactgccccagctgggaccctgagcggctggagcctgtggagaccggcagcagaggagccctgcggctgcggggcggggcccctggcagcgctgctggcttccgggccagcatctggggccctgctggctaccccagccctgtgggcctgggccacccagccagcctgcccaggcctgcctacagcccccgctgcccagagccagatgcccggcacggctggggcagcggcagcaatgccggctaccggggccctgacagagctggcaccccctgcccagcccaggaccgggagggccgcagcagcagccctgtgcccccaccccggctgaaggccatgaccagccaggccaggaagcagaatggaggagccctgattgacacagtggactggacccgggaggccccagacagcgaccctgtgatgtccatgcagaagacccagaagccccagaccaccgtgggccagtag

SEQ ID NO: 41654 - DNA, 591 bp, Artificial Sequence
  Description of Artificial Sequence: Synthetic coding sequence
atggaccatgaagctgcccagctggagaagcagcacgtgcacaacgtgtatgagagcacagccccctacttcagtgacctgcagagcaaggcctggccccgggtgcggcagttcctgcaggagcagaagccaggcagcctgattgctgacatcggctgcggcaccgggaagtacctgaaggtgaacagccaggtgcacacagtgggctgtgactactgcggccccctggtggagatcgccaggaacagaggctgtgaggccatgggcctggagcacccctggatctggtacccccgggcctcctggaaccagcccccaacagacatcgagggcccccagtacttctacccaccctgccaccccatcccagacctgcagaagcagaccatcatctgccacttcaagggccccaccctgaatgagcagcagaagagcagccccacccaccaccggctgcacgcctgcttccagcactgccgggaggaggagagccggccctggctgatggccctgagctcctgggaccaggtggccatggagggccacgtgtctgccagcctgaccagctgcatcgtgcggctgctgctgtag

SEQ ID NO: 41655 - DNA, 1365 bp, Artificial Sequence
  Description of Artificial Sequence: Synthetic coding sequence
atggaccatgaagctgcccagctggagaagcagcacgtgcacaacgtgtatgagagcacagccccctacttcagtgacctgcagagcaaggcctggccccgggtgcggcagttcctgcaggagcagaagccaggcagcctgattgctgacatcggctgcggcaccgggaagtacctgaaggtgaacagccaggtgcacacagtgggctgtgactactgcggccccctggtggagatcgccaggaacagaggctgtgaggccatggtgtgtgacaacctgaacctgcccttcagagatgagggctttgatgccatcatcagcattggagtcatccaccacttcagcaccaagcagaggcgcatccgggccatcaaggagatggcccgggtgctggtgcctgggggccagctgatgatctacgtgtgggccatggagcagaagaacagacactttgagaagcaggatgtgctggtgccctggaacagagccctgtgcagccagctgttcagcgagagcagccagagcggcaggaagaggcagtgtggctacccagagcggggccacccctaccaccccccctgcagcgagtgcagctgcagcgtgtgcttcaaggagcagtgtggcagcaagaggagccacagcgtgggctatgagcccgccatggcccggacctgctttgccaacatcagcaaggagggggaggaggagtatggcttctacagcaccctgggcaagagcttccgctcctggttcttcagccgcagcctggatgagagcaccctgaggaagcagatcgagcgggtgcggcccctgaagaacacagaggtgtgggccagcagcacagtgacagtgcagcccagccgccacagcagcctggactttgaccaccaggagcccttcagcaccaagggccagagcctggatgaggaggtgtttgtggagagcagcagcggcaagcacctggagtggctgcgggcccctggcaccctgaagcacctgaatggagaccaccagggcgagatgagaagaaatggaggcggcaacttcctggacagcaccaacacaggagtgaactgtgtggatgctggcaacattgaagatgacaaccccagcgccagcaagatcctgcggcgcatctctgctgtggacagcacagacttcaacccagatgacaccatgtctgtggaggacccccagacagatgtgctggacagcacagccttcatgagatactaccacgtgttccgggagggggagctgtgcagcctgctgaaggaaaatgtgtctgagctgcgcatcctgagcagtggaaatgaccacggcaactggtgcatcatcgccgagaagaagaggggctgtgactag

SEQ ID NO: 41656 - DNA, 1104 bp, Artificial Sequence
  Description of Artificial Sequence: Synthetic coding sequence
atggtgtgtgacaacctgaacctgcccttcagagatgagggctttgatgccatcatcagcattggagtcatccaccacttcagcaccaagcagaggcgcatccgggccatcaaggagatggcccgggtgctggtgcctgggggccagctgatgatctacgtgtgggccatggagcagaagaacagacactttgagaagcaggatgtgctggtgccctggaacagagccctgtgcagccagctgttcagcgagagcagccagagcggcaggaagaggcagtgtggctacccagagcggggccacccctaccaccccccctgcagtgaatgtagctgcagcgtgtgcttcaaggagcagtgtggcagcaagaggagccacagcgtgggctatgagcccgccatggcccggacctgctttgccaacatcagcaaggagggggaggaggagtatggcttctacagcaccctgggcaagagcttccgctcctggttcttcagccgcagcctggatgagagcaccctgaggaagcagatcgagcgggtgcggcccctgaagaacacagaggtgtgggccagcagcacagtgacagtgcagcccagccgccacagcagcctggactttgaccaccaggagcccttcagcaccaagggccagagcctggatgaggaggtgtttgtggagagcagcagcggcaagcacctggagtggctgcgggcccctggcaccctgaagcacctgaatggagaccaccagggcgagatgagaagaaatggaggcggcaacttcctggacagcaccaacacaggagtgaactgtgtggatgctggcaacattgaagatgacaaccccagcgccagcaagatcctgcggcgcatctctgctgtggacagcacagacttcaacccagatgacaccatgtctgtggaggacccccagacagatgtgctggacagcacagccttcatgagatactaccacgtgttccgggagggggagctgtgcagcctgctgaaggaaaatgtgtctgagctgcgcatcctgagcagtggaaatgaccacggcaactggtgcatcatcgccgagaagaagaggggctgtgactag

SEQ ID NO: 41657 - DNA, 2547 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagatcgtgctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacacccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 41658 - DNA, 3417 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagatcgtgctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaagctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacccccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 41659 - DNA, 2979 bp, Artificial Sequence
  Description of Artificial Sequence: Synthetic coding sequence
atgttccagagggcccaggagctgcggcggcgggcagaggactaccacaagtgcaagatccccccatctgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtctgctgacccccctgccccccagcgcagatgacaacctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaagctgaagaccccaccagaatgtctgctgacccccctgccccccagcgccctgcccagcgccccacccagcgcagatgacaacctgaagaccagggctgagtgcctgctgcaccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagatcccagctgagcggctgcgcatccccctgcccccatctgcagatgacaacctgaagacccccagcgagcggcagctgacccccctgccccccagcgccccacccagcgcagatgacaacatcaagaccccagccttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacacccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 41660 - DNA, 1263 bp, Artificial Sequence
  Description of Artificial Sequence: Synthetic coding sequence
atggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaagctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 41661 - DNA, 1986 bp, Artificial Sequence
  Description of Artificial Sequence: Synthetic coding sequence
atgttccagagggcccaggagctgcggcggcgggcagaggactaccacaagtgcaagatccccccatctgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgcagatgacaacctgaagaccccaccagaatgtctgctgacccccctgccccccagcgccccacccagcgccccacccagcgcagatgacaacctgaagaccagggctgagtgcctgctgcaccccctgcccccatctgcagatgacaacctgaagacccccagcgagcggcagctgacccccctgccccccagcgccccacccagcgcagatgacaacatcaagaccccagccttccacccccagaggatgatcatcagccgccacctgcccagcgtgagcagcctgcccttccacccccagctgcacagccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccccaagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaaggctgtcctag

SEQ ID NO: 41662 - DNA, 1263 bp, Artificial Sequence
  Description of Artificial Sequence: Synthetic coding sequence
atggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgcagatgacaacctgaagaccccacctgagtgcctgctgacccccctgcccccatctgcccctccttctgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccccaagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaaggctgtcctag

SEQ ID NO: 41663 - DNA, 2505 bp, Artificial Sequence
  Description of Artificial Sequence: Synthetic coding sequence
atgaaggtgattgtcatccacaggaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgcagatgacaacctgaagaccccacctgagtgcctgctgacccccctgcccccatctgcccctccttctgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcagatgacaacatcaagaccccagccttccacccccagaggatgatcatcagccgccacctgcccagcgtgagcagcctgcccttccacccccagctgcacagccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccccaagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaaggctgtcctag

SEQ ID NO: 41664 - DNA, 591 bp, Artificial Sequence
  Description of Artificial Sequence: Synthetic coding sequence
atgatccgctgtggcctggcctgtgagcgctgccgctggatcctgaccctgctgctgctgagcgccatcgcctttgacatcatcgccctggccggccggggctggctgcagagcagtgacagagtgcagaccagcagcctgtggtggcgctgcttcctgccccagggcagaagaagacggcagagggtgctgcggggccgcctgccccagccccacggcgtgcgggtgggcagcagcagcgctgccatgctgttctggggcgtgtccatcctggtgatctgcttcatcctgtccttctttgtgctgtgtgtgccccagatcctggtgttcctgcgggtcatcggcggcctgctggccctggccgctgtgttccagatcatcagcctggtgatctaccctgtgaagtacacccagcccagcaccttcatgcccagccctgctgtgaccagcatctacaactgggcctgtggcttcggctgggccgccatgatcatcctgattggctgtgccttcttctgctgctgcctgcccagctgtgaagatgacctgctgggcaacaccaagccccgctacttctacaccagcgcctag

SEQ ID NO: 41665 - DNA, 1389 bp, Artificial Sequence
  Description of Artificial Sequence: Synthetic coding sequence
atggacagcctgtggggccctggagctggcagccaccccttcggcgtgcacaacacccggctgagcccagacctgtgccctgggaagatcgtgctgcgggccctgaaggagagcggggccggcatgcctgagcaggacaaggacccccgggtgcaggagaaccctggggaccagaggagagtgcctgaggtgactggagatgcccccagcgccttccggcccctgcgggacaacagaggcctgagcccctttgtgcccggccctggccccctgcagacagacctgcacgcccagaggtctgagatccgctacaaccagaccagccagacctcctggaccagcagctgcaccaacagaaatgccatcagcagcagctacagcagcactggaggcctgcccggcctgaagagaagaagaggccctgccagcagccactgccagctgaccctgagcagcagcaagacagtgtctgaggaccggccccaggccgtgagcagcggccacacccagtgtgagaaggctgctgacatcgcccctggccagaccctggccctgagaaatgacagcagcaccagcgaggccagccggcccagcacccacaagttccccctgctgccccggcggcggggggagcccctgatgctgcccccacccctggagctgggctacagagtgacagtggaggacctggaccgggagaaggaggccgccttccagaggatcaacagcgccctgcaggtggaggacaaggccatcagtgactgccggcccagccggcccagccacaccctgagcagcctggccaccggcaccagcggcctgcctgccatcagcaaggcccccagcatggatgtgcagcaggagacccacaagagccaggactgcctgggcctgctggcccccctggccagcgctgctggggtgcccagcacagcccccatgtctgggaagaagcacaagcccccaggccccctcttcagcagcagtgaccccctgcctgccaccagcagccacagccaggacagcgcccaggtgaccagcctcatcccagcccccttccctgctgcctccatggatgtgggcatgaggaggacccgctgtggcaccagcgccccagctgctgctgctgctgcccccccacccagcaccctgaaccccaccctgggcagcctgctggagtggatggaggccctgcacatcagcggcccccagccccagctgcagcaggtgccccggggccagaaccagaggagccagaccagcaggaccagcagctgccccaagagaaatgccatcagcagcccctaccgcagcactggaggcctgcctgagaggaagagaagaagaggccctgccagcagccactgccagctgaacctgagcagctag

SEQ ID NO: 41666 - DNA, 381 bp, Artificial Sequence
  Description of Artificial Sequence: Synthetic coding sequence
atgggccgcatcttccagctgctgcgggaccggcgcatcagcagccggggccctggcctgcacacccccaaggccgagcccaggaggaggaagggcctgaccaccggcctgatgacccaggccgagcggcagaagcaggcccaccagaggcaggccgccatgagggagacagccctgtggtgcaccggccacatccggcccaggacccacacccacacaggcacccacacccagacagaccgggagcgggagaggaacacccagaggctgcgggaccgggagaggagagaaaatggccgccacacccacatccacacccagacccacacccagagcctcatcgccaaggccctgaaggacacccaccctggcaacccctag

SEQ ID NO: 41667 - DNA, 1395 bp, Artificial Sequence
  Description of Artificial Sequence: Synthetic coding sequence
atgatggcctgccgggaccccaagccaggggccaagaggctggtgcgggcccagaccctgcagaagcagaggcgggcccctgtgggcccccgggcccctcctccagatgaggaggacccccggctgaagtgcaagaactgtggggccttcggccacatggcccggagcacccgctgccccatgaagtgctggaaggccgccctggtgccccccaccctgggcaagaaggagggcaaggagaacctgaagccctggaagccccaggtggaggccaaccctggccccctgaacaaggacaagggggagaaggaggagcggccccggcagcaggacccccagaggaaggccctgctgcacatcttcagcggcaagcccccagagaagcccctgcccaacaggaagggcagcacagagagctctgtgtacctgcgggtggccagcggccccatgcctgtgcacaccaccagcaagaggccccgggtggaccctgtgctggccgacagaagtgccacagagatgtctgaccggggcagcgccctggccagcctgagccccctgaggaaggccagcctgagcagcagcagcagcctgggccccaaggagcggcagacaggagctgctgctgacatcccccagcctgctgtgcgccaccagggccctgagcccctgctggtggtgaagcccacccacagcagccctgagggcggctgccgggaggtgccccaggccgccagcaagacccacggcctgctgcaggccatcagcccccaggcccaggacaagaggcctgctgtgaccagccagccctgccccccagctgccacccacagcctgggcctgggcagcaacctgagctttggacctggggccaagaggcctgcccaggcccccatccaggcctgcctgaacttccccaagaagccccggctgggccccttccagatccctgagagcgccatccagggcggggagctgggcgcccctgagtacctgcagcccccaccagccaccacagagctgggccccagcaccagcccccagatgggccgccgcaccccagcccaggtgtcctctgtggaccggcagcccccccacagccggccctgcctgcccacagcccaggcctgcaccatgagccaccacccagccaccagccatgatggagcccagcccctgcgggtgctcttccggcggctggagaatggccgctggagcagcagcctgctggccgcccccagcttccacagccctgagaagccaggggccttcctggcccagagcccccacgtgtctgagaagtctgaggtgccccgggtgcgggtgccccccaacgtgctgtatgaggacctgcaggtgagcagcagcagtgaagattctgacagcgacctggagtag

SEQ ID NO: 41668 - DNA, 1383 bp, Artificial Sequence
  Description of Artificial Sequence: Synthetic coding sequence
cagatggcccggcacagcgtgcaccaccaggcccagaggcctccccgggccaagaacccccaggagcagcagaggcggcccatgggccagaccaccctgcctgctgagcaggaggagagccgggtgaagtgcaagaactgtggggccttcggccacagcgcccggagcaagacctgccccatcaagcgctggagcggggccctgcccctgcaggccctgggcagccacaaggagaaggagaacctgaagccagccaaggcccagctgcccttcaccaccccaggccccttcaccaccaatgaccgggagaaggagaggagccccagcccccagcagcagcagagcgaggcccccacccagaccttccccaggaccccccaggagaagatgcaggaggcctggaaggagcctgctgaggactgcctcttcctgcggcaccccaccatgcccctgcctgtgcacaccaccaagaagaggtctgtgctgggccctgtgtccactggacctcctcctgtgaacaagccagagatgaggctgctgtgccccagcggccacaatgacagcccccagctgagcacctgtggccccaccaagggccacggcagagatgtgacagccagcctgctgcctgtgctgaagagcagccaccagacccccaccctgagcgcccggctgcctgccaacagaccagacatgagcagccatggagccctgcagcctgccatgcaggccctggccctgggccctggcctgaagagccaggccgagatcaagcacccagatgctgatgccaagccccggccccagcaggtgaggaagcagtgtggccaggacagcaggacccaggccccagacaaggagcccgcccctgtgcccacccagaccttccagaacccagccaagaaggcccgcttcagcagcttccagaccccagccctgcggacccagctgcctgatgtgggcgctgtgcagaccctgcagccccccaggacagccaccggcctgggcagcaaggaggcccccaaggccacagctgagacagctgccaccaagacagccaccctgcagccccgggtgaacctgcagcctgcccccagcagccccttcctgggccctgcccagggctgccctgtgctgcagcccggcccccccatccacgtgcccggccggcccggctctgtgaccttcatgagaggagacaagggccagaagagcccccgcttcaggatgccacccaccagccggcccccagagaacagcgccagcgcccagagcccccgcttcagccggcagcctgagggccagggcccccaggtgtccacctctgtgctgtatgaggacctgctggtgaccagcagcagtgaagattctgacagcgactag

SEQ ID NO: 41669 - DNA, 894 bp, Artificial Sequence
  Description of Artificial Sequence: Synthetic coding sequence
tttgtgctgggcgctgtgtccccagctgtggtggtgctgtacaccatggtgctgcaggagaatggctatggagtggaggaggacatccccaccctgctgatggccgccagctccatggatgacctgctggccatcaccggcttcaacacctgcctgagcatcgtgttctacagcggcggcatgatcaacaatgccatcgccagcctgagaaatgtgtgcatcagcctgctggccggcatcgtgctgggcttctttgtgcgctacttccccagcgaggaccagaagaagatcaccctgaagaggggcttcctggtgctgatcacctttgtgtctgctgtgctgggcagccagcccatcggcctgcacggcagcggcggcctgtgcaccctggtgctgcacttcatcgagtggaccaagtggagccaggagaagatgaaggtgcagaagatcatcaccaacgtgtgggacatcttccagcccctgctgtttggcctggtgggcgctgaggtgtctgtgtccctgctggagagcaacatcgtgggcatctctgtgtccaccctgagcctggccctgtgtgtgcgcatcctgaacatctacctgctgatgtgctttgctggcttctccttcaaggagaagatcttcatcgccctggcctggatgcccaaggccaccgtgcaggccgtgctgggccccctggccctggagacagcccgggtgtccaccccccacctggagacctacgccaaggatgtgatgacagtggccttcctggccatcatgatcacagccccaaatggagccctgctgatgggcatcctgggccccaagatgctgaccaggcactatgaccccagcaagatcaagctgcagctgagcaccctggagcaccactag

SEQ ID NO: 41670 - DNA, 2325 bp, Artificial Sequence
  Description of Artificial Sequence: Synthetic coding sequence
atggagcctgagcgggagggcacagagcggcaccccaggaaggtgcgggagagccggcaggcccccaacaagctggtgggcgctgctgaggccatgaaggccggctgggacctggaggagagccagcctgaggccaagaaggcccggctgagcaccatcctcttcacagacaactgtgaggtgacccatgaccagctgtgtgagctgctgaagtatgctgtgctgggcaagagcaatgtgcccaagcccagctggtgccagctgttccaccagaaccacctgaacaacgtggtggtgtttgtgctgcagggcatgagccagctgcacttctaccgcttctacctggagtttggctgcctgaggaaggccttccgccacaagttccggctgcccccacccagcagtgacttcctggctgatgtggtgggcctgcagacagagcagagagctggggacctgcccaagaccatggagggccccctgcccagcaatgccaaggccgccatcaacctgcaggatgaccccatcatccagaagtatggcagcaagaaggtgggcctgacccgctgcctgctgaccaaggaggagatgaggaccttccacttccccctgcagggcttcccagactgtgagaacttcctgctgaccaagtgcaatggcagcattgctgacaacagccccctgtttggcctggactgtgagatgtgcctgaccagcaagggccgggagctgacccgcatcagcctggtggccgagggcggctgctgcgtgatggatgagctggtgaagccagagaacaagatcctggactacctgaccagcttcagcggcatcaccaagaagatcctgaaccctgtgaccaccaagctgaaggatgtgcagaggcagctgaaggccctgctgcccccagatgctgtgctggtgggccacagcctggacctggacctgcgggccctgaagatgatccacccctacgtgattgacaccagcctgctgtatgtgcgggagcagggccgccgcttcaagctgaagttcctggccaaggtgatcctgggcaaggacatccagtgcccagaccggctgggccatgatgccacagaagatgcccggaccatcctggagctggcccgctacttcctgaagcacggccccaagaagattgctgagctgaacctggaggccctggccaaccaccaggagatccaggccgccggccaggagcccaagaacacagctgaggtgctgcagcaccccaacacctctgtgctggagtgcctggacagcgtgggccagaagctgctcttcctgacccgggagacagatgctggggagctgcccagcagcaggaactgccagaccatcaagtgcctgagcaacaaggaggtgctggagcaggcccgggtggagatccccctcttccccttcagcatcgtgcagttctccttcaaggccttcagccctgtgctgacagaggagatgaacaagaggatgaggatcaagtggacagagatcagcacagtgtatgccggccccttcagcaagaactgcaacctgcgggccctgaagaggctcttcaagagctttggacctgtgcagagcatgacctttgtgctggagacccggcagccccacctgtgcatccagtatgaggtgctggaggccgcccagctggccatcgagagcctggatggcatcctggtggatggcatctgcatcaaggtgcagaggcctgtgacagagctgaccctggactgtgacaccctggtgaatgagctggagggggacagcgagaaccagggcagcatctacctgtctggagtgtctgagaccttcaaggagcagctgctgcaggagcccaggctcttcctgggcctggaggccgtcatcctgcccaaggacctgaagagcggcaagcagaagaagtactgcttcctgaagttcaagagctttggcagcgcccagcaggccctgaacatcctgaccgggaaggactggaagctgaagggcagacatgccctgacccccaggcacctgcacgcctggctgcggggcctgcccccagagagcacccggctgcccggcctgcgggtggtgcccccaccatttgagcaggaggccctgcagaccctgaagctggaccaccccaagattgctgcctggcgctggagcaggaagattggcaagctgtacaacagcctgtgccccggcaccctgtgcctgatcctgctgcccggcaccaagagcacccacggcagcctgagcggcctgggcctgatgggcatcaaggaggaggaggagagcgctggccctggcctgtgcagctag

SEQ ID NO: 41671 - DNA, 2232 bp, Artificial Sequence
  Description of Artificial Sequence: Synthetic coding sequence
atggagcctgagcgggagggcacagagcggcaccccaggaaggtgcgggagagccggcaggcccccaacaagctggtgggcgctgctgaggccatgaaggccggctgggacctggaggagagccagcctgaggccaagaaggcccggctgagcaccatcctcttcacagacaactgtgaggtgacccatgaccagctgtgtgagctgctgaagtatgctgtgctgggcaagagcaatgtgcccaagcccagctggtgccagctgttccaccagaaccacctgaacaacgtggtggtgtttgtgctgcagggcatgagccagctgcacttctaccgcttctacctggagtttggctgcctgaggaaggccttccgccacaagttccggctgcccccacccagcagtgacttcctggctgatgtggtgggcctgcagacagagcagagagctggggacctgcccaagaccatggagggccccctgcccagcaatgccaaggccgccatcaacctgcaggatgaccccatcatccagaagtatggcagcaagaaggtgggcctgacccgctgcctgctgaccaaggaggagatgaggaccttccacttccccctgcagggcttcccagactgtgagaacttcctgctgaccaagtgcaatggcagcattgctgacaacagccccctgtttggcctggactgtgagatgtgcctgaccagcaagggccgggagctgacccgcatcagcctggtggccgagggcggctgctgcgtgatggatgagctggtgaagccagagaacaagatcctggactacctgaccagcttcagcggcatcaccaagaagatcctgaaccctgtgaccaccaagctgaaggatgtgcagaggcagctgaaggccctgctgcccccagatgctgtgctggtgggccacagcctggacctggacctgcgggccctgaagatgatccacccctacgtgattgacaccagcctgctgtatgtgcgggagcagggccgccgcttcaagctgaagttcctggccaaggtgatcctgggcaaggacatccagtgcccagaccggctgggccatgatgccacagaagatgcccggaccatcctggagctggcccgctacttcctgaagcacggccccaagaagattgctgagctgaacctggaggccctggccaaccaccaggagatccaggccgccggccaggagcccaagaacacagctgaggtgctgcagcaccccaacacctctgtgctggagtgcctggacagcgtgggccagaagctgctcttcctgacccgggagacagatgctggggagctgcccagcagcaggaactgccagaccatcaagtgcctgagcaacaaggaggtgctggagcaggcccgggtggagatccccctcttccccttcagcatcgtgcagttctccttcaaggccttcagccctgtgctgacagaggagatgaacaagaggatgaggatcaagtggacagagatcagcacagtgtatgccggccccttcagcaagaactgcaacctgcgggccctgaagaggctcttcaagagctttggacctgtgcagagcatgacctttgtgctggagacccggcaggtgcagaggcctgtgacagagctgaccctggactgtgacaccctggtgaatgagctggagggggacagcgagaaccagggcagcatctacctgagcggcgtgtctgagaccttcaaggagcagctgctgcaggagcccaggctcttcctgggcctggaggccgtcatcctgcccaaggacctgaagagcggcaagcagaagaagtactgcttcctgaagttcaagagctttggaagtgcccagcaggccctgaacatcctgaccgggaaggactggaagctgaagggcagacatgccctgacccccaggcacctgcacgcctggctgcggggcctgcccccagagagcacccggctgcccggcctgcgggtggtgcccccaccatttgagcaggaggccctgcagaccctgaagctggaccaccccaagattgctgcctggcgctggagcaggaagattggcaagctgtacaacagcctgtgccccggcaccctgtgcctgatcctgctgcccggcaccaagagcacccacggcagcctgagcggcctgggcctgatgggcatcaaggaggaggaggagagcgctggccctggcctgtgcagctag

SEQ ID NO: 41672 - DNA, 2082 bp, Artificial Sequence
  Description of Artificial Sequence: Synthetic coding sequence
agcctgccccagagcgaggcccagggccaggccgtggacctgcggacccctgtgtcctgcctgcggggccgcctgcccccaggccacacagaggcccggctggtgggcggggagcacccctgtgccggccgcctggaggtgacctggggcaccgtgtgtgatgctgccctggacctggccacagcccacgtggtgtgccgggagctgcagtgtggggctgtggtgtccaccccagagggcgccaggtttggccggggcagcggccctgtgtggacagaggccttccgctgtgctggaaatgaaagcctgctcttccactgcccccggggccggggcagccagtgtggccacggccatgatgctggcctgcgctgcagcgagttcaggatggtgaatggcagcagcagctgtgagggccgggtggagttccaggtgcagggctcctgggcccccctgtgtgccacccactgggacattgctgatgccaccgtgctgtgccaccagctgaactgtggaaatgctgtggccgcccctgggggcggccactttggagatggagatgctgccatctggccagatgccttccactgtgagggcacagagagctacctgtggaactgccctgtgtccaccctgggcgccccagcctgtgcccctggcaacacagccagcgctgtgtgcagcggcctggcccacgccctgcggctgcgggagggccagagccgctgtgatggccgggtggaggtgtccctggatggagtgtggggccgggtgctggatgatgcctgggacctgcggggggccggcgtggtgtgccggcagctgggctgccgcggggcccagcaggcctatgatgccccagcccccagccggggctctgtgcaggtggccctgagccgggtgcgctgcctgggcacagagacccggctgacccagtgcaatgtgtctgccaccctgcaggagcctgctggcaccagcagagatgctggggtggtgtgcagcggggaggtgggcacagccagccccatggccaggagacatggcatccctggggccctgaccctgagcctgcaccgggagccccagggcgctgctggaagaggagctggggccctgcatggaggagcctggggcaccgtgtgtgatgatgcctgggacctgagagatgcccacgtggtgtgccggcagctgggctgcggccgggccctgagccctgggggccgcaccctgcggagccggggccgggcccacctggccggccgggccggcctgcccggcccccgggtgtgtgctgtggccgtgcctgtgggcggcctgggcgccgcccggctggaggcccagggcggcagaagaaggctgctgctgcgggtgggcggcagcgaggccgcccgctgggacctgctgctgtgctgggtggccggccgggtgctgcagtgggacctgggccgccacgtgcagcagtgcccagagggccccctgctggtgcaccacctgcaggccgccggcgtgtggggcgtgggcctggccggggagcaggccctgcccctgtgtggccaccgggaccggctgggcggccagcaccgggtgccccaggccgcccagctgcacagcgtggccatgcccttcccccccatggccccagccctgctgcggcccagcagagctggcctggactacctgtgcagaattgtgcggggccaggccaccggctgctggggcgccccccagctgctgctgctggcccggctgccccggggcggccgcacagcccgggcccggggccggggccccctgctgcgggcccggggggccctggcccggggcctgctgggccaccgggtgcggcgctggctgggccctgggggccggggcggccgggtgcccccagctggcctgtggagcggcagaagaagacctgggggccggcggctgtggccctggctgcgggcccgggtggccggccggggcggcgtgcccggccagaggggcgtgcctgtgggcctgcccaggtctggaggagatgctgagacagcccggaccaggaggacccgggcctgtgccgccggcaagaccaacagctag

SEQ ID NO: 41673 - DNA, 1359 bp, Artificial Sequence
  Description of Artificial Sequence: Synthetic coding sequence
atgaacagcggcatcctgcaggtgttccagcgggagctgatctgccccatctgcatgaactacttcattgatcctgtgaccatcgactgtggccacagcttctgccggccctgcttctacctgaactggaaggacagccccttcctggtgcagtgcagcgagtgcaccaagagcacaggccagatcaacctgaagaccaacatccacttcaagaagatggccagcctggccaggaaggtgtccctgtggctgttcctgagcagcgaggagcagatgtgtggcacccaccgggagaccaagaagatgttctgtgaggtggacaggagcctgctgtgcctgctgtgcagcagcagccaggagcaccgggaccaccgccactgccccattgaatctgctgctgaggagcaccaggagaagctgctgcagaagatgcagagcctgtgggagaaggcctgtgagaaccacaggaacctgaatgtggagaccaccaggacccgctgctggaaggactatgtgaacctgcggctggaggccatccgggcagagtaccagaagatgcctgccttccaccacgaggaggagaagcacaacctggagatgctgaagaagaagggcaaggacatcttccaccggctgcacctgagcaaggccaagatggcccaccggcgggagatcctgcggggcatgtatgaggagctgaatgagatgtgccacaagccagatgtggagctgctgcaggccttcggggacatcctgcacaggtctgagagcgtgctgctgcacatgccccagcccctgaaccctgagctgtctgctggccccatcaccggcctgcgggaccggctgaaccagttccgggtgcacatcaccctgcaccacgaggaggccaacagcgacatcttcctgtgtgagatcctgcgctccatgtgcatcggctgtgaccaccaggatgtgccctacttcaccgccacccccaggagcttcctggcctggggcgcccagaccttcaccagcggcaagtactactgggaggtgcacgtgggggacagctggaactgggcctttggagtgtgcaacatgtactggaaggagaagaaccagaatgagaagattgatggagaagatggcctcttcctgctgggctgtgtgaagaatgacatccagaggagcctcttcaccaccagccccctgctgctgcagtacatcccccggcccaccagccgggtgggcctcttcctggactgtgaggccaagacagtgtcctttgtggatgtgaaccagagcagcctcatctacaccatccccaactgcagcttcagcccccccctgcggcccatcttctgctgcatccacttctag

SEQ ID NO: 41674 - DNA, 339 bp, Artificial Sequence
  Description of Artificial Sequence: Synthetic coding sequence
caggtggcctacgtgcgggcccgggagctgcacaccctggaggtgacaggcctggagaccgtggcccagagcaaggcccacgtggccagcctggagggcctcatccctgaggacaaggtggtgctgctggccggcagccccctgcagaatgaggccaccctgggccagtgtggggtggaggccctgaccaccctggaggtggtgggccggcggctgggcggcaacaactgcctgagcctgcaggtgaaccctgtgcagcctgcccgctacctgtggaccaccctgcacagcagcaagcagggcgagcccaacagcagcgccaaccaccgctgcagctag

SEQ ID NO: 41675 - DNA, 1026 bp, Artificial Sequence
  Description of Artificial Sequence: Synthetic coding sequence
atgaggctgtgcctgatccccaggaacacaggcaccccccagagggtgctgcggcctgtggtgtggagcccccccagcaggaagaagcctgtgctgagcccccacaacagcatcatgtttggccacctgagccctgtgcgcatcccctgcctgcggggcaagttcaacctgcagctgcccagcctggatgaccaggtgatcccagcccggctgcccaagacagaggtgtctgctgaggagcccaaggaggccacagaggtgaaggaccaggtggagacccagggccaggaggacaacaagaggggcccctgcagcaatggagaggccgccagcaccagccggcccctggagacccagggcaacctgaccagctcctggtacaacccccggcccctggagggcaatgtgcacctgaagagcctgacagagaagaaccagacagacaaggcccaggtgcatgctgtgtccttctacagcaagggccacggcgtggccagcagccacagccctgctgggggcatcctgccctttgggaagccagaccccctgcccaccgtgctgcctgcccctgtgcccggctgcagcctgtggccagagaaggccgccctgaaggtgctgggggaggaccacctgcccagcagccctggcctgctgatggtgggggaggacatgcagcccaaggaccctgctgccctgggcagcagccgcagcagcccccccagggctgctggccacaggagccacaagaggaagctgagcggcccccccctgcagctgcagcccaccccacccctgcagctgcgctgtgacagagatgagaggcctcctccagccaagctgccctgcctgagccctgaggccctgctggtgggccaggccagccagcgggagggccgcctgcagcacggcaacatgaggaagaacatgagggtgctgagccgcatcagcaagttccggcggctgcggcagctgctgcggcggaggaagaagacccggcagggcagaagaggaggcagctgcctgtag

SEQ ID NO: 41676 - DNA, 285 bp, Artificial Sequence
  Description of Artificial Sequence: Synthetic coding sequence
atgaggaagctgcggctgcgggccagcaaccctggccccagcggggcccctggcacccggcagcacttcagcaccagccggggcggccaccactgtgcccggcgctggctgcggcgggtgagaagaagccgcagccagacccccagctaccagaacctggaccccaacccccccatcgtgcgcttccccctgcccctggagcgcatcagcgaggtgccccggcgggcctgcctgcacggcagagatgccagctctgtgtggcccccacctgagaggagtgactag

SEQ ID NO: 41677 - DNA, 2268 bp, Artificial Sequence
  Description of Artificial Sequence: Synthetic coding sequence
atggctgctgtggccgctgaggccgccgccacagctgccagccctggagagggcggggccggggaggccgagcctgagatggagcccatccctggcagcgaggccggcacagaccccctgcctgtgacagccacagaggcctctgtgcctgatggagaaacagatggccagcagagcgccccccaggctgatgagccccccctgcccccacctcctcctcctcctggagagctggcccggagccctgaggccgtgggccctgagctggaggccgaggagaagctgtctgtgcgggtggccgagagcgctgctgctgccccccagggcggccctgagctgccccccagccctgccagccccccagagcagcccccagcccctgaggagcgggaggagccccccctgccccagcctgtggccccagccctggtgcccccagctggaggagacagcacagtgtcccagctgatccctggcagcgaggtgcgggtgaccctggaccacatcattgaagatgccctggtggtgtccttccgctttggagagaagctgttcagcggcgtgctgatggacctgagcaagcgcttcggcccccacggcatccctgtgaccgtcttccccaagcgggagtacaaggacaagccagaggccatgcccctgcagagcaacaccttccaggagggcacagaggtgaagtgtgaggccaacggggctgtgcctgatgaccccagccctgtgccccaccctgagctgagcctggccgagagcctgtggaccagcaagcccccacccctcttccatgaaggagccccctaccccccacccctcttcatccgggacacctacaaccagagcatcccccagcccccacccaggaagatcaagaggcccaagaggaagatgtaccgggaggagcccaccagcatcatgaatgccatcaagctgcggccccggcaggtgctgtgtgacaagtgcaagaacagcgtggtggccgagaagaaggagatcaggaagggcagcagcgccacagacagcagcaaatatgaggacaagaagagaagaaatgaatctgtgaccaccgtgaacaagaagctgaagacagaccacaaggtggatggcaagaaccagaatgaaagccagaagagaaatgctgtggtgaaggtgagcaacatcgcccacagccggggccgggtggtgaaggtgtctgcccaggccaacaccagcaaggcccagctgagcaccaagaaggtgctgcagagcaagaacatggaccacgccaaggcccgggaggtgctgaagatcgccaaggagaaggcccagaagaagcagaatgagaccagcaccagcaagaatgcccacagcaaggtgcacttcacccggcgctaccagaaccccagcagcggcagcctgcccccccgggtgcggctgaagccccagcgctacagaaatgaagaaaatgacagcagcctgaagacaggcctggagaagatgaggtctgggaagatggcccccaagccccagagccgctgcaccagcaccaggtctgctggggaggcccccagcgagaaccagagccccagcaagggccctgaggaggccagcagcgaggtgcaggacaccaatgaggtgcacgtgcctggggaccaggatgagccccagaccctgggcaagaagggcagcaagaacaacatctctgtgtacatgaccctgaaccagaagaagagtgacagcagcagcgcctctgtgtgcagcattgacagcacagatgacctgaagagcagcaacagtgaatgtagcagcagcgagagctttgacttccccccaggctccatgcacgcccccagcaccagcagcaccagcagcagcagcaaggaggagaagaagctgagcaacagcctgaagatgaaggtgttcagcaagaatgtgtccaaatgtgtgaccccagatggccgcaccatctgtgtgggggacatcgtgtgggccaagatctacggcttcccctggtggccagcccgcatcctgaccatcaccgtgtccaggaaggacaatggcctgctggtgcggcaggaggcccgcatctcctggtttggcagccccaccaccagcttcctggccctgagccagctgagccccttcctggagaacttccagagccgcttcaacaagaagaggaagggcctgtacaggaaggccatcacagaagctgccaaggccgccaagcagctgaccccagaggtgcgggccctgctgacccagtttgagacctag

SEQ ID NO: 41678 - DNA, 1683 bp, Artificial Sequence
  Description of Artificial Sequence: Synthetic coding sequence
atggctgctgtggccgctgaggccgccgccacagctgccagccctggagagggcggggccggggaggccgagcctgagatggagcccatccctggcagcgaggccggcacagaccccctgcctgtgacagccacagaggcctctgtgcctgatggagaaacagatggccagcagagcgccccccaggctgatgagccccccctgcccccacctcctcctcctcctggagagctggcccggagccctgaggccgtgggccctgagctggaggccgaggagaagctgtctgtgcgggtggccgagagcgctgctgctgccccccagggcggccctgagctgccccccagccctgccagccccccagagcagcccccagcccctgaggagcgggaggagccccccctgccccagcctgtggccccagccctggtgcccccagctggaggagacagcacagtgtcccagctgatccctggcagcgaggtgcgggtgaccctggaccacatcattgaagatgccctggtggtgtccttccgctttggagagaagctgttcagcggcgtgctgatggacctgagcaagcgcttcggcccccacggcatccctgtgaccgtcttccccaagcgggagtacaaggacaagccagaggccatgcccctgcagagcaacaccttccaggagggcacagaggtgaagtgtgaggccaacggggctgtgcctgatgaccccagccctgtgccccaccctgagctgagcctggccgagagcctgtggaccagcaagcccccacccctcttccatgaaggagccccctaccccccacccctcttcatccgggacacctacaaccagagcatcccccagcccccacccaggaagatcaagaggcccaagaggaagatgtaccgggaggagcccaccagcatcatgaatgccatcaagctgcggccccggcaggtgctgtgtgacaagtgcaagaacagcgtggtggccgagaagaaggagatcaggaagggcagcagcgccacagacagcagcaaatatgaggacaagaagagaagaaatgaatctgtgaccaccgtgaacaagaagctgaagacagaccacaaggtggatggcaagaaccagaatgaaagccagaagagaaatgctgtggtgaaggtgagcaacatcgcccacagccggggccgggtggtgaaggtgtctgcccaggccaacaccagcaaggcccagctgagcaccaagaaggtgctgcagagcaagaacatggaccacgccaaggcccgggaggtgctgaagatcgccaaggagaaggcccagaagaagcagaatgagaccagcaccagcaagaatgcccacagcaaggtgcacttcacccggcgctaccagaaccccagcagcggcagcctgcccccccgggtgcggctgaagccccagcgctacagaaatgaagaaaatgacagcagcctgaagacaggcctggagaagatgaggtctgggaagatggcccccaagccccagagccgctgcaccagcaccaggtctgctggcctgaacaagtggcagctgctgcaccagacagtgaccagccctgctgcccccctgcagtgcctgacagaccactgcggcttccggctgggcgccctgaagctgactgtgaagagagctgcccagaggcactag

SEQ ID NO: 41679 - DNA, 1563 bp, Artificial Sequence
  Description of Artificial Sequence: Synthetic coding sequence
atggctgctgtggccgctgaggccgccgccacagctgccagccctggagagggcggggccggggaggccgagcctgagatggagcccatccctggcagcgaggccggcacagaccccctgcctgtgacagccacagaggcctctgtgcctgatggagaaacagatggccagcagagcgccccccaggctgatgagccccccctgcccccacctcctcctcctcctggagagctggcccggagccctgaggccgtgggccctgagctggaggccgaggagaagctgtctgtgcgggtggccgagagcgctgctgctgccccccagggcggccctgagctgccccccagccctgccagccccccagagcagcccccagcccctgaggagcgggaggagccccccctgccccagcctgtggccccagccctggtgcccccagctggaggagacagcacagtgtcccagctgatccctggcagcgaggtgcgggtgaccctggaccacatcattgaagatgccctggtggtgtccttccgctttggagagaagctgttcagcggcgtgctgatggacctgagcaagcgcttcggcccccacggcatccctgtgaccgtcttccccaagcgggagtacaaggacaagccagaggccatgcccctgcagagcaacaccttccaggagggcacagaggtgaagtgtgaggccaacggggctgtgcctgatgaccccagccctgtgccccaccctgagctgagcctggccgagagcctgtggaccagcaagcccccacccctcttccatgaaggagccccctaccccccacccctcttcatccgggacacctacaaccagagcatcccccagcccccacccaggaagatcaagaggcccaagaggaagatgtaccgggaggagcccaccagcatcatgaatgccatcaagctgcggccccggcaggtgctgtgtgacaagtgcaagaacagcgtggtggccgagaagaaggagatcaggaagggcagcagcgccacagacagcagcaaatatgaggacaagaagagaagaaatgaatctgtgaccaccgtgaacaagaagctgaagacagaccacaaggtggatggcaagaaccagaatgaaagccagaagagaaatgctgtggtgaaggtgagcaacatcgcccacagccggggccgggtggtgaaggtgtctgcccaggccaacaccagcaaggcccagctgagcaccaagaaggtgctgcagagcaagaacatggaccacgccaaggcccgggaggtgctgaagatcgccaaggagaaggcccagaagaagcagaatgagaccagcaccagcaagaatgcccacagcaaggtgcacttcacccggcgctaccagaaccccagcagcggcagcctgcccccccgggtgcggctgaagccccagcgctacagaaatgaagaaaatgacagcagcctgaagacaggcctggagaagatgaggtctgggaagatggcccccaagccccagagccgctgcaccagcaccaggtctgctgcccagaggcactag

SEQ ID NO: 41680 - DNA, 1773 bp, Artificial Sequence
  Description of Artificial Sequence: Synthetic coding sequence
atggagcccagggctggctgccgcctgcctgtgcgggtggagcaggtggtgaatggagccctggtggtgacagtgtcctgtggggagaggagctttgctggcatcctgctggactgcaccaagaagagcggcctgtttggcctgccccccctggcccccctgccccaggtggatgagagccctgtgaatgacagccacggccgggcccctgaggagggagatgctgaggtgatgcagctgggcagcagcagccccccaccagcccggggcgtgcagcccccagagaccaccaggcctgagcccccaccacccctggtgccccccctgcctgctggcagcctgcccccctacccaccctactttgaaggagcccccttcccccaccccctgtggctgcgggacacctacaagctgtgggtgccccagcccccacccaggaccatcaagaggacccggcggcggctgagcaggaacagagatcctggccgcctcatcctgagcaccatccggctgcggccccggcaggtgctgtgtgagaagtgcaagagcaccctgagccccccagaggccagccctggccccccagctgccccccgggcccggcggcggctgggcagcggccctgaccgggagctgaggaagccagaggagccagaaaatggagagcccacagctgctgccacagcccggcgcagcaagcgggagcggcgggaggaggaccgggccccagctgagcaggtgcccaggagccctgtgatcaagatctcctacagcaccccccagggcaaaggagaggtggtgaagatccccagccgggtgcacggcagcctggagcccttccggccccagcaggccccccaggatgatggcagccaggaccctgaggtgctggaccgggagagccgggaccggcccagctgtgcccccagcgccagcatccccaagctgaagctgaccaggcctgtgcctgctggagctgacctgcccccacccaagatccggctgaagccccaccggctgggggacagcgagcacgagcctgtgtacagagctgagctggtgggggagctgaatggctacctgcgggacagcagccctgccccctgtgctgatggccctgctgggggcctggccgacctgagcagcggcagcagtggagaagatgatgacttcaagagctgcccccagggcccccagggccgggagggcctggccttcctggtgtcctgcccagagggccgggctgactgtgccagcgagagcgcctgcagcagtgacagcctggatgaggcccggagcagcggcagcgagggcaccccagctgacacaggagacctgagccctggccacggggccagcgcccccagcgtgtcccgggaggcccggcagacagtgccccccctgactgtgcggctgcacacccagagcgtgtctgagtgcatcacagaagatggccgcacagtggccgtgggggacatcgtgtggggcaagatccacggcttcccctggtggccagcccgggtgctggacatcagcctgggccagaaggaggatggagagcccagctggagggaggccaaggtgtcctggtttggcagccccaccaccagcttcctgagcatcagcaagctgagccccttcagcgagttcttcaagctgcgcttcaacaggaagaagaagggcatgtacaggaaggccatcacagaggccgccaatgctgcccggcacgtggcccctgagatccgggagctgctgacccagtttgagacctag

SEQ ID NO: 41681 - DNA, 1500 bp, Artificial Sequence
  Description of Artificial Sequence: Synthetic coding sequence
atggagcccagggctggctgccgcctgcctgtgcgggtggagcaggtggtgaatggagccctggtggtgacagtgtcctgtggggagaggagctttgctggcatcctgctggactgcaccaagaagagcggcctgtttggcctgccccccctggcccccctgccccaggtggatgagagccctgtgaatgacagccacggccgggcccctgaggagggagatgctgaggtgatgcagctgggcagcagcagccccccaccagcccggggcgtgcagcccccagagaccaccaggcctgagcccccaccacccctggtgccccccctgcctgctggcagcctgcccccctacccaccctactttgaaggagcccccttcccccaccccctgtggctgcgggacacctacaagctgtgggtgccccagcccccacccaggaccatcaagaggacccggcggcggctgagcaggaacagagatcctggccgcctcatcctgagcaccatccggctgcggccccggcaggtgctgtgtgagaagtgcaagagcaccctgagccccccagaggccagccctggccccccagctgccccccgggcccggcggcggctgggcagcggccctgaccgggagctgaggaagccagaggagccagaaaatggagagcccacagctgctgccacagcccggcgcagcaagcgggagcggcgggaggaggaccgggccccagctgagcaggtgcccaggagccctgtgatcaagatctcctacagcaccccccagggcaaaggagaggtggtgaagatccccagccgggtgcacggcagcctggagcccttccggccccagcaggccccccaggatgatggcagccaggaccctgaggtgctggaccgggagagccgggaccggcccagctgtgcccccagcgccagcatccccaagctgaagctgaccaggcctgtgcctgctggagctgacctgcccccacccaagatccggctgaagccccaccggctgggggacagcgagcacgagcctgtgtacagagctgagctggtgggggagctgaatggctacctgcgggacagcagccctgccccctgtgctgatggccctgctgggggcctggccgacctgagcagcggcagcagtggagaagatgatgacttcaagagctgcccccagggcccccagggccgggagggcctggccttcctggtgtcctgcccagagggccgggctgactgtgccagcgagagcgcctgcagcagtgacagcctggatgaggcccggagcagcggcagcgagggcaccccagctgacacaggagacctgagccctggccacggggccagcgcccccagcgtgtcccgggaggcccggcagacagtgccccccctgactgtgcggctgcacacccagagcgtgtctgagtgcatcacagaagatggccgcacagtggccgtgggggacatcgtgtggggccacagaagatag

SEQ ID NO: 41682 - DNA, 540 bp, Artificial Sequence
  Description of Artificial Sequence: Synthetic coding sequence
tgacagagccgccgcatcgagcctgtgatgggccgcctgctgctgtgtgccagccatggagaaattgagaagcaccccagcctgcacgccagcagctatggcctggtggccatcaaggaggcccatgacatcgagacccggctgaatgaggtggagaagctgctgaagaccatcatctccatgccctgcaagtacagccgctctgaggtggtgctgaccttctttgagaggagccccctggaccaggtgctgaagaatgacaacgtgcacaagatccagcccagcttccagagccctgtgaagatcagcgagatcatgaggagcaatggcttctgcctggccaacacagagaccatcgtgattgaccacagcatccccaacggccgggaccagcagctgggcgtggaccccacagagcacctgtttgaaaatggcagcgagttccccagcgagctggaggatggagatgatcctgctgcctacgtgaccaacctgagctactaccacctggtgccctttgaaacagacatctgggactag

SEQ ID NO: 41683 - DNA, 696 bp, Artificial Sequence
  Description of Artificial Sequence: Synthetic coding sequence
atggccagcgctgtgtttgagggcaccagcctggtgaacatgtttgtgcggggctgctgggtgaatggcatcagaagactcatcgtgtccagaagaggagatgaggaggagttctttgagatcagaacagagtggagcgacagatctgtgctgtacctgcacaggagcctggccgacctgggccgcctgtggcagaggctgagagatgccttcccagaagatagaagtgagctggcccagggccccctgcggcagggcctggtggccatcaaggaggcccatgacatcgagacccggctgaatgaggtggagaagctgctgaagaccatcatctccatgccctgcaagtacagccgctctgaggtggtgctgaccttctttgagaggagccccctggaccaggtgctgaagaatgacaacgtgcacaagatccagcccagcttccagagccctgtgaagatcagcgagatcatgaggagcaatggcttctgcctggccaacacagagaccatcgtgattgaccacagcatccccaacggccgggaccagcagctgggcgtggaccccacagagcacctgtttgaaaatggcagcgagttccccagcgagctggaggatggagatgatcctgctgcctacgtgaccaacctgagctactaccacctggtgccctttgaaacagacatctgggactag

SEQ ID NO: 41684 - DNA, 1503 bp, Artificial Sequence
  Description of Artificial Sequence: Synthetic coding sequence
atggaggccgcccggcccccacccacagctgggaagtttgtggtggtgggcggcggcattgctggggtgacctgtgccgagcagctggccacccacttccccagcgaggacatcctgctggtgacagccagccctgtgatcaaggctgtgaccaacttcaagcagatcagcaagatcctggaggagtttgatgtggaggagcagagcagcaccatgctgggcaagcgcttccccaacatcaaggtgattgaaagtggagtgaagcagctgaagtctgaggagcactgcatcgtgacagaagatggcaaccagcacgtgtacaagaagctgtgcctgtgtgccggggccaagcccaagctgatctgtgagggcaacccctacgtgctgggcatccgggacacagacagcgcccaggagttccagaagcagctgaccaaggccaagaggatcatgatcattggaaatggaggcatcgccctggagctggtgtatgaaattgagggctgtgaggtgatctgggccatcaaggacaaggccatcggcaacaccttctttgatgctggagctgctgagttcctgaccagcaagctgattgctgagaagtctgaggccaagatcgcccacaagaggacccgctacaccacagagggcaggaagaaggaggcccggagcaagagcaaggctgacaacgtgggcagcgccctgggccctgactggcatgagggcctgaacctgaagggcaccaaggagttcagccacaagatccacctggagaccatgtgtgaggtgaagaagatctacctgcaggatgagttccgcatcctgaagaagaagagcttcaccttcccccgggaccacaagtctgtgacagctgacacagagatgtggcctgtgtatgtggagctgaccaatgagaagatctacggctgtgacttcatcgtgtctgccactggagtgacccccaacgtggagcccttcctgcacggcaacagctttgacctgggggaggatggcggcctgaaggtggatgaccacatgcacaccagcctgcctgacatctatgctgctggggacatctgcaccacctcctggcagctgagccctgtgtggcagcagatgaggctgtggacccaggcccggcagatgggctggtacgccgccaagtgcatggccgccgccagcagcggggacagcattgacatggacttctcctttgagctgtttgcccacgtgaccaagttcttcaactacaaggtggtgctgctgggcaagtacaatgcccagggcctgggcagtgaccacgagctgatgctgcgctgcaccaagggccgggagtacatcaaggtggtgatgcagaatggaaggatgatgggcgctgtgctgattggagaaacagacctggaggagacctttgagaacctgatcctgaaccagatgaacctgagcagctatggagaggacctgctggaccccaacattgatattgaggactactttgattag

SEQ ID NO: 41685 - DNA, 420 bp, Artificial Sequence
  Description of Artificial Sequence: Synthetic coding sequence
atggaggccgcccggcccccacccacagctgggaagtttgtggtggtgggcggcggcattgctggggtgacctgtgccgagcagctggccacccacttccccagcgaggacatcctgctggtgacagccagccctgtgatcaaggctgtgaccaacttcaagcagatcagcaagatcctggaggagtttgatgtggaggagcagagcagcaccatgctgggcaagcgcttccccaacatcaaggtgattgaaagtggagtgaagcagctgaagtctgaggagcactgcatcgtgacagaagatggcaaccagcacgtgtacaagaagctgtgcctgtgtgccggggccaagcccaagctgatctgtgagggcaacccctacgtgctgggcatccgggacacagacagcgcccaggtgtag

SEQ ID NO: 41686 - DNA, 1746 bp, Artificial Sequence
  Description of Artificial Sequence: Synthetic coding sequence
atggccgccagcggccggggcctgtgcaaggctgtggccgccagccccttccctgcctggaggcgggacaacacagaggcccggggcggcctgaagccagaatatgatgctgtggtgattggagctggccacaacggcctggtggccgccgcctacctgcagaggctgggcgtgaacacagctgtgtttgaaagaagacatgtgattggaggagctgctgtgacagaggagatcatccctggcttcaagttcagccgggccagctacctgctgagcctgctgcggccccagatctacacagacctggagctgaagaagcacggcctgcggctgcacctgaggaacccctacagcttcacccccatgctggaggagggcgccggcagcaaggtgccccgctgcctgctgctgggcacagacatggccgagaaccagaagcagatcgcccagttcagccagaaggatgcccaggtgttccccaagtatgaggagttcatgcaccggctggccctggccatcgaccccctgctggatgctgcccctgtggacatggccgccttccagcacggcagcctgctgcagaggatgaggagcctgagcaccctgaagcccctgctgaaggccggccgcatcctgggcgcccagctgccccgctactatgaggtgctgacagcccccatcaccaaggtgctggaccagtggtttgaaagtgagcccctgaaggccaccctggccacagatgctgtgattggagccatgaccagcccccacaccccaggcagcggctacgtgctgctgcaccacgtgatgggcggcctggagggcatgcagggcgcctggggctacgtgcagggcggcatgggcgccctgagtgatgccatcgccagcagcgccaccacccatggagccagcatcttcacagagaagacagtggccaaggtgcaggtgaacagcgagggctgtgtgcagggcgtggtgctggaggatggaacagaggtgcgcagcaagatggtgctgagcaacaccagcccccagatcaccttcctgaagctgaccccccaggagtggctgcctgaggagttcctggagcgcatcagccagctggacaccaggagccctgtgaccaagatcaacgtggccgtggaccggctgcccagcttcctggccgccccaaatgccccccggggccagcccctgccccaccaccagtgcagcatccacctgaactgtgaggacaccctgctgctgcaccaggcctttgaagatgccatggatggcctgcccagccacaggcctgtgattgagctgtgcatccccagcagcctggaccccaccctggcccctcctggctgccacgtggtgtccctcttcacccagtacatgccctacaccctggccggcggcaaggcctgggatgagcaggagagagatgcctatgctgacagagtgtttgactgcatcgaggtgtatgcccctggcttcaaggacagcgtggtgggccgggacatcctgaccccaccagacctggagcgcatcttcggcctgcccggcggcaacatcttccactgtgccatgagcctggaccagctgtactttgcccggcctgtgcccctgcacagcggctaccgctgccccctgcagggcctgtacctgtgtggcagcggggcccaccctgggggcggcgtgatgggcgccgccggcagaaatgctgcccacgtggccttccgggacctgaagtccatgtag

SEQ ID NO: 41687 - DNA, 591 bp, Artificial Sequence
  Description of Artificial Sequence: Synthetic coding sequence
atgaagcccaggaccctggtggagctgagcaagctgggcctgggcaatgagaccgtggtgcagctgcggaccctggagctgcctgtggactaccgggaggccaagagaagagtgacaggcatctgggaggaccaccagccccagctggtggtgcacgtgggcatggacacagctgccaaggccatcatcctggagcagagcggcaagaaccagggctacagagatgctgacatccgctccttctggccagagggcggcgtgtgcctgcccggcagcccagatgtgctggagagcggcgtgtgcatgaaggctgtgtgcaagagggtggccgtggagggcgtggatgtgatcttcagcagagatgctggccgctacgtgtgtgactacacctactacctgagcctgcaccacggcaagggctgtgccgccctgatccacgtgccccccctgagccggggcctgcctgccagcctgctgggccgggccctgcgggtcatcatccaggagatgctggaggaggtgggcaagcccaagcaccgggcccagtttgaggagaacagcaccatggtgctgcctgccaagggcaactag

SEQ ID NO: 41688 - DNA, 429 bp, Artificial Sequence
  Description of Artificial Sequence: Synthetic coding sequence
atggacacagctgccaaggccatcatcctggagcagagcggcaagaaccagggctacagagatgctgacatccgctccttctggccagagggcggcgtgtgcctgcccggcagcccagatgtgctggagagcggcgtgtgcatgaaggctgtgtgcaagagggtggccgtggagggcgtggatgtgatcttcagcagagatgctggccgctacgtgtgtgactacacctactacctgagcctgcaccacggcaagggctgtgccgccctgatccacgtgccccccctgagccggggcctgcctgccagcctgctgggccgggccctgcgggtcatcatccaggagatgctggaggaggtgggcaagcccaagcaccgggcccagtttgaggagaacagcaccatggtgctgcctgccaagggcaactag

SEQ ID NO: 41689 - DNA, 429 bp, Artificial Sequence; identical to SEQ ID NO: 41688
  Description of Artificial Sequence: Synthetic coding sequence

SEQ ID NO: 41690 - DNA, 8397 bp, Artificial Sequence
  Description of Artificial Sequence: Synthetic coding sequence
atgaccagcatccactttgtggtgcaccccctgcccggcacagaggaccagctgaatgaccggctgcgggaggtgtctgagaagctgaacaagtacaacctgaacagccacccccccctgaatgtgctggagcaggccaccatcaagcagtgtgtggtgggccccaaccacgccgccttcctgctggaggatggccgggtgtgccgcatcggcttctctgtgcagcctgaccggctggagctgggcaagccagacaacaatgatggcagcaagctgaacagcaacagcggggccggccgcaccagccggcccggccgcaccagtgacagcccctggttcctgagcggcagcgagaccctgggccgcctggccggcaacaccctgggcagccgctggagcagcggcgtgggcggcagcggcggcggcagcagcggccgcagcagcgctggggcccgggacagccggcggcagaccagggtcatcagaacaggccgggaccggggcagcggcctgctgggcagccagccccagcccgtcatcccagccagcgtcatccctgaggagctgatcagccaggcccaggtggtgctgcagggcaagagccgcagcgtcatcatccgggagctgcagaggaccaacctggatgtgaacctggccgtgaacaacctgctgagcagagatgatgaagatggagatgatggagatgacacagccagcgagagctacctgcccggggaggacctgatgagcctgctggatgctgacatccacagcgcccaccccagcgtcatcattgatgctgatgccatgttttctgaggacatctcctacttcggctaccccagcttccgccgcagcagcctgagccggctgggcagcagccgggtgctgctgctgcccctggagcgggacagcgagctgctgcgggagcgggagagcgtgctgcggctgcgggagcggcgctggctggatggagccagctttgacaatgaaagaggcagcaccagcaaggagggggagcccaacctggacaagaagaacacccctgtgcagagccctgtgtccctgggggaggacctgcagtggtggccagacaaggatggcaccaagttcatctgcatcggggccctgtacagcgagctgctggccgtgagcagcaaaggagagctgtaccagtggaagtggagcgagagcgagccctacagaaatgcccagaaccccagcctgcaccacccccgggccaccttcctgggcctgaccaatgagaagatcgtgctgctgagcgccaacagcatccgggccaccgtggccacagagaacaacaaggtggccacctgggtggatgagaccctgagctctgtggccagcaagctggagcacacagcccagacctacagcgagctgcagggcgagagaattgtgtccctgcactgctgtgccctgtacacctgtgcccagctggagaacagcctgtactggtggggcgtggtgcccttcagccagaggaagaagatgctggagaaggcccgggccaagaacaagaagcccaagagcagcgctggcatcagctccatgcccaacatcaccgtgggcacccaggtgtgcctgaggaacaaccccctgtaccacgccggggctgtggccttcagcatctctgctggcatccccaaggtgggcgtgctgatggagagcgtgtggaacatgaatgacagctgccgcttccagctgcggagccctgagagcctgaagaacatggagaaggccagcaagaccacagaggccaagccagagagcaagcaggagcctgtgaagacagagatgggccccccacccagccctgccagcacctgcagtgatgccagcagcatcgccagcagcgcctccatgccctacaagagaagaagaagcaccccagcccccaaggaggaggagaaggtgaatgaggagcagtggagcctgcgggaggtggtgtttgtggaggatgtgaagaatgtgcctgtgggcaaggtgctgaaggtggatggagcctacgtggccgtgaagtttcctggcaccagcagcaacaccaactgccagaacagcagcggcccagatgctgaccccagcagcctgctgcaggactgccgcctgctgagaattgatgagctgcaggtggtgaagacaggaggcacccccaaggtgcctgactgcttccagaggacccccaagaagctgtgcatccctgagaagacagagatcctggccgtgaatgtggacagcaagggcgtgcatgctgtgctgaagacaggcaactgggtgcgctactgcatctttgacctggccaccgggaaggccgagcaggagaacaacttccccaccagcagcatcgccttcctgggccagaatgaaagaaatgtggccatcttcaccgctggccaggagagccccatcatcctgagagatggaaatggcaccatctaccccatggccaaggactgcatgggcggcatccgggaccctgactggctggacctgccccccatcagcagcctgggcatgggcgtgcacagcctcatcaacctgcctgccaacagcaccatcaagaagaaggctgctgtgatcatcatggctgtggagaagcagaccctgatgcagcacatcctgcgctgtgactatgaggcctgccggcagtacctgatgaacctggagcaggccgtggtgctggagcagaacctgcagatgctgcagaccttcatcagccaccgctgtgatggcaacagaaacatcctgcacgcctgtgtgtctgtgtgcttccccaccagcaacaaggagaccaaggaggaggaggaggccgagaggagtgaaagaaacacctttgctgagcggctgtctgctgtggaggccatcgccaatgccatctctgtggtgagcagcaatggacctggcaacagagctggcagcagcagcagccgcagcctgcggctgcgggagatgatgagaagaagcctgcgggctgctggcctgggcagacatgaggccggggccagcagcagtgaccaccaggaccctgtgtccccacccatcgcccctccttcctgggtgcctgaccccccagccatggaccctgatggagacatcgacttcatcctggccccagctgtgggcagcctgaccacagctgccactggaacaggccagggccccagcaccagcaccatccctggccccagcacagagcccagcgtggtggagagcaaggacaggaaggccaatgcccacttcatcctgaagctgctgtgtgacagcgtggtgctgcagccctacctgcgggagctgctgagcgccaaggatgcccggggcatgacccccttcatgtctgctgtgtctggccgggcctacccagctgccatcaccatcctggagacagcccagaagatcgccaaggccgagatcagcagcagcgagaaggaggaggatgtgttcatgggcatggtgtgccccagcggcaccaacccagatgacagccccctgtatgtgctgtgctgcaatgacacctgcagcttcacctggacaggagctgagcacatcaaccaggacatctttgaatgtaggacctgtggcctgctggagagcctgtgctgctgcacagaatgtgcccgggtgtgccacaagggccatgactgcaagctgaagaggaccagccccacagcctactgtgactgctgggagaagtgcaagtgcaagaccctgattgctggccagaagagcgcccggctggacctgctgtaccgcctgctgacagccaccaacctggtgaccctgcccaacagcagaggagagcacctgctgctcttcctggtgcagacagtggcccggcagacagtggagcactgccagtacagaccaccccgcatccgggaggacaggaacaggaagacagccagccctgaggacagcgacatgccagaccatgacctggagcccccaagatttgcccagctggccctggagcgggtgctgcaggactggaatgccctgaagtccatgatcatgtttggcagccaggagaacaaggaccccctgagcgccagcagccgcatcggccacctgctgcctgaggagcaggtgtacctgaaccagcagagcggcaccatccggctggactgcttcacccactgcctgattgtgaagtgcacagctgacatcctgctgctggacaccctgctgggcaccctggtgaaggagctgcagaacaagtacaccccaggaagaagagaggaggccatcgctgtgaccatgaggttcctgcggtctgtggcccgggtgtttgtgatcctgtctgtggagatggccagcagcaagaagaagaacaacttcatcccccagcccatcggcaagtgcaagagggtcttccaggccctgctgccctatgctgtggaggagctgtgcaatgtggccgagagcctgattgtgcctgtgaggatgggcatcgcccggcccacagcccccttcaccctggccagcaccagcattgatgccatgcagggcagcgaggagctgttctctgtggagcccctgcccccccggcccagcagtgaccagagcagcagcagcagccagagccagagcagctacatcatccggaacccccagcagaggcgcatcagccagagccagcctgtgcggggcagagatgaggagcaggatgacatcgtgtctgcagatgtggaggaggtggaggtggtggagggcgtggccggggaggaggaccaccatgatgagcaggaggagcacggggaggagaatgctgaggccgagggccagcatgatgaacatgatgaagatggcagtgacatggagctggacctgctggccgctgctgagacagaaagtgacagcgagagcaaccacagcaaccaggacaatgccagcggcagaagatctgtggtgacagctgccacagctggcagcgaggccggggccagctctgtgcctgccttcttctctgaagatgacagccagagcaatgacagcagtgacagcgacagcagcagcagccagagtgatgacatcgagcaggagaccttcatgctggatgagcccctggagaggaccaccaacagcagccacgccaatggagctgcccaggcccccaggtccatgcagtgggccgtgaggaacacccagcaccagagagctgccagcacagcccccagcagcaccagcaccccagctgccagcagcgctggcctcatctacatcgaccccagcaacctgcggcgcagcggcaccatcagcaccagcgctgctgctgctgctgctgccctggaggccagcaatgccagcagctacctgaccagcgccagcagcctggcccgggcctacagcatcgtcatccggcagatcagtgacctgatgggcctcatccccaagtacaaccacctggtgtacagccagatcccagctgctgtgaagctgacctaccaggatgctgtgaacctgcagaactacgtggaggagaagctgatccccacctggaactggatggtgtccatcatggacagcacagaggcccagctgcgctatggcagcgccctggccagcgctggggaccccggccaccccaaccaccccctgcacgccagccagaacagcgcccggcgggagaggatgacagcccgggaggaggccagcctgcggaccctggagggcagaagaagagccaccctgctgagcgcccggcagggcatgatgtctgcccggggggacttcctgaactatgccctgagcctgatgaggagccacaatgatgagcacagtgatgtgctgcctgtgctggatgtgtgcagcctgaagcacgtggcctacgtgttccaggccctgatctactggatcaaggccatgaaccagcagaccaccctggacaccccccagctggagaggaagaggacccgggagctgctggagctgggcatcgacaatgaagacagcgagcatgaaaatgatgatgacaccaaccagagcgccaccctgaatgacaaggatgatgacagcctgcctgctgagaccggccagaaccaccccttcttccgccgcagtgacagcatgaccttcctgggctgcatcccccccaacccctttgaggtgcccctggccgaggccatccccctggccgaccagccccacctgctgcagcccaatgccaggaaggaggacctgtttggccggcccagccagggcctgtacagcagcagcgccagcagcggcaagtgcctgatggaggtgacagtggacaggaactgcctggaggtgctgcccaccaagatgtcctatgctgccaacctgaagaatgtgatgaacatgcagaaccggcagaagaaggagggggaggagcagcctgtgctgcctgaggagacagagagcagcaagccaggccccagcgcccatgacctggccgcccagctgaagagcagcctgctggccgagatcggcctgacagaaagtgagggcccccccctgaccagcttccggccccagtgcagcttcatgggcatggtgatcagccatgacatgctgctgggccgctggaggctgagcctggagctgtttggccgggtcttcatggaggatgtgggcgctgagcccggcagcatcctgacagagctgggcggctttgaggtgaaggagagcaagttccggcgggagatggagaagctgaggaaccagcagagccgggacctgagcctggaggtggaccgggaccgggacctgctgatccagcagaccatgaggcagctgaacaaccactttggaagaagatgtgccaccacccccatggctgtgcaccgggtgaaggtgaccttcaaggatgagcctggagagggcagcggcgtggcccggagcttctacacagccatcgcccaggccttcctgagcaatgagaagctgcccaacctggagtgcatccagaatgccaacaagggcacccacaccagcctgatgcagaggctgaggaacagaggagagcgggaccgggagcgggagcgggagcgggagatgagaagaagcagcggcctgcgggccggcagcagaagagaccgggaccgggacttccggcggcagctgagcattgacacccggcccttccggcctgccagcgagggcaaccccagtgatgatcctgagcccctgcctgcccaccggcaggccctgggggagcggctgtacccccgggtgcaggccatgcagcctgcctttgccagcaagatcaccggcatgctgctggagctgagccctgcccagctgctgctgctgctggccagcgaggacagcctgcgggcccgggtggatgaggccatggagctgatcatcgcccacggcagagaaaatggagctgacagcatcctggacctgggcctggtggacagcagcgagaaggtgcaggagaacaggaagagacatggcagcagccgctctgtggtggacatggacctggatgacacagatgatggagatgacaatgcccccctcttctaccagcccgggaagaggggcttctacacccccaggcctgggaagaacacagaggcccggctgaactgcttcagaaatattggccgcatcctgggcctgtgcctgctgcagaatgagctgtgccccatcaccctgaacagacatgtgatcaaggtgctgctgggcaggaaggtgaactggcatgactttgccttctttgatcctgtgatgtatgagagcctgcggcagctgatcctggccagccagagcagtgatgctgatgctgtgttttctgccatggacctggcctttgccatcgacctgtgcaaggaggagggcggcggccaggtggagctgatccccaatggagtgaacatccctgtgaccccccagaatgtgtatgaatatgtgaggaaatatgcagagcacaggatgctggtggtggccgagcagcccctgcacgccatgaggaagggcctgctggatgtgctgcccaagaacagcctggaggacctgacagctgaggacttccggctgctggtgaatggctgtggggaggtgaatgtgcagatgctgatctccttcaccagcttcaatgatgaaagtggagaaaatgctgagaagctgctgcagttcaagcgctggttctggagcatcgtggagaagatgtccatgacagagcggcaggacctggtgtacttctggaccagcagccccagcctgcctgccagcgaggagggcttccagcccatgcccagcatcaccatccggcccccagatgaccagcacctgcccacagccaacacctgcatcagccggctgtatgtgcccctgtacagcagcaagcagatcctgaagcagaagctgctgctggccatcaagaccaagaactttggatttgtgtag

SEQ ID NO: 41691 - DNA, 414 bp, Artificial Sequence
  Description of Artificial Sequence: Synthetic coding sequence
atggcccggggccgccacgtgggcagcagcgagaccaagctgctgcagcacctgctggaggcctgtggccgctgtgaggaggtgcctgaggcctacgtggacatccacacaggcctgagcggcagcggcgtggcctttgtgtgtgccttcagcgaggccctggccgagggcgctgtgaagatgggcatgcccagcagcctggcccacagaattgctgcccagaccctgctgggcacagccaagatgctgctgcacgagggccagcacccagcccagctgcggagtgatgtgtgcacccctgggggcaccaccatctacggcctgcacgccctggagcagggcggcctgcgggccgccaccatgtctgctgtggaggccgccacctgccgggccaaggagctgagcaggaagtag

SEQ ID NO: 41692 - DNA, 762 bp, Artificial Sequence
  Description of Artificial Sequence: Synthetic coding sequence
atgacccagggcacagaggacctgaagggccctggccagagatgtgaaaatgagcccctgctggaccctgtgggccctgagcccctgggccctgagagccagagcgggaaaggagacatggtggagatggccaccaggtttggcagcaccctgcagctggacctggagaagggcaaggagagcctgctggagaagaggctggtggccgaggaggaggaggatgaggaggaggtggaggaggatggccccagcagctgcagtgaagatgactacagcgagctgctgcaggagatcacagacaacctgaccaagaaggagatccagatcgagaagatccacctggacaccagcagctttgtggaggagctgcccggggagaaggacctggcccacgtggtggagatctatgactttgagcccgccctgaagacagaggacctgctggccaccttcagcgagttccaggagaagggcttccgcatccagtgggtggatgacacccacgccctgggcatcttcccctgcctggccagcgctgctgaggccctgacccgggagttctctgtgctgaagatccggcccctgacccagggcaccaagcagagcaagctgaaggccctgcagaggcccaagctgctgcggctggtgaaggagcggccccagaccaatgccaccgtggcccggcggctggtggcccgggccctgggcctgcagcacaagaagaaggagaggcctgctgtgcggggccccctgcccccatag

SEQ ID NO: 41693 - DNA, 1443 bp, Artificial Sequence
  Description of Artificial Sequence: Synthetic coding sequence
atgaacatgaaggccagccgggtgaccctgggggaggccggggcccgggcccgctggcccctgggcacccccagggctgctgccacccggcgggaggccgccgccctgccccctgtgaccctggccctgctgtgcctggatggagtcttcctgagcagcgcagaaaatgactttgtgcaccgcatccaggaggagctggaccgcttcctgctgcagaagcagctgagcaaggtgctgctcttcccccccctgagcagccggctgcgctacctgatccacaggacagcagaaaattttgacctgctgagcagcttctctgtgggggagggctggaagagaagaactgtcatctgccaccaggacatccgggtgcccagcagtgatggcctgagcggcccctgccgggccccagccagctgccccagccgctaccacggcccccggcccatcagcaaccagggcgctgctgctgtgcccaggggggcccgggccggccgctggtaccggggcaggaagccagaccagcccctgtatgtgccccgggtgctgcggcggcaggaggagtggggcctgaccagcacctctgtgctgaagcgggaggccccagctggccgggaccctgaggagcctggagatgtgggcgctggggaccccaacagcgaccagggcctgcctgtgctgatgacccagggcacagaggacctgaagggccctggccagagatgtgaaaatgagcccctgctggaccctgtgggccctgagcccctgggccctgagagccagagcggcaagggggacatggtggagatggccacccgcttcggcagcaccctgcagctggacctggagaagggcaaggagagcctgctggagaagaggctggtggccgaggaggaggaggatgaggaggaggtggaggaggatggccccagcagctgcagtgaagatgactacagcgagctgctgcaggagatcacagacaacctgaccaagaaggagatccagatcgagaagatccacctggacaccagcagctttgtggaggagctgcctggagagaaggacctggcccacgtggtggagatctatgactttgagcccgccctgaagacagaggacctgctggccaccttcagcgagttccaggagaagggcttccgcatccagtgggtggatgacacccacgccctgggcatcttcccctgcctggccagcgctgctgaggccctgacccgggagttctctgtgctgaagatccggcccctgacccagggcaccaagcagagcaagctgaaggccctgcagaggcccaagctgctgcggctggtgaaggagcggccccagaccaatgccaccgtggcccggcggctggtggcccgggccctgggcctgcagcacaagaagaaggagaggcctgctgtgcggggccccctgcccccatag

SEQ ID NO: 41694 - DNA, 762 bp, Artificial Sequence; identical to SEQ ID NO: 41692
  Description of Artificial Sequence: Synthetic coding sequence

SEQ ID NO: 41695 - DNA, 111 bp, Artificial Sequence
  Description of Artificial Sequence: Synthetic coding sequence
atgacccagggcacagaggacctgaagggccctggccagagatgtgaaaatgagcccctgctggaccctgtgggccctgagcccctgggccctgagagccagagcggctag

SEQ ID NO: 41696 - DNA, 402 bp, Artificial Sequence
  Description of Artificial Sequence: Synthetic coding sequence
atgacccagggcacagaggacctgaagggccctggccagagatgtgaaaatgagcccctgctggaccctgtgggccctgagcccctgggccctgagagccagagcgggaaaggagacatggtggagatggccaccaggtttggcagcaccctgcagctggacctggagaagggcaaggagagcctgctggagaagaggctggtggccgaggaggaggaggatgaggaggaggtggaggaggatggccccagcagctgcagtgaagatgactacagcgagctgctgcaggagatcacagacaacctgaccaagaaggagatccagatcgagaagatccacctggacaccagcagctttgtggaggagctgcccggggagaaggacctggcccacgtggtgtag

SEQ ID NO: 41697 - DNA, 291 bp, Artificial Sequence
  Description of Artificial Sequence: Synthetic coding sequence
atgacccagggcacagaggacctgaagggccctggccagagatgtgaaaatgagcccctgctggaccctgtgggccctgagcccctgggccctgagagccagagcgggaaaggagacatggtggagatggccaccaggtttggcagcaccctgcagctggacctggagaagggcaaggagagcctgctggagaagaggctggtggccgaggaggaggaggatgaggaggaggtggaggaggatggccccagcagctgcagtgaagatgactacagcgagctgctgcagtag

SEQ ID NO: 41698 - DNA, 3300 bp, Artificial Sequence
  Description of Artificial Sequence: Synthetic coding sequence
atgaggatgtctgacacagtgacagtgaaggatgaaacagccaccatgaaggacctggaggccgaggtgaaggacaccaccagggtggagaacctgatcaagtctgagaactacggcaagatcctggtggagaagaatgagcactgcatcgagaacaacatcgacctgcagaggcccctgcagagctttggccagacaggcaagaggagcaagagcagcagcaagctgaagctggtgcgcagcctggccgtgtgtgaggagagccccccacctccagcccctgagatcagccaggagaaccaggagaagatccagatccagctgacccagagctttgagaaggaggagaagcccagcaaggatgaagctgagaaggagaaggccagtgacaagctgcccaggaagatgctgagccgggacagcagccaggagtacacagacagcactggaattgacctgcacgagttcctggtgaacaccctgaagaacaacccccgggacaggatgatgctgctgaagctggagcaggagatcctggacttcatcggcaacaatgaaagccccaggaagaagtttcctcccatgaccagctaccacaggatgctgctgcaccgggtggccgcctacttcggcctggaccacaacgtggaccagagcggcaagagcgtcatcgtgaacaagaccagcaacacccgcatcccagaccagaagttcaatgagcacatcaaggatgacaagggggaggacttccagaagcgctacatcctgaagagggacaacagcagctttgacaaggatgacaaccagatgaggatccggctgaaggatgaccggcgcagcaagagcattgaggagcgggaggaggagtaccagagggcccgggaccgcatcttcagccaggacagcctgtgcagccaggagaactacatcatcgacaagaggctgcaggatgaagatgccagcagcacccagcagaggcggcagatcttccgggtgaacaaggatgccagcggccgcagcaccaacagccaccagagcagcacagaaaatgagctgaagtacagcgagccccggccctggagcagcacagacagcgacagcagcctgaggaacctgaagccagctgtgaccaaggccagcagcttcagcggcatctctgtgctgaccaggggggacagcagcggcagcagcaagagcatcggccgcctgagcaagacaggcagcgagagcagcggctctgtgggcagcagcacaggcagcctgagccacatccagcagcccctgcctggaacagccctgagccagagcagccacggggcccctgtggtgtaccccaccgtgtccacccacagcagcctgagctttgatggcggcctgaatggccaggtggccagccccagcaccagcttcttcctgctgcccctggaggccgccggcatccccccaggcagcatcctgatcaacccccagacaggccagcccttcatcaacccagatggcagccctgtggtgtacaacccccccatgacccagcagcctgtgcgcagccaggtgcccggccccccccagccccccctgcctgccccaccccagcagcctgctgccaaccacatcttcagccaggacaacctgggcagccagttcagccacatgagcctggcccggcagcccagcgcagatggcagtgacccccacgccgccatgttccagagcacagtggtgctgcagagcccccagcagagcggctacatcatgacagctgcccccccaccccaccccccacctcctcctcctcctcctcctcctcctccacccctgcccccaggccagcctgtgcccacagctggctacccagccagcggccaccctgtgtcccagcctgtgctgcagcagcagggctacatccagcagcccagcccccagatgcctgcctgctactgtgcccctggccactaccacagcagccagccccagtacagacctgtgcccagcgtgcactacaacagccacctgaaccagcccctgccccagcctgcccagcagacaggctaccaggtgatccccaaccagcagcagaactaccagggcatcgtgggcgtgcagcagccccagagccagagcctggtgtctggccagcccaacagcatcggcaaccagatccagggcgtggtgatcccctacacctctgtgcccacctaccaggtgtccctgccccagggcagccagggcatcccccaccagacctaccagcagcctgtgatgttccccaaccagagcaaccagggctccatgcccaccaccggcatgcctgtgtactacagcgtcatccccccaggccagcagaacaacctgagcagctctgtgggctacctgcagcaccctggcagcgagcaggtgcagttccccaggaccaccagcccctgcagcagccagcagctgcagggccaccagtgcacagctggccccccacctcctcctgggggcggcatggtgatgatgcagctgtctgtgcccaacaacccccagagctgtgcccacagccccccccagtggaagcagaacaagtactactgtgaccaccagaggggccagaagtgtgtggagttcagctctgtggacaacatcgtgcagcacagcccccagctgagcagccccatcatcagccctgcccagagccctgccccagcccagctgagcaccctgaagacagtgcggcccagcggcccccccctgagcatcatgccccagttcagccggccctttgtgcccggccagggcgacagccgctaccccctgctgggccagcccctgcagtacaaccccccagctgtgctgcacggccacatccccaaccagcagggccagcccggcagccgccacggcaacagaggaagacggcaggccaagaaggccgccagcacagacctgggcgctggggagaccgtggtgggcaaggtgctggagatcacagagctgcctgatggcatcaccaggatggaggccgagaagctgtttggagagctgttcaagattggagccaagatccgctggctgcgggacccccagagccagccccggcggcaccccctgtgctgcggcagcggggacaacacagccaaccctgagaggagcaagcccagcgacctggccagcacctacacagtgctggccaccttccccagcatctctgctgcccagaatgccctgaagaagcagatcaacagcgtgaacaagttcaagctgcggaccagcaagaagcactatgacttccacatcctggagcgggccagcagccagtag

SEQ ID NO: 41699 - DNA, 2913 bp, Artificial Sequence
  Description of Artificial Sequence: Synthetic coding sequence
atgaggatgtctgacacagtgacagtgaaggatgaaacagccaccatgaaggacctggaggccgaggtgaaggacaccaccagggtggagaacctgatcaagtctgagaactacggcaagatcctggtggagaagaatgagcactgcatcgagaacaacatcgacctgcaggagaagatccagatccagctgacccagagctttgagaaggaggagaagcccagcaaggatgaagctgagaaggagaaggccagtgacaagctgcccaggaagatgctgagccgggacagcagccaggagtacacagacagcactggaattgacctgcacgagttcctggtgaacaccctgaagaacaacccccgggacaggatgatgctgctgaagctggagcaggagatcctggacttcatcggcaacaatgaaagccccaggaagaagtttcctcccatgaccagctaccacaggatgctgctgcaccgggtggccgcctacttcggcctggaccacaacgtggaccagagcggcaagagcgtcatcgtgaacaagaccagcaacacccgcatcccagaccagaagttcaatgagcacatcaaggatgacaagggggaggacttccagaagcgctacatcctgaagagggacaacagcagctttgacaaggatgacaaccagatgaggatccggctgaaggatgaccggcgcagcaagagcattgaggagcgggaggaggagtaccagagggcccgggaccgcatcttcagccaggacagcctgtgcagccaggagaactacatcatcgacaagaggctgcaggatgaagatgccagcagcacccagcagaggcggcagatcttccgggtgaacaaggatgccagcggccgcagcaccaacagccaccagagcagcacagaaaatgagctgaagtacagcgagccccggccctggagcagcacagacagcgacagcagcctgaggaacctgaagccagctgtgaccaaggccagcagcttcagcggcatctctgtgctgaccaggggggacagcagcggcagcagcaagagcatcggccgcctgagcaagacaggccagcccttcatcaacccagatggcagccctgtggtgtacaacccccccatgacccagcagcctgtgcgcagccaggtgcccggccccccccagccccccctgcctgccccaccccagcagcctgctgccaaccacatcttcagccaggacaacctgggcagccagttcagccacatgagcctggcccggcagcccagcgcagatggcagtgacccccatgctgccatgttccagagcacagtggtgctgcagagcccccagcagagcggctacatcatgacagctgcccccccaccccaccccccacctcctcctcctcctcctcctcctcctccacccctgcccccaggccagcctgtgcccacagctggctacccagccagcggccaccctgtgtcccagcctgtgctgcagcagcagggctacatccagcagcccagcccccagatgcctgcctgctactgtgcccctggccactaccacagcagccagccccagtacagacctgtgcccagcgtgcactacaacagccacctgaaccagcccctgccccagcctgcccagcagacaggctaccaggtgatccccaaccagcagcagaactaccagggcatcgtgggcgtgcagcagccccagagccagagcctggtgtctggccagcccaacagcatcggcaaccagatccagggcgtggtgatcccctacacctctgtgcccacctaccaggtgtccctgccccagggcagccagggcatcccccaccagacctaccagcagcctgtgatgttccccaaccagagcaaccagggctccatgcccaccaccggcatgcctgtgtactacagcgtcatccccccaggccagcagaacaacctgagcagctctgtgggctacctgcagcaccctggcagcgagcaggtgcagttccccaggaccaccagcccctgcagcagccagcagctgcagggccaccagtgcacagctggccccccacctcctcctgggggcggcatggtgatgatgcagctgtctgtgcccaacaacccccagagctgtgcccacagccccccccagtggaagcagaacaagtactactgtgaccaccagaggggccagaagtgtgtggagttcagctctgtggacaacatcgtgcagcacagcccccagctgagcagccccatcatcagccctgcccagagccctgccccagcccagctgagcaccctgaagacagtgcggcccagcggcccccccctgagcatcatgccccagttcagccggccctttgtgcccggccagggcgacagccgctaccccctgctgggccagcccctgcagtacaaccccccagctgtgctgcacggccacatccccaaccagcagggccagcccggcagcagacatggcaacagaggccggcggcaggccaagaaggccgccagcacagacctgggcgctggggagaccgtggtgggcaaggtgctggagatcacagagctgcctgatggcatcaccaggatggaggccgagaagctgtttggagagctgttcaagatcggggccaagatccgctggctgcgggacccccagagccagcccaggaggcaccccctgtgctgcggcagcggggacaacacagccaaccctgagaggagcaagcccagcgacctggccagcacctacacagtgctggccaccttccccagcatctctgctgcccagaatgccctgaagaagcagatcaacagcgtgaacaagttcaagctgcggaccagcaagaagcactatgacttccacatcctggagcgggccagcagccagtag

SEQ ID NO: 41700 - DNA, 807 bp, Artificial Sequence
  Description of Artificial Sequence: Synthetic coding sequence
atggtggccctggagaacccagaatgtggccctgaggccgctgagggcacccctgggggccgccgcctgctgcccctgcccagctgcctgcctgccctggccagcagccaggtgaagaggctgagcgccagcaggaggaagcagcacttcatcaaccaggccgtgaggaacagcgacctggtgcccaaggccaagggcaggaagagcctgcagaggctggagaacacccagtacctgctgaccctgctggagacagatggcggcctgcccggcctggaggatggagacctggcccccccagccagccctggcatctttgctgaggcctgcaacaatgccacctacgtggaggtgtggaatgacttcatgaacagaagtggagaggagcaggagcgggtgctgcgctacctggaggatgagggccgcagcaaggccaggagaagaggccctggccgcggggaggacagaagaagagaagatcctgcctacaccccccgggagtgcttccagaggatcagccggcggctgcgggctgtgctgaagaggagccgcatccccatggagaccctggagacctgggaggagcggctgctgcgcttcttctctgtgagcccccaggccgtgtacacagccatgctggacaacagctttgagcggctgctgctgcatgctgtgtgccagtacatggacctgatcagcgccagcgctgacctggagggcaagaggcagatgaaggtgagcaacagacacctggacttcctgcccccaggcctgctgctgagcgcctacctggagcagcacagctag

SEQ ID NO: 41701 - DNA, 690 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggccgcaccatcctggtggacttctgggacacagctggccaggagcgcttccagagcatgcacgccagctactaccacaaggcccacgcctgcatcatggtgtttgatgtgcagaggaaggtgacctacagaaacctgagcacctggtacacagagctgcgggagttccggcctgagatcccctgcatcgtggtggccaacaagattgatgctgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagaccccatctgaggaggccgccagcccccacagctag

SEQ ID NO: 41702 - DNA, 687 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggccgcaccatcctggtggacttctgggacacagctggccaggagcgcttccagagcatgcacgccagctactaccacaaggcccacgcctgcatcatggtgtttgatgtgcagaggaaggtgacctacagaaacctgagcacctggtacacagagctgcgggagttccggcctgagatcccctgcatcgtggtggccaacaagattgatgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagacccccagcgaggaggccgccagcccccacagctag

SEQ ID NO: 41703 - DNA, 690 bp, Artificial Sequence; identical to SEQ ID NO: 41701
  Description of Artificial Sequence: Synthetic coding sequence

SEQ ID NO: 41704 - DNA, 558 bp, Artificial Sequence
  Description of Artificial Sequence: Synthetic coding sequence
atgctgaaggccaagatcctgtttgtgggcccctgtgagagcggcaagacagtgctggccaacttcctgacagagagcagtgacatcacagagtacagccccacccagggcgtgcgcatcctggagtttgagaacccccacgtgaccagcaacaacaagggcaccggctgtgaatttgagctgtgggactgtggaggagatgccaagtttgagagctgctggccagccctgatgaaggatgcccacggcgtggtgattgtgttcaatgctgacatccccagccacaggaaggagatggagatgtggtacagctgctttgtgcagcagcccagcctgcaggacacccagtgcatgctgattgcccaccacaagccaggcagcggagatgacaagggcagcctgagcctgagcccccccctgaacaagctgaagctggtgcacagcaacctggaggatgatcctgaggagatccgcatggagttcatcaagtacctgaagagcatcatcaacagcatgtctgagagccgggaccgggaggagatgagcatcatgacctag

SEQ ID NO: 41705 - DNA, 558 bp, Artificial Sequence; identical to SEQ ID NO: 41704
  Description of Artificial Sequence: Synthetic coding sequence

SEQ ID NO: 41706 - DNA, 468 bp, Artificial Sequence
  Description of Artificial Sequence: Synthetic coding sequence
atgctgaaggccaagatcctgtttgtgggcccctgtgagagcggcaagacagtgctggccaacttcctgacagagagcagtgacatcacagagtacagccccacccagggcgtgcgctttgagagctgctggccagccctgatgaaggatgcccacggcgtggtgattgtgttcaatgctgacatccccagccacaggaaggagatggagatgtggtacagctgctttgtgcagcagcccagcctgcaggacacccagtgcatgctgattgcccaccacaagccaggcagcggagatgacaagggcagcctgagcctgagcccccccctgaacaagctgaagctggtgcacagcaacctggaggatgatcctgaggagatccgcatggagttcatcaagtacctgaagagcatcatcaacagcatgtctgagagccgggaccgggaggagatgagcatcatgacctag

SEQ ID NO: 41707 - DNA, 327 bp, Artificial Sequence
  Description of Artificial Sequence: Synthetic coding sequence
atgaaggatgcccatggagtggtgattgtgttcaatgctgacatccccagccacaggaaggagatggagatgtggtacagctgctttgtgcagcagcccagcctgcaggacacccagtgcatgctgattgcccaccacaagccaggcagcggagatgacaagggcagcctgagcctgagcccccccctgaacaagctgaagctggtgcacagcaacctggaggatgatcctgaggagatccgcatggagttcatcaagtacctgaagagcatcatcaacagcatgtctgagagccgggaccgggaggagatgagcatcatgacctag

SEQ ID NO: 41708 - DNA, 327 bp, Artificial Sequence; identical to SEQ ID NO: 41707
  Description of Artificial Sequence: Synthetic coding sequence

SEQ ID NO: 41709 - DNA, 1071 bp, Artificial Sequence
  Description of Artificial Sequence: Synthetic coding sequence
atggacagcagcgaggagcacgccggctgcccagcccggggcacctgccctgtgttcctggccatgtctgctggcaccgtgcgctatgcccccagcggcctgtgccctgtgctggagggcaacctgcgggaggagccctggggcacagacagccccccccagcctgaccagggcctgcccccacccctggccgctgtgcctgtgccctggaagagcacagacccctgccagggccaccgggagagccctggggccctggtggagaccagcgctggggaggaggcccagggccaggagggccctgctgctgcccagctggatgtgctgcggctgcggagcagctccatggagatccgggagaagggcagcgagttcctgaaggaggagctgcaccgggcccagaaggagctgaagctgaaggatgaagaatgtgagcggctgagcaaggtgcgggagcagctggagcaggagctggaggagctgacagccagcctgtttgaggaggcccacaagatggtgcgggaggccaacatgaagcaggccgccagcgagaagcagctgaaggaggcccggggcaaggtggacaccatcctgtttgctgagttccaggcctggagggagagccccaccctggacaagacctgccccttcctggagcgggtgtaccgggaggatgtgggcccctgcctggacttcaccatgcaggagctgtctgtgctggtgcgggctgctgtggaggacaacaccctgaccatcgagcctgtggccagccagaccctgcccaccgtgaaggtggccgaggtggactgcagcagcaccaacacctgtgccctgagcggcctgaccaggacctgccgccaccgcatccggctgggggacagcaagagccactactacatcagccccagcagccgggcccgcatcacagctgtgtgcaacttcttcacctacatccgctacatccagcagggcctggtgcggcaggatgctgagcccatgttctgggagatcatgaggctgaggaaggagatgagcctggccaagctgggcttcttcccccaggaggcctag

SEQ ID NO: 41710 - DNA, 1149 bp, Artificial Sequence
  Description of Artificial Sequence: Synthetic coding sequence
atgtggagcggccccccccagcctgaccagggcctgcccccacccctggccgctgtgcctgtgccctggaagagcacagacccctgccagggccaccgggagagccctggggccctggtggagaccagcgctggggaggaggcccagggccaggagggccctgctgctgcccagctggatgtgctgcggctgcggagcagctccatggagatccgggagaagggcagcgagttcctgaaggaggagctgcaccgggcccagaaggagctgaagctgaaggatgaggagtgtgagcggctgagcaaggtgcgggagcagctggagcaggagctggaggagctgacagccagcctgtttgaggaggcccacaagatggtgcgggaggccaacatgaagcaggccgccagcgagaagcagctgaaggaggcccggggcaagattgacatgctgcaggccgaggtgacagccctgaagaccctggtgatcaccagcaccccagccagccccaaccgggagctgcacccccagctgctgagccccaccaaggccggccccaggaagggccacagccgccacaagagcaccagcagcaccctgtgcccagctgtgtgcccagctgctggccacaccctgaccccagaccgggagggcaaggaggtggacaccatcctgtttgctgagttccaggcctggagggagagccccaccctggacaagacctgccccttcctggagcgggtgtaccgggaggatgtgggcccctgcctggacttcaccatgcaggagctgtctgtgctggtgcgggctgctgtggaggacaacaccctgaccatcgagcctgtggccagccagaccctgcccaccgtgaaggtggccgaggtggactgcagcagcaccaacacctgtgccctgagcggcctgaccaggacctgccgccaccgcatccggctgggggacagcaagagccactactacatcagccccagcagccgggcccgcatcacagctgtgtgcaacttcttcacctacatccgctacatccagcagggcctggtgcggcaggatgctgagcccatgttctgggagatcatgaggctgaggaaggagatgagcctggccaagctgggcttcttcccccaggaggcctag

SEQ ID NO: 41711 - DNA, 318 bp, Artificial Sequence
  Description of Artificial Sequence: Synthetic coding sequence
atggccacccagggccctgacaaggtgatcttcctgctggtgggccacaagagtgacctgcagagcacccgctgtgtgtctgcccaggaggccgaggagctggccgccagcctgggcatggcctttgtggagacctctgtgaagaacaactgcaatgtggacctggcctttgacaccctggctgatgccatccagcaggccctgcagcagggcgacatcaagctggaggagggctggggcggcgtgcggctcatccacaagacccagatccccaggagccccagcaggaagcagcacagcggcccctgccagtgctag

SEQ ID NO: 41712 - DNA, 1398 bp, Artificial Sequence
  Description of Artificial Sequence: Synthetic coding sequence
atggccatgacaggcagcaccccctgcagctccatgagcaaccacaccaaggagcgggtgaccatgaccaaggtgaccctggagaacttctacagcaacctgattgcccagcacgaggagcgggagatgaggcagaagaagctggagaaggtgatggaggaggagggcctgaaggatgaggagaagaggctgcggcgcagcgcccacgccaggaaggagacagagttcctgcggctgaagaggacccggctgggcctggaggactttgagagcctgaaggtgattggccgcggggccttcggggaggtgcggctggtgcagaagaaggacaccggccacgtgtatgccatgaagatcctgaggaaggctgacatgctggagaaggagcaggtgggccacatccgggcagagcgggacatcctggtggaggccgacagcctgtgggtggtgaagatgttctacagcttccaggacaagctgaacctgtacctgatcatggagttcctgcccggcggggacatgatgaccctgctgatgaagaaggacaccctgacagaggaggagacccagttctacatcgccgagaccgtgctggccatcgacagcatccaccagctgggcttcatccaccgggacatcaagccagacaacctgctgctggacagcaaaggacatgtgaagctgagtgactttggcctgtgcaccggcctgaagaaggcccacaggacagagttctacagaaacctgaaccacagcctgcccagcgacttcaccttccagaacatgaacagcaagaggaaggccgagacctggaagaggaacagacggcagctggccttcagcacagtgggcaccccagactacatcgcccctgaggtgttcatgcagacaggctacaacaagctgtgtgactggtggagcctgggcgtcatcatgtatgagatgctgattggctacccacccttctgcagcgagaccccccaggagacctacaagaaggtgatgaactggaaggagaccctgaccttccccccagaggtgcccatcagcgagaaggccaaggacctgatcctgcgcttctgctgtgagtgggagcaccgcatcggggcccctggggtggaggagatcaagagcaacagcttctttgagggcgtggactgggagcacatccgggagaggcctgctgccatcagcattgagatcaagagcattgatgacaccagcaactttgatgagttccctgagagtgacatcctgaagcccaccgtggccaccagcaaccaccctgagacagactacaagaacaaggactgggtgttcatcaactacacctacaagagatttgagggcctgacagcccggggggccatccccagctacatgaaggccgccaagtag

SEQ ID NO: 41713 - DNA, 651 bp, Artificial Sequence
  Description of Artificial Sequence: Synthetic coding sequence
atggccggccggggcggggccgcccggcccaatggacctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctgggacacagctggccaggagcgctaccacagcctggcccccatgtactacagaggagcccaggccgccatcgtggtgtatgacatcaccaacacagacacctttgcccgggccaagaactgggtgaaggagctgcagaggcaggccagccccaacatcgtgattgccctggccggcaacaaggctgacctggccagcaagagagctgtggagttccaggaggcccaggcctatgcagatgacaacagcctgctcttcatggagaccagcgccaagacagccatgaatgtgaatgagatcttcatggccatcgccaagaagctgcccaagaatgagccccagaatgccactggagcccctggcaggaacagaggagtggacctgcaggagaacaacccagccagccgcagccagtgctgcagcaactag

SEQ ID NO: 41714 - DNA, 861 bp, Artificial Sequence
  Description of Artificial Sequence: Synthetic coding sequence
atggctgacaccatcttcggcagcggaaatgaccagtgggtgtgccccaatgaccggcagctggccctgcgggccaagctgcagacaggctggagcgtgcacacctaccagacagagaagcagaggaggaagcagcacctgagccctgctgaggtggaggccatcctgcaggtgatccagagagctgagcggctggatgtgctggagcagcagagaattggccgcctggtggagcggctggagaccatgagaagaaatgtgatgggaaatggcctgagccagtgcctgctgtgtggggaggtgctgggcttcctgggcagcagctctgtgttctgcaaggactgcaggaaggtgtggaagaggtctggggcctggttctacaagggcctgcccaagtacatcctgcccctgaagaccccaggccgggcagatgacccccacttccggcccctgcccacagagcctgctgagcgggagcccaggagcagcgagaccagccgcatctacacctgggcccggggccgggtggtgtccagtgacagcgacagcgacagcgacctgagcagcagcagcctggaggaccggctgcccagcactggagtgcgggacagaaaaggagacaagccctggaaggagagcggcggctctgtggaggcccccaggatgggcttcacccaccccccaggccacctgagcggctgccagagcagcctggccagcggggagactggaactggatctgctgaccccccaggcggcccccggcccggcctgacccggcgggcccctgtgaaggacaccccaggccgggccccagctgctgatgctgccccagctggccccagcagctgcctgggctag

SEQ ID NO: 41715 - DNA, 2013 bp, Artificial Sequence
  Description of Artificial Sequence: Synthetic coding sequence
atgaaccaggtgacagactgggtggaccccagctttgatgacttcctggagtgcagcggcgtgtccaccatcacagccaccagcctgggcgtgaacaacagcagccacaggaggaagaatggccccagcaccctggagagcagccgcttccctgccaggaagaggggcaacctgagcagcctggagcagatctacggcctggagaacagcaaggagtacctgtctgaaaatgagccctgggtggacaagtacaagccagagacccagcacgagctggccgtgcacaagaagaagattgaggaggtggagacctggctgaaggcccaggtgctggagcggcagcccaagcagggcggcagcatcctgctgatcactggacctcctggctgtgggaagaccaccaccctgaagatcctgagcaaggagcacggcatccaggtgcaggagtggatcaaccctgtgctgcctgacttccagaaggatgacttcaagggcatgttcaacacagagagcagcttccacatgttcccctaccagagccagattgctgtgttcaaggagttcctgctgcgggccaccaagtacaacaagctgcagatgctgggagatgacctgaggacagacaagaagatcatcctggtggaggacctgcccaaccagttctacagagacagccacaccctgcacgaggtgctgaggaaatatgtgcgcatcggccgctgccccctcatcttcatcatcagtgacagcctgagcggggacaacaaccagaggctgctcttccccaaggagatccaggaggagtgcagcatcagcaacatctccttcaaccctgtggcccccaccatcatgatgaagttcctgaacagaattgtgaccatcgaggccaacaagaatggaggcaagatcaccgtgcctgacaagaccagcctggagctgctgtgccagggctgcagcggggacatccgcagcgccatcaacagcctgcagttcagcagcagcaaaggagagaacaacctgcggcccaggaagaagggcatgagcctgaagagtgatgctgtgctgagcaagagcaagaggaggaagaagccagacagagtgtttgagaaccaggaggtgcaggccatcggcggcaaggatgtgtccctcttcctgttccgggccctgggcaagatcctgtactgcaagagggccagcctgacagagctggacagcccccggctgcccagccacctgtctgaatatgagcgggacaccctgctggtggagcctgaggaggtggtggagatgagccacatgcctggggacctcttcaacctgtacctgcaccagaactacatcgacttcttcatggagattgatgacatcgtgcgggccagcgagttcctgagctttgctgacatcctgagcggggactggaacaccaggagcctgctgcgggagtacagcaccagcatcgccacccggggcgtgatgcacagcaacaaggcccggggctacgcccactgccagggcggcggcagcagcttccggcccctgcacaagccccagtggttcctgatcaacaagaagtaccgggagaactgcctggccgccaaggccctcttcccagacttctgcctgcctgccctgtgccggcagacccagctgctgccctacctggccctgctgaccatccccatgaggaaccaggcccagatctccttcatccaggacatcggccgcctgcccctgaagaggcacttcggccgcctgaagatggaggccctgacagaccgggagcacggcatgattgatcctgacagcggagatgaggcccagctgaatggaggccacagcgctgaggagagcctgggggagcccacccaggccaccgtgcctgagacctggagcctgcccctgagccagaacagcgccagcgagctgcctgccagccagccccagcccttcagcgcccagggcgacatggaggagaacatcatcattgaagattatgaaagtgatggcacctag

SEQ ID NO: 41716 - DNA, 2013 bp, Artificial Sequence; identical to SEQ ID NO: 41715
  Description of Artificial Sequence: Synthetic coding sequence

SEQ ID NO: 41717 - DNA, 2013 bp, Artificial Sequence; identical to SEQ ID NO: 41715
  Description of Artificial Sequence: Synthetic coding sequence

SEQ ID NO: 41718 - DNA, 3480 bp, Artificial Sequence
  Description of Artificial Sequence: Synthetic coding sequence
atgagcctgccccagcccacccccaggatggccgagctgaggaagcccaccagcagcctgaccccacctgaggaccctgacagccagccccccagcagcaagaggctgtgcctggaggagcctggaggagtcttcaaggccggctggaggctgcccctggtgccccggctgtctgaggccgagaaggtgtgggagctgagcccccggcccttcaagggcctgctggtgtccaccaatgccatctttgacaacagcacagacagctgtgtggagaagtctgtgtctgggaagcagatctgcaacctgaagtgcagcaacctgaagttccagatgagcagctgcctgcagagcccccccagccagagcccagacagcgacctgcgggccagcggccgctctgaggccggcctgcatgaccgggaggccttctctgtgcacaggagcaacagcagcaaggccggcgtgtcccagctgctgcccagcaccagcatccatgacatccacggcatcagaaatgaaaataggaagcagcagtttgtgcagggccgggacaacgtgcacaaggagaaccccttcctggatgtgaccttctacaaggagaccaagagccccttccacgagatcaagaaccgctgcaaggccaacagcgtggtgcccagcaacaagcgggagaacaacatcagcagctctgtgctgaagatcagcaagagccagaaccagcccagcctggagatcgccaagcccagctacttccgggacagcggcaccatctctgtgccccagttccccatggacctgaacagcaagatgagctctgtgtacctgaaggagatcgccaagaagaagaatgacaagaaggaggcctacgtgcgggacttcaccaacatctactggagccagaacagaccagatgtgaagaagcagaagctgcagaatgacaagaagacagtggaggccgagaacatcttcagcaaatgttatgaaaatgactaccccagcctgagcagccagaacacctgcaagaggaaggacctgatcagcagcaactactgcaactgcagcagcatccagtgcaatgtgcgggacagcaggaagaactttgccatcctggagaatgccaactgggaggaggctgaatgtctggacagctatgtgctgacccggctggagaagagccagaactgggactgcaatgtgcgccacatcctgcggaggaacagaggcaactgctggatcatcaacaactgcaagaccaagtgtgagaacatgaagaagacagaggagaagtggaactggctgctgctgctggagattgacctgctgagcaaggaggactaccactgtgccaaggtgatcaatgcctatgaggagcagagcaagctgctggtgcgggagatcctgggcagccagacagccctgatcaccaccgtgtggctgaatggcaagggggagaatgacaacaccctgcagctgcgctacaacaccacccagaaggtgttccacgtgaacaacccctttgagagcttcatcatcgagatcttctacttccacaagagcatcagcggcaacaagaaggacaacagcatcctgacctgctgcaacatcctgaagtgcaagaagcagatcggcatcatcggcatccagaacctgatcaccaggaacatgaacaccaacatcaagaatggcatcctgagcatctacctgcaggacagcgtgtctgagcccctggacatcctgctgaagaccaacatcgccttcctgctgaacaactttgacagcctgaccagaattgaaaatgactttgagctggaggaggagtgcatcttcaagtgcatgctgtacctgaagtaccccaagaacatcgtggagaaccacacagcctacctggtgaagatcctgaccagcagccggctgctggaggacaacatgaagcccatgctgaagaagaggaagctgttcagaacagagcaggtgtttgagaagagcaagaagaagctgatcaacagcttctccatgaccacccagaacacaggcttccccatctttgagacctatgagaagatccccctgctgatggactttgatgacatggatgagatcagcctcatccgggagatcacctgccagaacatgagctgcccccagcaggtggtgaatgtggagaactgggcccactacaacagcagcacagtgaaggcccacggcaacagctgcccccagttcatccagaacaacagaggctacatcaatgaaaacttctatgaggtgaacatgcacagccaggacctgaacatggagaggaagcagggccacaacaagatcagcaactttgactgtgagcacatctttgaggacctgtgcaatgtgcggcagcaggccatcccagccagccacaacatcatccacaatgaggagacccacaccaccagcatcacccaggtgctgaacttctggaacctgctgtctgaaattgaggagaagaagtatgacctgatcctgaaggaggaggtgaaggtgacagctgagagcctgaccaacagctgccaggtgcacaaggacaccaagattgagaaggaggagaaggacagcttcttccccatggatgacatgttttctgtgcagagcgtgtccctcatcagcaaggaggtgaatgtggaggagaacaagtatgtgaaccagaactacgtgaccaacaccaatgaatatgagagcatcctgcctgagcgggagatcgccaacagcaaggacttccacaggaagaatgattctgccctgtacatcaaccaccagtttgaaacaggcctgtctgagggcaatgatgagtgcttccaggacctggccgccaagtacctgagcacagaggccctgaccatcgtgaaggactttgagatgaagaggaagtttgacctggtgctggaggagctgaggatgtttcatgagatcagccgggagaatgagctgctgagcacagtggagaccaacaacggccaggagaactactttggagaaaatgatgctgagaaggtgaagatggagattgagaaggacctgaagatggtggtggtgaacaagatccgggccagcagcagcttccatgacaccatcgccggccccaacatgggcaagagccaccagagcctcttcaagtggaagacagtgcccaacaacggggagcaggaggtgcccaatgaaagctgctaccccagccgctctgaggaggagctgctgtacagcaccagcgagaaggactgtgagacccccctgcccaagaggcctgccttcctgcctgatgagtgcaaggaggagttcaactacctgctgcggggcggcagccacttcccccacggcatcagccgggtgcggcccctgaagacctgcagccggcccatccgcatcggcctgagcaggaaggcccgcatcaagcagctgcacccctacctgaagcagatgtgctacggcaacctgaaggagaacttctag

SEQ ID NO: 41719 - DNA, 1683 bp, Artificial Sequence
  Description of Artificial Sequence: Synthetic coding sequence
atgacagtgaagccagccaaggccgccagcctggccaggaacctggccaagagaagaaggacctacctgggcggcgctgctggccgcagccaggagcctgaggtgccctgtgccgctgtgctgcccgggaagccaggggacaggaactgcccagagttccccccaccagacaggaccctgggctgctgggccacagatgctgccccagctgctggcctgtgtggggccggcagcgagcccagcatcgcccccaccagctgtgccggcaacctgcccagccggcccccacccctgctgagccccctgctggccagcaggaacccctgcccctggcactacctgcacctgagcggcagccacaacaccctggcccccacctgcttcaaggccaagctgcacaggaagaggggcagccagcccccagacatggccagcgccctgacagacaggaccagccgggcccccagcacctacacctacaccagccggccccgggccctgccctgccagaggagccgctacagagacagcctgacccagccagatgaggagcccatgcactacggcaacatcatgtatgacagaagagtcatccggggcaacacctacgccctgcagacaggccccctgctgggccgcccagacagcctggagctgcagaggcagcgggaggccaggaagagggccctggccaggaagcaggcccaggagcagctgcggccccagaccccagagcctgtggagggcaggaagcacgtggatgtgcagacagagctgtacctggaggagattgctgaccgcatcatcgaggtggacatggagtgccagacagatgccttcctggaccggccccccacccccctcttcatcccagccaagacaggcaaggatgtggccacccagatcctggagggggagctgtttgattttgacctggaggtgaagcctgtgctggaggtgctggtgggcaagaccatcgagcagagcctgctggaggtgatggaggaggaggagctggccaacctgcgggccagccagcgggagtatgaggagctgagaaattctgagcgggcagaggtgcagaggctggaggagcaggagcggcggcaccgggaggagaaggagaggaggaagaagcagcagtgggagatcatgcacaagcacaatgagaccagccagaagattgctgcccgggcctttgcccagcgctacctggccgacctgctgcccagcgtgtttggcagcctgcgggacagcggctacttctatgaccccatcgagcgggacatcgagatcggcttcctgccctggctgatgaatgaggtggagaagaccatggagtacagcatggtgggccgcacagtgctggacatgctgatccgggaggtggtggagaagaggctgtgcatgtatgaacatggagaggacacccaccagagccctgagccagaagatgagcccggcggccctggggccatgacagagagcctggaggccagcgagttcctggagcagagcatgagccagacccgggagctgctgctggatggcggctacctgcagaggaccacctatgacagaagaagcagccaggagaggaagttcatggaggagcgggagctgctgggccaggatgaggagacagccatgaggaagagcctgggggaggaggagctgtcctag

SEQ ID NO: 41720 - DNA, 1395 bp, Artificial Sequence
  Description of Artificial Sequence: Synthetic coding sequence
atgacagtgaagccagccaaggccgccagcctggccaggaacctggccaagagaagaaggacctacctgggcggcgctgctggccgcagccaggagcctgaggtgccctgtgccgctgtgctgcccgggaagccaggggacaggaactgcccagagttccccccaccagacaggaccctgggctgctgggccacagatgctgccccagctgctggcctgtgtggggccggcagcgagcccagcatcgcccccaccagctgtgccggcaacctgcccagccggcccccacccctgctgagccccctgctggccagcaggaacccctgcccctggcactacctgcacctgagcggcagccacaacaccctggcccccacctgcttcaaggccaagctgcacaggaagaggggcagccagcccccagacatggccagcgccctgacagacaggaccagccgggcccccagcacctacacctacaccagccggccccgggccctgccctgccagaggagccgctacagagacagcctgacccagccagatgaggagcccatgcactacggcaacatcatgtatgacagaagagtcatccggggcaacacctacgccctgcagacaggccccctgctgtttgattttgacctggaggtgaagcctgtgctggaggtgctggtgggcaagaccatcgagcagagcctgctggaggtgatggaggaggaggagctggccaacctgcgggccagccagcgggagtatgaggagctgagaaattctgagcgggcagaggtgcagaggctggaggagcaggagcggcggcaccgggaggagaaggagaggaggaagaagcagcagtgggagatcatgcacaagcacaatgagaccagccagaagattgctgcccgggcctttgcccagcgctacctggccgacctgctgcccagcgtgtttggcagcctgcgggacagcggctacttctatgaccccatcgagcgggacatcgagatcggcttcctgccctggctgatgaatgaggtggagaagaccatggagtacagcatggtgggccgcacagtgctggacatgctgatccgggaggtggtggagaagaggctgtgcatgtatgaacatggagaggacacccaccagagccctgagccagaagatgagcccggcggccctggggccatgacagagagcctggaggccagcgagttcctggagcagagcatgagccagacccgggagctgctgctggatggcggctacctgcagaggaccacctatgacagaagaagcagccaggagaggaagttcatggaggagcgggagctgctgggccaggatgaggagacagccatgaggaagagcctgggggaggaggagctgtcctag

SEQ ID NO: 41721 - DNA, 1257 bp, Artificial Sequence
  Description of Artificial Sequence: Synthetic coding sequence
atggccagcgccctgacagacaggaccagccgggcccccagcacctacacctacaccagccggccccgggccctgccctgccagaggagccgctacagagacagcctgacccagccagatgaggagcccatgcactacggcaacatcatgtatgacagaagagtcatccggggcaacacctacgccctgcagacaggccccctgctgggccgcccagacagcctggagctgcagaggcagcgggaggccaggaagagggccctggccaggaagcaggcccaggagcagctgcggccccagaccccagagcctgtggagggcaggaagcacgtggatgtgcagacagagctgtacctggaggagattgctgaccgcatcatcgaggtggacatggagtgccagacagatgccttcctggaccggccccccacccccctcttcatcccagccaagacaggcaaggatgtggccacccagatcctggagggggagctgtttgattttgacctggaggtgaagcctgtgctggaggtgctggtgggcaagaccatcgagcagagcctgctggaggtgatggaggaggaggagctggccaacctgcgggccagccagcgggagtatgaggagctgagaaattctgagcgggcagaggtgcagaggctggaggagcaggagcggcggcaccgggaggagaaggagaggaggaagaagcagcagtgggagatcatgcacaagcacaatgagaccagccagaagattgctgcccgggcctttgcccagcgctacctggccgacctgctgcccagcgtgtttggcagcctgcgggacagcggctacttctatgaccccatcgagcgggacatcgagatcggcttcctgccctggctgatgaatgaggtggagaagaccatggagtacagcatggtgggccgcacagtgctggacatgctgatccgggaggtggtggagaagaggctgtgcatgtatgaacatggagaggacacccaccagagccctgagccagaagatgagcccggcggccctggggccatgacagagagcctggaggccagcgagttcctggagcagagcatgagccagacccgggagctgctgctggatggcggctacctgcagaggaccacctatgacagaagaagcagccaggagaggaagttcatggaggagcgggagctgctgggccaggatgaggagacagccatgaggaagagcctgggggaggaggagctgtcctag

SEQ ID NO: 41722 - DNA, 969 bp, Artificial Sequence
  Description of Artificial Sequence: Synthetic coding sequence
atggccagcgccctgacagacaggaccagccgggcccccagcacctacacctacaccagccggccccgggccctgccctgccagaggagccgctacagagacagcctgacccagccagatgaggagcccatgcactacggcaacatcatgtatgacagaagagtcatccggggcaacacctacgccctgcagacaggccccctgctgtttgattttgacctggaggtgaagcctgtgctggaggtgctggtgggcaagaccatcgagcagagcctgctggaggtgatggaggaggaggagctggccaacctgcgggccagccagcgggagtatgaggagctgagaaattctgagcgggcagaggtgcagaggctggaggagcaggagcggcggcaccgggaggagaaggagaggaggaagaagcagcagtgggagatcatgcacaagcacaatgagaccagccagaagattgctgcccgggcctttgcccagcgctacctggccgacctgctgcccagcgtgtttggcagcctgcgggacagcggctacttctatgaccccatcgagcgggacatcgagatcggcttcctgccctggctgatgaatgaggtggagaagaccatggagtacagcatggtgggccgcacagtgctggacatgctgatccgggaggtggtggagaagaggctgtgcatgtatgaacatggagaggacacccaccagagccctgagccagaagatgagcccggcggccctggggccatgacagagagcctggaggccagcgagttcctggagcagagcatgagccagacccgggagctgctgctggatggcggctacctgcagaggaccacctatgacagaagaagcagccaggagaggaagttcatggaggagcgggagctgctgggccaggatgaggagacagccatgaggaagagcctgggggaggaggagctgtcctag

SEQ ID NO: 41723 - DNA, 2613 bp, Artificial Sequence
  Description of Artificial Sequence: Synthetic coding sequence
atggtgaaggagaagaagaaggctgacaagaagggggagaagagcgcccggagccccagcagcctgagtgacaacctggacttcagcaagcaggacggcaacaccacccggcaggagatgagccctgctggggtgcccctgctgggcatgcagctgaatgaggtgaagcccaagaaggaccggcagaatgtgcagcagaatgaagatgccacccagtatgaggagagcatcctgaccaagctgattgtggagagctatgaaggagagaaggtgcggggcctgtatgaaggagagggctttgctgccttccagggcggctgcacctaccggggcatgttcagcgagggcctgatgcacggccagggcacctacatctgggcagatggcctgaagtatgaaggagactttgtgaagaatgtgcccatgaaccacggcgtgtacacctggccagatggctccatgtatgaaggagaggtggtgaatggcatgagaaatggatttggcatgttcaagtgcagcacccagcctgtgtcctacatcggccactggtgcaatggcaagagacatggcaagggcagcatctactacaaccaggagggcacctgctggtatgaaggagactgggtgcagaacatcaagaagggctggggcatccgctgctacaagagcggcaacatctatgagggccagtgggaggacaacatgagacatggagagggccgcatgcgctggctgaccaccaatgaggagtacacaggccgctgggagcggggcatccagaatggatttggcacccacacctggttcctgaagaggatccgcagcagccagtaccccctgagaaatgagtacatcggggagtttgtgaatggctaccgccacggccggggcaagttctactatgccagcggggccatgtatgatggagagtgggtgagcaacaagaagcacggcatgggccgcctgaccttcaagaatggccgggtgtatgagggcgccttcagcaatgaccacatcgccggcttcccagacctggaggtggagttcatcagctgcctggacctgagcagtggagtggccccccggctgagccgctctgctgagctgatcaggaagctggatggcagcgagagccacagcgtgctgggcagcagcattgagctggacctgaacctgctgctggacatgtacccagagaccgtgcagcctgaggagaagaagcaggtggagtatgctgtgctgaggaacatcacagagctgcggcgcatctacagcttctacagcagcctgggctgcggccacagcctggacaacaccttcctgatgaccaagctgcacttctggaggttcctgaaggactgcaagttccaccaccacaagctgaccctggccgacatggaccgcatcctgagcgccaacaatgacatccctgtggaggagatccacagccccttcaccaccatcctgctgcggaccttcctgaactacctgctgcacctggcctaccacatctaccacgaggagttccagaagaggagccccagcctcttcctgtgcttcaccaagctgatgacagagaacatccggcccaatgccttccagatcaagggcaacctcttccgggagcagcagaggaccctgtacagcatgagctacatgaacaagtgctgggagatctacctggcctactgccggcccagcgctgcccctcctcatgagcccaccatgaagatgaggcacttcctgtggatgctgaaggacttcaagatgatcaacaaggagctgacagctgccaccttcatggaggtgattgctgaggacaaccgcttcatctatgatggcatcgacagcaactttgagcctgagctggtgttcctggagttctttgaggccctgctgagctttgccttcatctgtgtgacagaccagatgaccaagagctacaccaacgtgcctgcagatgatgtgtctggcaacaagcatgagaccatctacaccatcctgaaccaggatgcccagaacaagagccccagcgctgtgatgagccatgaaagtgatgctgcccacagcgacagcgcccggagcagcagcagcaagctggagctgagcccagatgtgaacaagatcaggaagtctgagcccaagatcaagaagtctgtgtcccatgagcgggtgtccaagatgaacttcaagctgaccgggaagggcatcaccttcttcagcagcgagagcaagaagtatgagcggcccaaggatgaccgggaggaggagttcaacacctgggtgaacaacatgtatgtgttctttgtgaacaccctcttccacgcctacaagcgggaggaggccatcaaggagaagatccgggctgaccggctgcggagcacagcccaggcccagcagaggaagatggaggatgatgagctggaggcccggctgaacatcttcatcctgcgggaggaggaggccaagagacatgactatgaggtggacatcaccgtgctgaaggagccagcagatgtgagcagcagccacctgatcctggacccccccaaggaggatgtgacagtgagccccagcagcaagaccatcaccagcaagaagaagaagaagtag

SEQ ID NO: 41724 - DNA, 1857 bp, Artificial Sequence
  Description of Artificial Sequence: Synthetic coding sequence
atgaaccacggcgtgtacacctggccagatggctccatgtatgaaggagaggtggtgaatggcatgagaaatggcttcggcatgttcaagtgcagcacccagcctgtgtcctacatcggccactggtgcaatggcaagagacatggcaagggcagcatctactacaaccaggagggcacctgctggtatgaaggagactgggtgcagaacatcaagaagggctggggcatccgctgctacaagagcggcaacatctatgagggccagtgggaggacaacatgagacatggagagggccgcatgcgctggctgaccaccaatgaggagtacacaggccgctgggagcggggcatccagaatggcttcggcacccacacctggttcctgaagaggatccgcagcagccagtaccccctgagaaatgagtacatcggggagtttgtgaatggctacagacatggccggggcaagttctactatgccagcggggccatgtatgatggagagtgggtgagcaacaagaagcacggcatgggccgcctgaccttcaagaatggccgggtgtatgaaggagccttcagcaatgaccacatcgccggcttcccagacctggaggtggagttcatcagctgcctggacctgagcagcggcgtggccccccggctgagccgctctgctgagctgatcaggaagctggatggcagcgagagccacagcgtgctgggcagcagcattgagctggacctgaacctgctgctggacatgtacccagagaccgtgcagcctgaggagaagaagcaggtggagtatgctgtgctgaggaacatcacagagctgcggcgcatctacagcttctacagcagcctgggctgcggccacagcctggacaacaccttcctgatgaccaagctgcacttctggaggttcctgaaggactgcaagttccaccaccacaagctgaccctggccgacatggaccgcatcctgagcgccaacaatgacatccctgtggaggagatccacagccccttcaccaccatcctgctgcggaccttcctgaactacctgctgcacctggcctaccacatctaccacgaggagttccagaagaggagccccagcctcttcctgtgcttcaccaagctgatgacagagaacatccggcccaatgccttccagatcaagggcaacctcttccgggagcagcagaggaccctgtacagcatgagctacatgaacaagtgctgggagatctacctggcctactgccggcccagcgctgcccctcctcatgagcccaccatgaagatgaggcacttcctgtggatgctgaaggacttcaagatgatcaacaaggagctgacagctgccaccttcatggaggtgattgctgaggacaaccgcttcatctatgatggcatcgacagcaactttgagcctgagctggtgttcctggagttctttgaggccctgctgagctttgccttcatctgtgtgacagaccagatgaccaagagctacaccaacgtgcctgcagatgatgtgtctggcaacaagcatgagaccatctacaccatcctgaaccaggatgcccagaacaagagccccagcgctgtgatgagccatgaaagtgatgctgcccacagcgacagcgcccggagcagcagcagcaagctggagctgagcccagatgtgaacaagatcaggaagtctgagcccaagatcaagaagtctgtgtcccatgagcgggtgtccaagatgaacttcaagctgaccgggaagggcatcaccttcttcagcagcgagagcaagaagtatgaaagacccaaggatgaccgggaggaggatggccgctag

SEQ ID NO: 41725 - DNA, 2613 bp, Artificial Sequence; identical to SEQ ID NO: 41723
  Description of Artificial Sequence: Synthetic coding sequence

SEQ ID NO: 41726 - DNA, 2613 bp, Artificial Sequence; identical to SEQ ID NO: 41723
  Description of Artificial Sequence: Synthetic coding sequence

SEQ ID NO: 41727 - DNA, 2613 bp, Artificial Sequence; identical to SEQ ID NO: 41723
  Description of Artificial Sequence: Synthetic coding sequence

SEQ ID NO: 41728 - DNA, 15 bp, Artificial Sequence
  Description of Artificial Sequence: Synthetic coding sequence
atggtgaaggagtag

SEQ ID NO: 41729 - DNA, 843 bp, Artificial Sequence
  Description of Artificial Sequence: Synthetic coding sequence
atgagacatggagagggccgcatgcgctggctgaccaccaatgaggagtacacaggccgctgggagcggggcatccagaatggatttggcacccacacctggttcctgaagaggatccgcagcagccagtaccccctgagaaatgagtacatcggggagtttgtgaatggctaccgccacggccggggcaagttctactatgccagcggggccatgtatgatggagagtgggtgagcaacaagaagcacggcatgggccgcctgaccttcaagaatggccgggtgtatgagggcgccttcagcaatgaccacatcgccggcttcccagacctggaggtggagttcatcagctgcctggacctgagcagtggagtggccccccggctgagccgctctgctgagctgatcaggaagctggatggcagcgagagccacagcgtgctgggcagcagcattgagctggacctgaacctgctgctggacatgtacccagagaccgtgcagcctgaggagaagaagcaggtggagtatgctgtgctgaggaacatcacagagctgcggcgcatctacagcttctacagcagcctgggctgcggccacagcctggacaacaccttcctgatgaccaagctgcacttctggaggttcctgaaggactgcaagttccaccaccacaagctgaccctggccgacatggaccgcatcctgagcgccaacaatgacatccctgtggaggagatccacagccccttcaccaccatcctgctgcggaccttcctgaactacctgctgcacctggcctaccacatctaccacgaggagttccagcagttcatcccctag

SEQ ID NO: 41730 - DNA, 42 bp, Artificial Sequence
  Description of Artificial Sequence: Synthetic coding sequence
atggtgaaggagaagaagaaggctgacaagaagggggagtag

SEQ ID NO: 41731 - DNA, 2613 bp, Artificial Sequence
  Description of Artificial Sequence: Synthetic coding sequence
atggtgaaggagaagaagaaggctgacaagaagggggagaagagcgcccggagccccagcagcctgagtgacaacctggacttcagcaagcaggacggcaacaccacccggcaggagatgagccctgctggggtgcccctgctgggcatgcagctgaatgaggtgaagcccaagaaggaccggcagaatgtgcagcagaatgaagatgccagccagtatgaggagagcatcctgaccaagctgattgtggagagctatgaaggagagaaggtgcggggcctgtatgaaggagagggctttgctgccttccagggcggctgcacctaccggggcatgttcagcgagggcctgatgcacggccagggcacctacatctgggcagatggcctgaagtatgaaggagactttgtgaagaatgtgcccatgaaccacggcgtgtacacctggccagatggctccatgtatgaaggagaggtggtgaatggcatgagaaatggatttggcatgttcaagtgcagcacccagcctgtgtcctacatcggccactggtgcaatggcaagagacatggcaagggcagcatctactacaaccaggagggcacctgctggtatgaaggagactgggtgcagaacatcaagaagggctggggcatccgctgctacaagagcggcaacatctatgagggccagtgggaggacaacatgagacatggagagggccgcatgcgctggctgaccaccaatgaggagtacacaggccgctgggagcggggcatccagaatggatttggcacccacacctggttcctgaagaggatccgcagcagccagtaccccctgagaaatgagtacatcggggagtttgtgaatggctaccgccacggccggggcaagttctactatgccagcggggccatgtatgatggagagtgggtgagcaacaagaagcacggcatgggccgcctgaccttcaagaatggccgggtgtatgagggcgccttcagcaatgaccacatcgccggcttcccagacctggaggtggagttcatcagctgcctggacctgagcagtggagtggccccccggctgagccgctctgctgagctgatcaggaagctggatggcagcgagagccacagcgtgctgggcagcagcattgagctggacctgaacctgctgctggacatgtacccagagaccgtgcagcctgaggagaagaagcaggtggagtatgctgtgctgaggaacatcacagagctgcggcgcatctacagcttctacagcagcctgggctgcggccacagcctggacaacaccttcctgatgaccaagctgcacttctggaggttcctgaaggactgcaagttccaccaccacaagctgaccctggccgacatggaccgcatcctgagcgccaacaatgacatccctgtggaggagatccacagccccttcaccaccatcctgctgcggaccttcctgaactacctgctgcacctggcctaccacatctaccacgaggagttccagaagaggagccccagcctcttcctgtgcttcaccaagctgatgacagagaacatccggcccaatgcctgccagatcaagggcaacctcttccgggagcagcagaggaccctgtacagcatgagctacatgaacaagtgctgggagatctacctggcctactgccggcccagcgctgcccctcctcatgagcccaccatgaagatgaggcacttcctgtggatgctgaaggacttcaagatgatcaacaaggagctgacagctgccaccttcatggaggtgattgctgaggacaaccgcttcatctatgatggcatcgacagcaactttgagcctgagctggtgttcctggagttctttgaggccctgctgagctttgccttcatctgtgtgacagaccagatgaccaagagctacaccaacgtgcctgcagatgatgtgtctggcaacaagcatgagaccatctacaccatcctgaaccaggatgcccagaacaagagccccagcgctgtgatgagccatgaaagtgatgctgcccacagcgacagcgcccggagcagcagcagcaagctggagctgagcccagatgtgaacaagatcaggaagtctgagcccaagatcaagaagtctgtgtcccatgagcgggtgtccaagatgaacttcaagctgaccgggaagggcatcaccttcttcagcagcgagagcaagaagtatgagcggcccaaggatgaccgggaggaggagttcaacacctgggtgaacaacacctacgtgttctttgtgaacaccctcttccacgcctacaagcgggaggaggccatcaaggagaagatccgggctgaccggctgcggagcacagcccaggcccagcagaggaagatggaggatgatgagctggaggcccggctgaacatcttcatcctgcgggaggaggaggccaagagacatgactatgaggtggacatcaccgtgctgaaggagccagcagatgtgagcagcagccacctgatcctggacccccccaaggaggatgtgacagtgagccccagcagcaagaccatcaccagcaagaagaagaagaagtag

SEQ ID NO: 41732 - DNA, 843 bp, Artificial Sequence; identical to SEQ ID NO: 41729
  Description of Artificial Sequence: Synthetic coding sequence

SEQ ID NO: 41733 - DNA, 2613 bp, Artificial Sequence; identical to SEQ ID NO: 41731
  Description of Artificial Sequence: Synthetic coding sequence

SEQ ID NO: 41734 - DNA, 2613 bp, Artificial Sequence; identical to SEQ ID NO: 41731
  Description of Artificial Sequence: Synthetic coding sequence

SEQ ID NO: 41735 - DNA, 180 bp, Artificial Sequence
  Description of Artificial Sequence: Synthetic coding sequence
atggtgaaggagaagaagaaggctgacaagaagggggagaagagcgcccggagccccagcagcctgagtgacaacctggacttcagcaagcaggacggcaacaccacccggcaggagatgagccctgctggggtgcccctgctgggcatgcagctgaatgaggtgaagcccaagaagtag

SEQ ID NO: 41736 - DNA, 2613 bp, Artificial Sequence; identical to SEQ ID NO: 41731
  Description of Artificial Sequence: Synthetic coding sequence

SEQ ID NO: 41737 - DNA, 30 bp, Artificial Sequence
  Description of Artificial Sequence: Synthetic coding sequence
atggtgaaggagaagaagaaggctgactag

SEQ ID NO: 41738 - DNA, 1857 bp, Artificial Sequence
  Description of Artificial Sequence: Synthetic coding sequence
atgaaccacggcgtgtacacctggccagatggctccatgtatgaaggagaggtggtgaatggcatgagaaatggcttcggcatgttcaagtgcagcacccagcctgtgtcctacatcggccactggtgcaatggcaagagacatggcaagggcagcatctactacaaccaggagggcacctgctggtatgaaggagactgggtgcagaacatcaagaagggctggggcatccgctgctacaagagcggcaacatctatgagggccagtgggaggacaacatgagacatggagagggccgcatgcgctggctgaccaccaatgaggagtacacaggccgctgggagcggggcatccagaatggcttcggcacccacacctggttcctgaagaggatccgcagcagccagtaccccctgagaaatgagtacatcggggagtttgtgaatggctacagacatggccggggcaagttctactatgccagcggggccatgtatgatggagagtgggtgagcaacaagaagcacggcatgggccgcctgaccttcaagaatggccgggtgtatgaaggagccttcagcaatgaccacatcgccggcttcccagacctggaggtggagttcatcagctgcctggacctgagcagcggcgtggccccccggctgagccgctctgctgagctgatcaggaagctggatggcagcgagagccacagcgtgctgggcagcagcattgagctggacctgaacctgctgctggacatgtacccagagaccgtgcagcctgaggagaagaagcaggtggagtatgctgtgctgaggaacatcacagagctgcggcgcatctacagcttctacagcagcctgggctgcggccacagcctggacaacaccttcctgatgaccaagctgcacttctggaggttcctgaaggactgcaagttccaccaccacaagctgaccctggccgacatggaccgcatcctgagcgccaacaatgacatccctgtggaggagatccacagccccttcaccaccatcctgctgcggaccttcctgaactacctgctgcacctggcctaccacatctaccacgaggagttccagaagaggagccccagcctcttcctgtgcttcaccaagctgatgacagagaacatccggcccaatgcctgccagatcaagggcaacctcttccgggagcagcagaggaccctgtacagcatgagctacatgaacaagtgctgggagatctacctggcctactgccggcccagcgctgcccctcctcatgagcccaccatgaagatgaggcacttcctgtggatgctgaaggacttcaagatgatcaacaaggagctgacagctgccaccttcatggaggtgattgctgaggacaaccgcttcatctatgatggcatcgacagcaactttgagcctgagctggtgttcctggagttctttgaggccctgctgagctttgccttcatctgtgtgacagaccagatgaccaagagctacaccaacgtgcctgcagatgatgtgtctggcaacaagcatgagaccatctacaccatcctgaaccaggatgcccagaacaagagccccagcgctgtgatgagccatgaaagtgatgctgcccacagcgacagcgcccggagcagcagcagcaagctggagctgagcccagatgtgaacaagatcaggaagtctgagcccaagatcaagaagtctgtgtcccatgagcgggtgtccaagatgaacttcaagctgaccgggaagggcatcaccttcttcagcagcgagagcaagaagtatgaaagacccaaggatgaccgggaggaggatggccgctag

SEQ ID NO: 41739 - DNA, 327 bp, Artificial Sequence
  Description of Artificial Sequence: Synthetic coding sequence
atgaaggccctgtgcctgctgctgctgcctgtgctgggcctgctggtgagcagcaagaccctgtgcagcatggaggaggccatcaatgaaagaatccaggaggtggccggcagcctcatcttccgggccatcagcagcatcggcctggagtgccagagcgtgaccagcagaggagacctggccacctgcccccggggctttgctgtgacaggctgcacctgtggcagcgcctgtggctcctgggatgtgcgggcagagaccacctgccactgccagtgtgccggcatggactggacaggagcccgctgctgccgggtgcagccctag

SEQ ID NO: 41740 - DNA, 4485 bp, Artificial Sequence
  Description of Artificial Sequence: Synthetic coding sequence
atgtacagcgagtggaggagcctgcacctggtgatccagaatgaccagggccacacctctgtgctgcacagctacccagagagcgtgggccgggaggtggccaatgctgtggtgcggcccctgggccaggtgctgggcaccccatctgtggccggcagcgagaacctgctgaagacagacaaggaggtgaagtggaccatggaggtgatctgctacggcctgaccctgcccctggatggagagaccgtgaagtactgtgtggatgtgtacacagactggatcatggccctggtgctgcccaaggacagcatccccctgcctgtgatcaaggagcccaaccagtatgtgcagaccatcctgaagcacctgcagaacctgtttgtgccccggcaggagcagggcagcagccagatccggctgtgcctgcaggtgctgcgggccatccagaagctggcccgggagagcagcctgatggcccgggagacctgggaggtgctgctgctcttcctgctgcagatcaatgacatcctgctggccccacccaccgtgcagggcggcattgctgagaacctggccgagaagctgattggagtgctgtttgaggtgtggctgctggcctgcacccgctgcttccccaccccaccctactggaagacagccaaggagatggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagccatcaccacccaggcctccatggagttccggaggaagggcagccagatgagcacagacaccatggtgagcaaccccatgtttgatgccagcgagttcccagacaactatgaagctggccgggcagaggcctgtggcaccctgtgccgcatcttctgcagcaagaagacaggagaggagatcctgcctgcctacctgagccgcttctacatgctgctgatccagggcctgcagatcaatgactatgtgtgccaccctgtgctggccagcgtcatcctgaacagccccccactcttctgctgtgacctgaagggcattgatgtggtggtgccctacttcatcagcgccctggagaccatcctgcctgaccgggagctgagcaagttcaagagctatgtgaaccccacagagctgcggcgcagcagcatcaacatcctgctgagcctgctgcccctgccccaccacttcggcaccgtgaagtctgaggtggtgctggagggcaagttcagcaatgatgacagcagcagctatgacaagcccatcaccttcctgagcctgaagctgcggctggtgaacatcctgattggagccctgcagacagaaacagaccccaacaacacccagatgatcctgggcgccatgctgaacatcgtgcaggacagcgccctgctggaggccatcggctgccagatggagatgggcggcggggagaacaacctgaagagccacagcaggaccaacagcggcatcagcagcgccagcggcggcagcacagagcccaccaccccagattctgagaggcctgcccaggccctgctgcgggactatgccctgaacacagacagcgctgctggcctgctgatccgcagcatccacctggtgacccagaggctgaacagccagtggaggcaggacatgagcatcagcctggccgccctggagctgctgagcggcctggccaaggtgaaggtgatggtggacagcggggacaggaagagggccatcagctctgtgtgcacctacatcgtgtaccagtgcagcaggcctgcccccctgcacagccgggacctgcacagcatgattgtggccgccttccagtgcctgtgtgtgtggctgacagagcacccagacatgctggatgagaaggactgcctgaaggaggtgctggagatcgtggagctgggcatcagcggcagcaagagcaagaacaatgagcaggaggtgaagtacaagggggacaaggagcccaacccagcctccatgagggtgaaggatgctgctgaggccaccctgacctgcatcatgcagctgctgggcgccttccccagccccagcggccctgccagcccctgcagcctggtgaatgagaccaccctcatcaagtacagccggctgcccaccatcaacaagcacagcttccgctactttgtgctggacaacagcgtcatcctggccatgctggagcagcccctgggcaatgagcagaatgacttcttccccagcgtgacagtgctggtgcggggcatgagcggccgcctggcctgggcccagcagctgtgcctgctgcccaggggggccaaggccaaccagaagctgtttgtgcctgagcccaggcctgtgcccaagaatgatgtgggcttcaagtacagcgtgaagcaccggcccttccctgaggaggtggacaagatcccctttgtgaaggctgacctgagcatcccagacctgcacgagatcgtgacagaggagctggaggagagacatgagaagctgcggagcggcatggcccagcagatcgcctatgagatccacctggagcagcagagcgaggaggagctgcagaagaggagcttcccagaccctgtgacagactgcaagcccccacctccagcccaggagttccagacagcccggctcttcctgagccacttcggcttcctgagcctggaggccctgaaggagcccgccaacagccggctgcccccccacctgattgccctggacagcaccatccctggcttctttgatgacatcggctacctggacctgctgccctgccggccctttgacaccgtcttcatcttctacatgaagccaggccagaagaccaaccaggagatcctgaagaatgtggagagcagcaggacagtgcagccccacttcctggagttcctgctgagcctgggctggagcgtggatgtgggccgccaccctggctggacaggccacgtgtccacctcctggagcatcaactgctgtgatgatggagagggcagccagcaggaggtgatcagcagcgaggacatcggggccagcatcttcaacggccagaagaaggtgctgtactatgcagatgccctgacagaaattgcctttgtggtgcccagccctgtggagagcctgacagacagcctggagagcaacatcagtgaccaggacagcgacagcaacatggacctgatgcctggcatcctgaagcagcccagcctgaccctggagctgttccccaaccacacagacaacctgaacagcagccagaggctgagccccagcagcaggatgaggaagctgccccagggccggcctgtgccccccctgggccctgagaccagggtgtctgtggtgtgggtggagagatatgatgacatcgagaacttccccctgtctgagctgatgacagagatcagcactggagtggagaccacagccaacagcagcaccagcctgcggagcaccaccctggagaaggaggtgcctgtgatcttcatccaccccctgaacacaggcctcttccgcatcaagatccagggcgccaccgggaagttcaacatggtgatccccctggtggatggcatgattgtgtccagaagagccctgggcttcctggtgcggcagaccgtcatcaacatctgcaggaggaagaggctggagagtgacagctacagccccccccacgtgcggaggaagcagaagatcacagacatcgtgaacaagtacagaaacaagcagctggagcctgagttctacaccagcctcttccaggaggtgggcctgaagaactgcagcagctag

SEQ ID NO: 41741 - DNA, 2892 bp, Artificial Sequence
  Description of Artificial Sequence: Synthetic coding sequence
atgtacagcgagtggaggagcctgcacctggtgatccagaatgaccagggccacacctctgtgctgcacagctacccagagagcgtgggccgggaggtggccaatgctgtggtgcggcccctgggccaggtgctgggcaccccatctgtggccggcagcgagaacctgctgaagacagacaaggaggtgaagtggaccatggaggtgatctgctacggcctgaccctgcccctggatggagagaccgtgaagtactgtgtggatgtgtacacagactggatcatggccctggtgctgcccaaggacagcatccccctgcctgtgatcaaggagcccaaccagtatgtgcagaccatcctgaagcacctgcagaacctgtttgtgccccggcaggagcagggcagcagccagatccggctgtgcctgcaggtgctgcgggccatccagaagctggcccgggagagcagcctgatggcccgggagacctgggaggtgctgctgctcttcctgctgcagatcaatgacatcctgctggccccacccaccgtgcagggcggcattgctgagaacctggccgagaagctgattggagtgctgtttgaggtgtggctgctggcctgcacccgctgcttccccaccccaccctactggaagacagccaaggagatggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagccatcaccacccaggcctccatggagttccggaggaagggcagccagatgagcacagacaccatggtgagcaaccccatgtttgatgccagcgagttcccagacaactatgaagctggccgggcagaggcctgtggcaccctgtgccgcatcttctgcagcaagaagacaggagaggagatcctgcctgcctacctgagccgcttctacatgctgctgatccagggcctgcagatcaatgactatgtgtgccaccctgtgctggccagcgtcatcctgaacagccccccactcttctgctgtgacctgaagggcattgatgtggtggtgccctacttcatcagcgccctggagaccatcctgcctgaccgggagctgagcaagttcaagagctatgtgaaccccacagagctgcggcgcagcagcatcaacatcctgctgagcctgctgcccctgccccaccacttcggcaccgtgaagtctgaggtggtgctggagggcaagttcagcaatgatgacagcagcagctatgacaagcccatcaccttcctgagcctgaagctgcggctggtgaacatcctgattggagccctgcagacagaaacagaccccaacaacacccagatgatcctgggcgccatgctgaacatcgtgcaggacagcgccctgctggaggccatcggctgccagatggagatgggcggcggggagaacaacctgaagagccacagcaggaccaacagcggcatcagcagcgccagcggcggcagcacagagcccaccaccccagattctgagaggcctgcccaggccctgctgcgggactatgccctgaacacagacagcgctgctggcctgctgatccgcagcatccacctggtgacccagaggctgaacagccagtggaggcaggacatgagcatcagcctggccgccctggagctgctgagcggcctggccaaggtgaaggtgatggtggacagcggggacaggaagagggccatcagctctgtgtgcacctacatcgtgtaccagtgcagcaggcctgcccccctgcacagccgggacctgcacagcatgattgtggccgccttccagtgcctgtgtgtgtggctgacagagcacccagacatgctggatgagaaggactgcctgaaggaggtgctggagatcgtggagctgggcatcagcggcagcaagagcaagaacaatgagcaggaggtgaagtacaagggggacaaggagcccaacccagcctccatgagggtgaaggatgctgctgaggccaccctgacctgcatcatgcagctgctgggcgccttccccagccccagcggccctgccagcccctgcagcctggtgaatgagaccaccctcatcaagtacagccggctgcccaccatcaacaagcagctggagcctgagttctacaccagcctcttccaggaggtgggcctgaagaactgcagcagctag

SEQ ID NO: 41742 - DNA, 3822 bp, Artificial Sequence
  Description of Artificial Sequence: Synthetic coding sequence
atggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagccatcaccacccaggcctccatggagttccggaggaagggcagccagatgagcacagacaccatggtgagcaaccccatgtttgatgccagcgagttcccagacaactatgaagctggccgggcagaggcctgtggcaccctgtgccgcatcttctgcagcaagaagacaggagaggagatcctgcctgcctacctgagccgcttctacatgctgctgatccagggcctgcagatcaatgactatgtgtgccaccctgtgctggccagcgtcatcctgaacagccccccactcttctgctgtgacctgaagggcattgatgtggtggtgccctacttcatcagcgccctggagaccatcctgcctgaccgggagctgagcaagttcaagagctatgtgaaccccacagagctgcggcgcagcagcatcaacatcctgctgagcctgctgcccctgccccaccacttcggcaccgtgaagtctgaggtggtgctggagggcaagttcagcaatgatgacagcagcagctatgacaagcccatcaccttcctgagcctgaagctgcggctggtgaacatcctgattggagccctgcagacagaaacagaccccaacaacacccagatgatcctgggcgccatgctgaacatcgtgcaggacagcgccctgctggaggccatcggctgccagatggagatgggcggcggggagaacaacctgaagagccacagcaggaccaacagcggcatcagcagcgccagcggcggcagcacagagcccaccaccccagattctgagaggcctgcccaggccctgctgcgggactatgccctgaacacagacagcgctgctggcctgctgatccgcagcatccacctggtgacccagaggctgaacagccagtggaggcaggacatgagcatcagcctggccgccctggagctgctgagcggcctggccaaggtgaaggtgatggtggacagcggggacaggaagagggccatcagctctgtgtgcacctacatcgtgtaccagtgcagcaggcctgcccccctgcacagccgggacctgcacagcatgattgtggccgccttccagtgcctgtgtgtgtggctgacagagcacccagacatgctggatgagaaggactgcctgaaggaggtgctggagatcgtggagctgggcatcagcggcagcaagagcaagaacaatgagcaggaggtgaagtacaagggggacaaggagcccaacccagcctccatgagggtgaaggatgctgctgaggccaccctgacctgcatcatgcagctgctgggcgccttccccagccccagcggccctgccagcccctgcagcctggtgaatgagaccaccctcatcaagtacagccggctgcccaccatcaacaagcacagcttccgctactttgtgctggacaacagcgtcatcctggccatgctggagcagcccctgggcaatgagcagaatgacttcttccccagcgtgacagtgctggtgcggggcatgagcggccgcctggcctgggcccagcagctgtgcctgctgcccaggggggccaaggccaaccagaagctgtttgtgcctgagcccaggcctgtgcccaagaatgatgtgggcttcaagtacagcgtgaagcaccggcccttccctgaggaggtggacaagatcccctttgtgaaggctgacctgagcatcccagacctgcacgagatcgtgacagaggagctggaggagagacatgagaagctgcggagcggcatggcccagcagatcgcctatgagatccacctggagcagcagagcgaggaggagctgcagaagaggagcttcccagaccctgtgacagactgcaagcccccacctccagcccaggagttccagacagcccggctcttcctgagccacttcggcttcctgagcctggaggccctgaaggagcccgccaacagccggctgcccccccacctgattgccctggacagcaccatccctggcttctttgatgacatcggctacctggacctgctgccctgccggccctttgacaccgtcttcatcttctacatgaagccaggccagaagaccaaccaggagatcctgaagaatgtggagagcagcaggacagtgcagccccacttcctggagttcctgctgagcctgggctggagcgtggatgtgggccgccaccctggctggacaggccacgtgtccacctcctggagcatcaactgctgtgatgatggagagggcagccagcaggaggaggtgatcagcagtgaagatattggagccagcatcttcaacggccagaagaaggtgctgtactatgcagatgccctgacagagatcgcctttgtggtgcccagccctgtggagagcctgacagacagcctggagagcaacatcagtgaccaggacagcgacagcaacatggacctgatgcctggcatcctgaagcagcccagcctgaccctggagctgttccccaaccacacagacaacctgaacagcagccagaggctgagccccagcagcaggatgaggaagctgccccagggccggcctgtgccccccctgggccctgagaccagggtgtctgtggtgtgggtggagagatatgatgacatcgagaacttccccctgtctgagctgatgacagagatcagcactggagtggagaccacagccaacagcagcaccagcctgcggagcaccaccctggagaaggaggtgcctgtgatcttcatccaccccctgaacacaggcctcttccgcatcaagatccagggcgccaccgggaagttcaacatggtgatccccctggtggatggcatgattgtgtcccggcgggccctgggcttcctggtgcggcagaccgtcatcaacatctgcaggaggaagaggctggagagtgacagctacagcccccctcatgtgcggaggaagcagaagatcacagacatcgtgaacaagtacagaaacaagcagctggagcctgagttctacaccagcctcttccaggaggtgggcctgaagaactgcagcagctag

SEQ ID NO: 41743 - DNA, 4485 bp, Artificial Sequence; identical to SEQ ID NO: 41740
  Description of Artificial Sequence: Synthetic coding sequence

SEQ ID NO: 41744 - DNA, 4476 bp, Artificial Sequence
  Description of Artificial Sequence: Synthetic coding sequence
atgtacagcgagtggaggagcctgcacctggtgatccagaatgaccagggccacacctctgtgctgcacagctacccagagagcgtgggccgggaggtggccaatgctgtggtgcggcccctgggccaggtgctgggcaccccatctgtggccggcagcgagaacctgctgaagacagacaaggaggtgaagtggaccatggaggtgatctgctacggcctgaccctgcccctggatggagagaccgtgaagtactgtgtggatgtgtacacagactggatcatggccctggtgctgcccaaggacagcatccccctgcctgtgatcaaggagcccaaccagtatgtgcagaccatcctgaagcacctgcagaacctgtttgtgccccggcaggagcagggcagcagccagatccggctgtgcctgcaggtgctgcgggccatccagaagctggcccgggagagcagcctgatggcccgggagacctgggaggtgctgctgctcttcctgctgcagatcaatgacatcctgctggccccacccaccgtgcagggcggcattgctgagaacctggccgagaagctgattggagtgctgtttgaggtgtggctgctggcctgcacccgctgcttccccaccccaccctactggaagacagccaaggagatggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagccatcaccacccaggcctccatggagttccggaggaagggcagccagatgagcacagacaccatggtgagcaaccccatgtttgatgccagcgagttcccagacaactatgaagctggccgggcagaggcctgtggcaccctgtgccgcatcttctgcagcaagaagacaggagaggagatcctgcctgcctacctgagccgcttctacatgctgctgatccagggcctgcagatcaatgactatgtgtgccaccctgtgctggccagcgtcatcctgaacagccccccactcttctgctgtgacctgaagggcattgatgtggtggtgccctacttcatcagcgccctggagaccatcctgcctgaccgggagctgagcaagttcaagagctatgtgaaccccacagagctgcggcgcagcagcatcaacatcctgctgagcctgctgcccctgccccaccacttcggcaccgtgaagtctgaggtggtgctggagggcaagttcagcaatgatgacagcagcagctatgacaagcccatcaccttcctgagcctgaagctgcggctggtgaacatcctgattggagccctgcagacagaaacagaccccaacaacacccagatgatcctgggcgccatgctgaacatcgtgcaggacagcgccctgctggaggccatcggctgccagatggagatgggcggcggggagaacaacctgaagagccacagcaggaccaacagcggcatcagcagcgccagcggcggcagcacagagcccaccaccccagattctgagaggcctgcccaggccctgctgcgggactatgacagcgctgctggcctgctgatccgcagcatccacctggtgacccagaggctgaacagccagtggaggcaggacatgagcatcagcctggccgccctggagctgctgagcggcctggccaaggtgaaggtgatggtggacagcggggacaggaagagggccatcagctctgtgtgcacctacatcgtgtaccagtgcagcaggcctgcccccctgcacagccgggacctgcacagcatgattgtggccgccttccagtgcctgtgtgtgtggctgacagagcacccagacatgctggatgagaaggactgcctgaaggaggtgctggagatcgtggagctgggcatcagcggcagcaagagcaagaacaatgagcaggaggtgaagtacaagggggacaaggagcccaacccagcctccatgagggtgaaggatgctgctgaggccaccctgacctgcatcatgcagctgctgggcgccttccccagccccagcggccctgccagcccctgcagcctggtgaatgagaccaccctcatcaagtacagccggctgcccaccatcaacaagcacagcttccgctactttgtgctggacaacagcgtcatcctggccatgctggagcagcccctgggcaatgagcagaatgacttcttccccagcgtgacagtgctggtgcggggcatgagcggccgcctggcctgggcccagcagctgtgcctgctgcccaggggggccaaggccaaccagaagctgtttgtgcctgagcccaggcctgtgcccaagaatgatgtgggcttcaagtacagcgtgaagcaccggcccttccctgaggaggtggacaagatcccctttgtgaaggctgacctgagcatcccagacctgcacgagatcgtgacagaggagctggaggagagacatgagaagctgcggagcggcatggcccagcagatcgcctatgagatccacctggagcagcagagcgaggaggagctgcagaagaggagcttcccagaccctgtgacagactgcaagcccccacctccagcccaggagttccagacagcccggctcttcctgagccacttcggcttcctgagcctggaggccctgaaggagcccgccaacagccggctgcccccccacctgattgccctggacagcaccatccctggcttctttgatgacatcggctacctggacctgctgccctgccggccctttgacaccgtcttcatcttctacatgaagccaggccagaagaccaaccaggagatcctgaagaatgtggagagcagcaggacagtgcagccccacttcctggagttcctgctgagcctgggctggagcgtggatgtgggccgccaccctggctggacaggccacgtgtccacctcctggagcatcaactgctgtgatgatggagagggcagccagcaggaggaggtgatcagcagtgaagatattggagccagcatcttcaacggccagaagaaggtgctgtactatgcagatgccctgacagagatcgcctttgtggtgcccagccctgtggagagcctgacagacagcctggagagcaacatcagtgaccaggacagcgacagcaacatggacctgatgcctggcatcctgaagcagcccagcctgaccctggagctgttccccaaccacacagacaacctgaacagcagccagaggctgagccccagcagcaggatgaggaagctgccccagggccggcctgtgccccccctgggccctgagaccagggtgtctgtggtgtgggtggagagatatgatgacatcgagaacttccccctgtctgagctgatgacagagatcagcactggagtggagaccacagccaacagcagcaccagcctgcggagcaccaccctggagaaggaggtgcctgtgatcttcatccaccccctgaacacaggcctcttccgcatcaagatccagggcgccaccgggaagttcaacatggtgatccccctggtggatggcatgattgtgtcccggcgggccctgggcttcctggtgcggcagaccgtcatcaacatctgcaggaggaagaggctggagagtgacagctacagcccccctcatgtgcggaggaagcagaagatcacagacatcgtgaacaagtacagaaacaagcagctggagcctgagttctacaccagcctcttccaggaggtgggcctgaagaactgcagcagctag

SEQ ID NO: 41745 - DNA, 3972 bp, Artificial Sequence
  Description of Artificial Sequence: Synthetic coding sequence
atcaatgacatcctgctggccccacccaccgtgcagggcggcattgctgagaacctggccgagaagctgattggagtgctgtttgaggtgtggctgctggcctgcacccgctgcttccccaccccaccctactggaagacagccaaggagatggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagccatcaccacccaggcctccatggagttccggaggaagggcagccagatgagcacagacaccatggtgagcaaccccatgtttgatgccagcgagttcccagacaactatgaagctggccgggcagaggcctgtggcaccctgtgccgcatcttctgcagcaagaagacaggagaggagatcctgcctgcctacctgagccgcttctacatgctgctgatccagggcctgcagatcaatgactatgtgtgccaccctgtgctggccagcgtcatcctgaacagccccccactcttctgctgtgacctgaagggcattgatgtggtggtgccctacttcatcagcgccctggagaccatcctgcctgaccgggagctgagcaagttcaagagctatgtgaaccccacagagctgcggcgcagcagcatcaacatcctgctgagcctgctgcccctgccccaccacttcggcaccgtgaagtctgaggtggtgctggagggcaagttcagcaatgatgacagcagcagctatgacaagcccatcaccttcctgagcctgaagctgcggctggtgaacatcctgattggagccctgcagacagaaacagaccccaacaacacccagatgatcctgggcgccatgctgaacatcgtgcaggacagcgccctgctggaggccatcggctgccagatggagatgggcggcggggagaacaacctgaagagccacagcaggaccaacagcggcatcagcagcgccagcggcggcagcacagagcccaccaccccagattctgagaggcctgcccaggccctgctgcgggactatgccctgaacacagacagcgctgctggcctgctgatccgcagcatccacctggtgacccagaggctgaacagccagtggaggcaggacatgagcatcagcctggccgccctggagctgctgagcggcctggccaaggtgaaggtgatggtggacagcggggacaggaagagggccatcagctctgtgtgcacctacatcgtgtaccagtgcagcaggcctgcccccctgcacagccgggacctgcacagcatgattgtggccgccttccagtgcctgtgtgtgtggctgacagagcacccagacatgctggatgagaaggactgcctgaaggaggtgctggagatcgtggagctgggcatcagcggcagcaagagcaagaacaatgagcaggaggtgaagtacaagggggacaaggagcccaacccagcctccatgagggtgaaggatgctgctgaggccaccctgacctgcatcatgcagctgctgggcgccttccccagccccagcggccctgccagcccctgcagcctggtgaatgagaccaccctcatcaagtacagccggctgcccaccatcaacaagcacagcttccgctactttgtgctggacaacagcgtcatcctggccatgctggagcagcccctgggcaatgagcagaatgacttcttccccagcgtgacagtgctggtgcggggcatgagcggccgcctggcctgggcccagcagctgtgcctgctgcccaggggggccaaggccaaccagaagctgtttgtgcctgagcccaggcctgtgcccaagaatgatgtgggcttcaagtacagcgtgaagcaccggcccttccctgaggaggtggacaagatcccctttgtgaaggctgacctgagcatcccagacctgcacgagatcgtgacagaggagctggaggagagacatgagaagctgcggagcggcatggcccagcagatcgcctatgagatccacctggagcagcagagcgaggaggagctgcagaagaggagcttcccagaccctgtgacagactgcaagcccccacctccagcccaggagttccagacagcccggctcttcctgagccacttcggcttcctgagcctggaggccctgaaggagcccgccaacagccggctgcccccccacctgattgccctggacagcaccatccctggcttctttgatgacatcggctacctggacctgctgccctgccggccctttgacaccgtcttcatcttctacatgaagccaggccagaagaccaaccaggagatcctgaagaatgtggagagcagcaggacagtgcagccccacttcctggagttcctgctgagcctgggctggagcgtggatgtgggccgccaccctggctggacaggccacgtgtccacctcctggagcatcaactgctgtgatgatggagagggcagccagcaggaggaggtgatcagcagtgaagatattggagccagcatcttcaacggccagaagaaggtgctgtactatgcagatgccctgacagagatcgcctttgtggtgcccagccctgtggagagcctgacagacagcctggagagcaacatcagtgaccaggacagcgacagcaacatggacctgatgcctggcatcctgaagcagcccagcctgaccctggagctgttccccaaccacacagacaacctgaacagcagccagaggctgagccccagcagcaggatgaggaagctgccccagggccggcctgtgccccccctgggccctgagaccagggtgtctgtggtgtgggtggagagatatgatgacatcgagaacttccccctgtctgagctgatgacagagatcagcactggagtggagaccacagccaacagcagcaccagcctgcggagcaccaccctggagaaggaggtgcctgtgatcttcatccaccccctgaacacaggcctcttccgcatcaagatccagggcgccaccgggaagttcaacatggtgatccccctggtggatggcatgattgtgtcccggcgggccctgggcttcctggtgcggcagaccgtcatcaacatctgcaggaggaagaggctggagagtgacagctacagcccccctcatgtgcggaggaagcagaagatcacagacatcgtgaacaagtacagaaacaagcagctggagcctgagttctacaccagcctcttccaggaggtgggcctgaagaactgcagcagctag

SEQ ID NO: 41746 - DNA, 1434 bp, Artificial Sequence
  Description of Artificial Sequence: Synthetic coding sequence
atgtacagcgagtggaggagcctgcacctggtgatccagaatgaccagggccacacctctgtgctgcacagctacccagagagcgtgggccgggaggtggccaatgctgtggtgcggcccctgggccaggtgctgggcaccccatctgtggccggcagcgagaacctgctgaagacagacaaggaggtgaagtggaccatggaggtgatctgctacggcctgaccctgcccctggatggagagaccgtgaagtactgtgtggatgtgtacacagactggatcatggccctggtgctgcccaaggacagcatccccctgcctgtgatcaaggagcccaaccagtatgtgcagaccatcctgaagcacctgcagaacctgtttgtgccccggcaggagcagggcagcagccagatccggctgtgcctgcaggtgctgcgggccatccagaagctggcccgggagagcagcctgatggcccgggagacctgggaggtgctgctgctcttcctgctgcagatcaatgacatcctgctggccccacccaccgtgcagggcggcattgctgagaacctggccgagaagctgattggagtgctgtttgaggtgtggctgctggcctgcacccgctgcttccccaccccaccctactggaagacagccaaggagatggtggccaactggaggcaccaccctgctgtggtggagcagtggagcaaggtgatctgtgccctgaccagccggctgctgcgcttcacctacggccccagcttccctgccttcaaggtgcctgatgaagatgccagcctcatccccccagagatggacaatgaatgtgtggcccagacctggttccgcttcctgcacatgctgagcaaccctgtggacctgagcaacccagccatcatcagcagcacccccaagttccaggagcagttcctgaatgtgtctggcatgccccaggagctgaaccagtacccctgcctgaagcacctgccccagatcttcttccgggccatgaggggcatcagctgcctggtggatgccttcctgggcatcagccggcccaggagtgacagcgccccacccacccctgtgaaccggctgtccatgccccagagcgctgctgtgtccaccaccccaccccacaacagaagacacagagctgtgacagtgaacaaggccaccatgaagaccagcacagtgtccacagcccacgccagcaaggtgcagcaccagaccagcagcaccagccccctgagcagccccaaccagaccagcagcgagccccggcccctgcctgccccccggcggcccaaggtgaacagcatcctgaacctgtttggctcctggctgtttgatgctgcctttgtgcactgcaagctgcacaacggcatcaacagagacagctccatgacagacttcacctgcttctag

SEQ ID NO: 41747 - DNA, 2334 bp, Artificial Sequence
  Description of Artificial Sequence: Synthetic coding sequence
atgctgccccggcccctgcggctgctgctggacaccagccccccaggaggagtggtgctgagcagcttccgcagccgggaccctgaggagggcggcggccctgggggcctggtggtgggcggcggccaggaggaggaggaggaggaggaggaggaggcccctgtgtctgtgtgggatgaggaggaggatggagctgtgttcaccgtgaccagccggcagtaccggcccctggaccccctggtgcccatgcccccacccaggagcagccggcggctgcgggccggcaccctggaggccctggtgcgccacctgctggacaccaggaccagcggcacagatgtgtccttcatgtctgccttcctggccacccaccgggccttcaccagcaccccagccctgctgggcctgatggctgaccggctggaggccctggagagccaccccacagatgagctggagaggaccacagaggtggccatctctgtgctgagcacctggctggccagccaccctgaggactttggcagcgaggccaagggccagctggaccggctggagagcttcctgctgcagacaggctatgctgctgggaagggcgtgggcggcggcagcgctgacctgatccggaacctgcggagccgggtggacccccaggccccagacctgcccaagcccctggccctgcccggggaccccccagctgaccccacagatgtgctggtgttcctggccgaccacctggccgagcagctgaccctgctggatgctgagctgttcctgaacctgatccccagccagtgcctgggcggcctgtggggccaccgggaccggcccggccacagccacctgtgccccagcgtgcgggccaccgtgacccagttcaacaaggtggccggggctgtggtgtcctctgtgctgggcgccaccagcactggagagggccctggagaggtgaccatccggcccctgcggcccccccagagggcccggctgctggagaagtggatccgggtggccgaggagtgccgcctgctgaggaacttcagctctgtgtatgctgtggtgtctgccctgcagagcagccccatccaccggctgcgggccgcctggggcgaggccacccgggacagcctgcgggtcttcagcagcctgtgccagatcttcagcgaggaggacaactacagccagagccgggagctgctggtgcaggaggtgaagctgcagagccccctggagccccacagcaagaaggcccccaggagcggcagcagaggaggaggagtggtgccctacctgggcaccttcctgaaggacctggtgatgctggatgctgccagcaaggatgagctggagaatggctacatcaactttgacaagaggaggaaggagtttgctgtgctgtctgagctgcggcggctgcagaatgaatgtcggggctacaacctgcagcctgaccatgacatccagcgctggctgcagggcctgcggcccctgacagaggcccagagccaccgggtgtcctgtgaggtggagcccccaggcagcagtgaccccccagccccccgggtgctgcggcccaccctggtgatcagccagtggacagaggtgctgggctctgtgggcgtgcccacccccctggtgtcctgtgaccggcccagcactggaggagatgaggcccccaccaccccagcccccctgctgacccggctggcccagcacatgaagtggcccagcgtgagcagcctggacagcgccctggagagcagccccagcctgcacagccctgctgaccccagccacctgagccccccagccagcagcccccggcccagccggggccacagaagaagtgccagctgtggcagccccctgtctggaggagctgaggaggccagcggcggcaccggctatggaggagagggcagcggccctggggccagtgactgccgcatcatccgggtgcagatggagctgggggaggatggctctgtgtacaagagcatcctggtgaccagccaggacaaggcccccagcgtcatcagccgggtgctgaagaagaacaacagagattctgctgtggcctctgaatatgagctggtgcagctgctgcccggggagcgggagctgaccatcccagccagcgccaacgtgttctacgccatggatggagccagccatgacttcctgctgcggcagaggcggcgcagcagcacagccaccccaggagtgaccagcggccccagcgccagcggcaccccaccttctgagggcggcggcggcagcttcccccgcatcaaggccaccggcaggaagatcgcccgggccctcttctag

SEQ ID NO: 41748 - DNA, 441 bp, Artificial Sequence
  Description of Artificial Sequence: Synthetic coding sequence
atgctgccccggcccctgcggctgctgctggacaccagccccccaggaggagtggtgctgagcagcttccgcagccgggaccctgaggagggcggcggccctgggggcctggtggtgggcggcggccaggaggaggaggaggaggaggaggaggaggcccctgtgtctgtgtgggatgaggaggaggatggagctgtgttcaccgtgaccagccggcagtaccggcccctggaccccctggtgcccatgcccccacccaggagcagccggcggctgcgggccggcaccctggaggccctggtgcgccacctgctggacaccaggaccagcggcacagatgtgtccttcatgtctgccttcctggccacccaccgggccttcaccagcaccccagccctgctgggcctgatggctgaccggctggaggccctggagagctag

SEQ ID NO: 41749 - DNA, 2334 bp, Artificial Sequence; identical to SEQ ID NO: 41747
  Description of Artificial Sequence: Synthetic coding sequence

SEQ ID NO: 41750 - DNA, 2334 bp, Artificial Sequence; identical to SEQ ID NO: 41747
  Description of Artificial Sequence: Synthetic coding sequence

SEQ ID NO: 41751 - DNA, 1977 bp, Artificial Sequence
  Description of Artificial Sequence: Synthetic coding sequence
atggctgaccggctggaggccctggagagccaccccacagatgagctggagaggaccacagaggtggccatctctgtgctgagcacctggctggccagccaccctgaggactttggcagcgaggccaagggccagctggaccggctggagagcttcctgctgcagacaggctatgctgctgggaagggcgtgggcggcggcagcgctgacctgatccggaacctgcggagccgggtggacccccaggccccagacctgcccaagcccctggccctgcccggggaccccccagctgaccccacagatgtgctggtgttcctggccgaccacctggccgagcagctgaccctgctggatgctgagctgttcctgaacctgatccccagccagtgcctgggcggcctgtggggccaccgggaccggcccggccacagccacctgtgccccagcgtgcgggccaccgtgacccagttcaacaaggtggccggggctgtggtgtcctctgtgctgggcgccaccagcactggagagggccctggagaggtgaccatccggcccctgcggcccccccagagggcccggctgctggagaagtggatccgggtggccgaggagtgccgcctgctgaggaacttcagctctgtgtatgctgtggtgtctgccctgcagagcagccccatccaccggctgcgggccgcctggggcgaggccacccgggacagcctgcgggtcttcagcagcctgtgccagatcttcagcgaggaggacaactacagccagagccgggagctgctggtgcaggaggtgaagctgcagagccccctggagccccacagcaagaaggcccccaggagcggcagcagaggaggaggagtggtgccctacctgggcaccttcctgaaggacctggtgatgctggatgctgccagcaaggatgagctggagaatggctacatcaactttgacaagaggaggaaggagtttgctgtgctgtctgagctgcggcggctgcagaatgaatgtcggggctacaacctgcagcctgaccatgacatccagcgctggctgcagggcctgcggcccctgacagaggcccagagccaccgggtgtcctgtgaggtggagcccccaggcagcagtgaccccccagccccccgggtgctgcggcccaccctggtgatcagccagtggacagaggtgctgggctctgtgggcgtgcccacccccctggtgtcctgtgaccggcccagcactggaggagatgaggcccccaccaccccagcccccctgctgacccggctggcccagcacatgaagtggcccagcgtgagcagcctggacagcgccctggagagcagccccagcctgcacagccctgctgaccccagccacctgagccccccagccagcagcccccggcccagccggggccacagaagaagtgccagctgtggcagccccctgtctggaggagctgaggaggccagcggcggcaccggctatggaggagagggcagcggccctggggccagtgactgccgcatcatccgggtgcagatggagctgggggaggatggctctgtgtacaagagcatcctggtgaccagccaggacaaggcccccagcgtcatcagccgggtgctgaagaagaacaacagagattctgctgtggcctctgaatatgagctggtgcagctgctgcccggggagcgggagctgaccatcccagccagcgccaacgtgttctacgccatggatggagccagccatgacttcctgctgcggggggagggccccctgctgctgcacctggccagccctgtggcccggctgccccaggagctgctgcgggtgcgggaggagggcgcccccttccctggcagccggccccagggcggccgcctgcacggccactgcagcgaggaggaggcccccctggcctaccgcagccatggagtgcacacccgctgtggctag

SEQ ID NO: 41752 - DNA, 441 bp, Artificial Sequence; identical to SEQ ID NO: 41748
  Description of Artificial Sequence: Synthetic coding sequence

SEQ ID NO: 41753 - DNA, 441 bp, Artificial Sequence; identical to SEQ ID NO: 41748
  Description of Artificial Sequence: Synthetic coding sequence

SEQ ID NO: 41754 - DNA, 1383 bp, Artificial Sequence
  Description of Artificial Sequence: Synthetic coding sequence
atgcccccacccaggagcagccggcggctgcgggccggcaccctggaggccctggtgcgccacctgctggacaccaggaccagcggcacagatgtgtccttcatgtctgccttcctggccacccaccgggccttcaccagcaccccagccctgctgggcctgatggctgaccggctggaggccctggagagccaccccacagatgagctggagaggaccacagaggtggccatctctgtgctgagcacctggctggccagccaccctgaggactttggcagcgaggccaagggccagctggaccggctggagagcttcctgctgcagacaggctatgctgctgggaagggcgtgggcggcggcagcgctgacctgatccggaacctgcggagccgggtggacccccaggccccagacctgcccaagcccctggccctgcccggggaccccccagctgaccccacagatgtgctggtgttcctggccgaccacctggccgagcagctgaccctgctggatgctgagctgttcctgaacctgatccccagccagtgcctgggcggcctgtggggccaccgggaccggcccggccacagccacctgtgccccagcgtgcgggccaccgtgacccagttcaacaaggtggccggggctgtggtgtcctctgtgctgggcgccaccagcactggagagggccctggagaggtgaccatccggcccctgcggcccccccagagggcccggctgctggagaagtggatccgggtggccgaggagtgccgcctgctgaggaacttcagctctgtgtatgctgtggtgtctgccctgcagagcagccccatccaccggctgcgggccgcctggggcgaggccacccgggacagcctgcgggtcttcagcagcctgtgccagatcttcagcgaggaggacaactacagccagagccgggagctgctggtgcaggaggtgaagctgcagagccccctggagccccacagcaagaaggcccccaggagcggcagcagaggaggaggagtggtgccctacctgggcaccttcctgaaggacctggtgatgctggatgctgccagcaaggatgagctggagaatggctacatcaactttgacaagaggaggaaggtgtctggagtgtctggcctggatgctggcctgccctacccctgcagcaggaagggccggggcaagagccagggcagcctgagctttggcagctgcagcctgcgggcccccagccaggagtttgctgtgctgtctgagctgcggcggctgcagaatgaatgtcggggctacaacctgcagcctgaccatgacatccagcgctggctgcagggcctgcggcccctgacagaggcccagaggtag

SEQ ID NO: 41755 - DNA, 441 bp, Artificial Sequence; identical to SEQ ID NO: 41748
  Description of Artificial Sequence: Synthetic coding sequence

SEQ ID NO: 41756 - DNA, 2334 bp, Artificial Sequence; identical to SEQ ID NO: 41747
  Description of Artificial Sequence: Synthetic coding sequence

SEQ ID NO: 41757 - DNA, 441 bp, Artificial Sequence; identical to SEQ ID NO: 41748
  Description of Artificial Sequence: Synthetic coding sequence

SEQ ID NO: 41758 - DNA, 2334 bp, Artificial Sequence; identical to SEQ ID NO: 41747
  Description of Artificial Sequence: Synthetic coding sequence

SEQ ID NO: 41759 - DNA, 1383 bp, Artificial Sequence; identical to SEQ ID NO: 41754
  Description of Artificial Sequence: Synthetic coding sequence

SEQ ID NO: 41760 - DNA, 1977 bp, Artificial Sequence; identical to SEQ ID NO: 41751
  Description of Artificial Sequence: Synthetic coding sequence

SEQ ID NO: 41761 - DNA, 1977 bp, Artificial Sequence; identical to SEQ ID NO: 41751
  Description of Artificial Sequence: Synthetic coding sequence

SEQ ID NO: 41762 - DNA, 1977 bp, Artificial Sequence; identical to SEQ ID NO: 41751
  Description of Artificial Sequence: Synthetic coding sequence

SEQ ID NO: 41763 - DNA, 1977 bp, Artificial Sequence; identical to SEQ ID NO: 41751
  Description of Artificial Sequence: Synthetic coding sequence

SEQ ID NO: 41764 - DNA, 1383 bp, Artificial Sequence; identical to SEQ ID NO: 41754
  Description of Artificial Sequence: Synthetic coding sequence

SEQ ID NO: 41765 - DNA, 1383 bp, Artificial Sequence; identical to SEQ ID NO: 41754
  Description of Artificial Sequence: Synthetic coding sequence

SEQ ID NO: 41766 - DNA, 1383 bp, Artificial Sequence; identical to SEQ ID NO: 41754
  Description of Artificial Sequence: Synthetic coding sequence

SEQ ID NO: 41767 - DNA, 1494 bp, Artificial Sequence
  Description of Artificial Sequence: Synthetic coding sequence
gcccgggccggcagaggagctgccagcggccccccccgggtggcccagaccagtgaccctgacagcagcgaggcctgtgccgaggaggaggagggcctgatgccccagggcccccagctgctggacttctctgtggatgaggtggccgagcagctgaccctgattgacctggagctgttcagcaaggtgcggctgtatgaatgtctgggctctgtgtggagccagagggacaggcctggagctgctggggccagccccaccgtgcgggccaccgtggcccagttcaacacagtgacaggctgtgtgctgggctctgtgctgggcgcccctggcctggccgccccccagagggcccagaggctggagaagtggatcagaattgcccagcgctgccgggagctgaggaacttcagcagcctgcgggccatcctgagcgccctgcagagcaaccccatctaccgcctgaagaggtcctggggcgctgtgtcccgggagcccctgagcaccttcaggaagctgagccagatcttcagtgatgagaacaaccacctgagcagccgggagatcctcttccaggaggaggccacagagggcagccaggaggaggacaacaccccaggcagcctgcccagcaagcccccacctggccctgtgccctacctgggcaccttcctgacagacctggtgatgctggacacagccctgcctgacatgctggagggggacctgatcaactttgagaagaggaggaaggagtgggagatcctggcccgcatccagcagctgcagaggcgctgccagagctacaccctgagcccccacccccccatcctggccgccctgcacgcccagaaccagctgacagaggagcagagctaccgcctgagccgggtgattgagcccccagctgccagctgccccagcagcccccgcatcagaagacgcatcagcctgaccaagaggctgagcgccaagctggcccgggagaagagcagcagccccagcggcagccctggggaccccagcagccccaccagctctgtgtccccaggcagcccccccagcagccccaggagcagagatgccccagctggcagccccccagccagccctggcccccagggccccagcaccaagctgcccctgagcctggacctgcccagcccccggccctttgccctgcccctgggcagcccccgcatccccctgcctgcccagcagagcagcgaggcccgggtcatccgggtgtccattgacaatgaccacggcaacctgtaccgcagcatcctgctgaccagccaggacaaggcccccagcgtggtgcggcgggccctgcagaagcacaacgtgccccagccctgggcctgtgactaccagctgttccaggtgctgcccggggaccggggctgggaggagatgctgatcagcgccatcaagtctgtgggcaccttcttcggcatgtttgccatgtgccaggcccgcttctacagatag

SEQ ID NO: 41768 - DNA, 2133 bp, Artificial Sequence
  Description of Artificial Sequence: Synthetic coding sequence
atggagaggacagctgggaaggagctggccctggcccccctgcaggactggggcgaggagacagaagatggagctgtgtacagcgtgtccctgcggcggcagaggagccagaggaggagccctgctgagggccctgggggcagccaggcccccagccccatcgccaacaccttcctgcactaccgcaccagcaaggtgcgggtgctgcgggccgcccggctggagcggctggtgggggagctggtgtttggagaccgggagcaggaccccagcttcatgcctgccttcctggccacctaccgcacctttgtgcccacagcctgcctgctgggcttcctgctgccccccatgcctcctcctcctcctcctggggtggagatcaagaagacagctgtgcaggacctgtccttcaacaagaacctgcgggctgtggtgtctgtgctgggctcctggctgcaggaccacccccaggacttccgggaccccccagcccacagcgacctgggctctgtgaggaccttcctgggctgggccgcccctggcagcgctgaggcccagaaggccgagaagctgctggaggacttcctggaggaggccgagcgggagcaggaggaggagcccccccaggtgtggacaggccccccccgggtggcccagaccagtgaccctgacagcagcgaggcctgtgccgaggaggaggagggcctgatgccccagggcccccagctgctggacttctctgtggatgaggtggccgagcagctgaccctgattgacctggagctgttcagcaaggtgcggctgtatgagtgcctgggctctgtgtggagccagagggacaggcctggagctgctggggccagccccaccgtgcgggccaccgtggcccagttcaacacagtgacaggctgtgtgctgggctctgtgctgggcgcccctggcctggccgccccccagagggcccagaggctggagaagtggatccgcatcgcccagcgctgccgggagctgaggaacttcagcagcctgcgggccatcctgagcgccctgcagagcaaccccatctaccgcctgaagaggtcctggggcgctgtgtcccgggagcccctgagcaccttcaggaagctgagccagatcttcagtgatgagaacaaccacctgagcagccgggagatcctcttccaggaggaggccacagagggcagccaggaggaggacaacaccccaggcagcctgcccagcaagcccccacctggccctgtgccctacctgggcaccttcctgacagacctggtgatgctggacacagccctgcctgacatgctggagggggacctgatcaactttgagaagaggaggaaggagtgggagatcctggcccgcatccagcagctgcagaggcgctgccagagctacaccctgagcccccacccccccatcctggccgccctgcacgcccagaaccagctgacagaggagcagagctaccgcctgagcagggtcatcgagcccccagctgccagctgccccagcagcccccgcatcagaagacgcatcagcctgaccaagaggctgagcgccaagctggcccgggagaagagcagcagccccagcggcagccctggggaccccagcagccccaccagctctgtgtccccaggcagcccccccagcagccccaggagcagagatgccccagctggcagccccccagccagccctggcccccagggccccagcaccaagctgcccctgagcctggacctgcccagcccccggccctttgccctgcccctgggcagcccccgcatccccctgcctgcccagcagagcagcgaggcccgggtcatccgggtgtccattgacaatgaccacggcaacctgtaccgcagcatcctgctgaccagccaggacaaggcccccagcgtggtgagaagagccctgcagaagcacaacgtgccccagccctgggcctgtgactaccagctgttccaggtgctgcccggggacagagtgctgctgatcccagacaatgccaacgtgttctacgccatgagccctgtggccccccgggacttcatgctgcggaggaaggagggcaccaggaacaccctgtctgtgagccccagctag

SEQ ID NO: 41769 - DNA, 2151 bp, Artificial Sequence
  Description of Artificial Sequence: Synthetic coding sequence
atggagaggacagctgggaaggagctggccctggcccccctgcaggactggggcgaggagacagaagatggagctgtgtacagcgtgtccctgcggcggcagaggagccagaggaggagccctgctgagggccctgggggcagccaggcccccagccccatcgccaacaccttcctgcactaccgcaccagcaaggtgcgggtgctgcgggccgcccggctggagcggctggtgggggagctggtgtttggagaccgggagcaggaccccagcttcatgcctgccttcctggccacctaccgcacctttgtgcccacagcctgcctgctgggcttcctgctgccccccatgcctcctcctcctcctcctggggtggagatcaagaagacagctgtgcaggacctgtccttcaacaagaacctgcgggctgtggtgtctgtgctgggctcctggctgcaggaccacccccaggacttccgggaccccccagcccacagcgacctgggctctgtgaggaccttcctgggctgggccgcccctggcagcgctgaggcccagaaggccgagaagctgctggaggacttcctggaggaggccgagcgggagcaggaggaggagcccccccaggtgtggacaggccccccccgggtggcccagaccagtgaccctgacagcagcgaggcctgtgccgaggaggaggagggcctgatgccccagggcccccagctgctggacttctctgtggatgaggtggccgagcagctgaccctgattgacctggagctgttcagcaaggtgcggctgtatgagtgcctgggctctgtgtggagccagagggacaggcctggagctgctggggccagccccaccgtgcgggccaccgtggcccagttcaacacagtgacaggctgtgtgctgggctctgtgctgggcgcccctggcctggccgccccccagagggcccagaggctggagaagtggatccgcatcgcccagcgctgccgggagctgaggaacttcagcagcctgcgggccatcctgagcgccctgcagagcaaccccatctaccgcctgaagaggtcctggggcgctgtgtcccgggagcccctgagcaccttcaggaagctgagccagatcttcagtgatgagaacaaccacctgagcagccgggagatcctcttccaggaggaggccacagagggcagccaggaggaggacaacaccccaggcagcctgcccagcaagcccccacctggccctgtgccctacctgggcaccttcctgacagacctggtgatgctggacacagccctgcctgacatgctggagggggacctgatcaactttgagaagaggaggaaggagtgggagatcctggcccgcatccagcagctgcagaggcgctgccagagctacaccctgagcccccacccccccatcctggccgccctgcacgcccagaaccagctgacagaggagcagagctaccgcctgagcagggtcatcgagcccccagctgccagctgccccagcagcccccgcatcagaagacgcatcagcctgaccaagaggctgagcgccaagctggcccgggagaagagcagcagccccagcggcagccctggggaccccagcagccccaccagcagcctgtgcatcagccccagcgtgtccccaggcagcccccccagcagccccaggagcagagatgccccagctggcagccccccagccagccctggcccccagggccccagcaccaagctgcccctgagcctggacctgcccagcccccggccctttgccctgcccctgggcagcccccgcatccccctgcctgcccagcagagcagcgaggcccgggtcatccgggtgtccattgacaatgaccacggcaacctgtaccgcagcatcctgctgaccagccaggacaaggcccccagcgtggtgagaagagccctgcagaagcacaacgtgccccagccctgggcctgtgactaccagctgttccaggtgctgcccggggacagagtgctgctgatcccagacaatgccaacgtgttctacgccatgagccctgtggccccccgggacttcatgctgcggaggaaggagggcaccaggaacaccctgtctgtgagccccagctag

SEQ ID NO: 41770 - DNA, 813 bp, Artificial Sequence
  Description of Artificial Sequence: Synthetic coding sequence
atggagaggacagctgggaaggagctggccctggcccccctgcaggactggggcgaggagacagaagatggagctgtgtacagcgtgtccctgcggcggcagaggagccagaggaggagccctgctgagggccctgggggcagccaggcccccagccccatcgccaacaccttcctgcactaccgcaccagcaaggtgcgggtgctgcgggccgcccggctggagcggctggtgggggagctggtgtttggagaccgggagcaggaccccagcttcatgcctgccttcctggccacctaccgcacctttgtgcccacagcctgcctgctgggcttcctgctgccccccatgcctcctcctcctcctcctggggtggagatcaagaagacagctgtgcaggacctgtccttcaacaagaacctgcggctcttccggggcctgcggggcggccggggccgggcccacgccagccgcagccctgcccctggcctgcagaggggccggggcggccgggctgctgacccccaccggctgggcgccctgctgcagggcgaggccctgcgggtgctgggcctgcgggtggtggccgagggccctgctgggggctgccggcggctgccccactgtgcccggcaccggggccctgtgcagcaccgggaccggctgtgtgccggcttccgggcccggagcacaggcctgggccggcctgctgagggcgctgctgctggggaggtggacccccacaggcctgccctgcccaggacagctgagctgctgctgctggcccggcaccctgtgcggcctgccatctag

SEQ ID NO: 41771 - DNA, 258 bp, Artificial Sequence
  Description of Artificial Sequence: Synthetic coding sequence
atgaccgggaagacccagaccagcaatgtgaccaacaagaatgaccccaagagcatcaacagcagggtcttcatcggcaacctgaacacagccatcgtgaagaaggtggacatcgaggccatcttcagcaaatatggcaagatcgtgggctgcagcgtgcacaagggctacgcctttgtgcagtacatgtctgaaagacatgcccgggctgctgtggccggagaaaatgcccgggtgattgctggccagcccctgtag

SEQ ID NO: 41772 - DNA, 876 bp, Artificial Sequence
  Description of Artificial Sequence: Synthetic coding sequence
atgaccgggaagacccagaccagcaatgtgaccaacaagaatgaccccaagagcatcaacagcagggtcttcatcggcaacctgaacacagccatcgtgaagaaggtggacatcgaggccatcttcagcaaatatggcaagatcgtgggctgcagcgtgcacaagggctacgcctttgtgcagtacatgtctgaaagacatgcccgggctgctgtggccggagaaaatgcccgggtgattgctggccagcccctggacatcaacatggccggggagcccaagccctaccggcccaagccaggcaacaagaggcccctgagcgccctgtaccgcctggagagcaaggagcccttcctgtctgtgggcggctacgtgtttgattatgactactacagagatgacttctacaacagactctttgactaccacggccgggtgcccccaccaccccgggccgtcatccccctgaagaggccccgggtggccgtgaccaccacccggcggggcaagggcgtcttctccatgaagggcggcagccgcagcacagccagcggcagcacaggcagcaagctgaagagtgatgagctgcagaccatcaagaaggagctgacccagatcaagaccaagattgacagcctgctgggccgcctggagaagattgagaagcagcagaaggccgaggccgaggcccagaagaagcagctggaggagagcctggtgctgatccaggaggagtgtgtgtctgaaattgctgaccacagcacagaggagcctgctgagggcggcccagatgctgatggagaggagatgacagatggcatcgaggaggactttgatgaagatggcggccacgagctgttcctgcagatcaagtag

SEQ ID NO: 41773 - DNA, 876 bp, Artificial Sequence; identical to SEQ ID NO: 41772
  Description of Artificial Sequence: Synthetic coding sequence

SEQ ID NO: 41774 - DNA, 876 bp, Artificial Sequence; identical to SEQ ID NO: 41772
  Description of Artificial Sequence: Synthetic coding sequence

SEQ ID NO: 41775 - DNA, 258 bp, Artificial Sequence; identical to SEQ ID NO: 41771
  Description of Artificial Sequence: Synthetic coding sequence

SEQ ID NO: 41776 - DNA, 657 bp, Artificial Sequence
  Description of Artificial Sequence: Synthetic coding sequence
atgaccatgtacaagagcaagaggaggcaccagcgctacatcaacatggccggggagcccaagccctaccggcccaagccaggcaacaagaggcccctgagcgccctgtaccgcctggagagcaaggagcccttcctgtctgtgggcggctacgtgtttgattatgactactacagagatgacttctacaaccggctgtttgactaccacggccgggtgcccccaccacccagggctgtgatccccctgaagaggccccgggtggccgtgaccaccacccggcggggcaaaggagtcttctccatgaagggcggcagccgcagcacagccagcggcagcacaggcagcaagctgaagagtgatgagctgcagaccatcaagaaggagctgacccagatcaagaccaagattgacagcctgctgggccgcctggagaagattgagaagcagcagaaggccgaggccgaggcccagaagaagcagctggaggagagcctggtgctgatccaggaggagtgtgtgtctgaaattgctgaccacagcacagaggagcctgctgagggcggcccagatgctgatggagaggagatgacagatggcattgaagaagattttgatgaagatggcggccacgagctgttcctgcagatcaagtag

SEQ ID NO: 41777 - DNA, 1986 bp, Artificial Sequence
  Description of Artificial Sequence: Synthetic coding sequence
atgaagcccctggagaagttcctgaagaagcagaccagccagctggccggccgcacagtggccggcggccctgggggcggcctgggcagctgtggcggccctgggggcggcggcggccctgggggcggcggcggccctgctgggggccagaggagcctgcagaggcggcagagcgtgtcccggctgctgctgcctgccttcctgcgggagcccccagctgagcccggcctggagcccccacctgaggagggcggggagcctgctggggtggccgaggagcccggcagcggcggcccctgctggctgcagctggaggaggtgcccggccctggccccctgggcggcggcggccccctgcggagccccagcagctacagcagtgatgagctgagccctggagagcccctgaccagccccccctgggcccccctgggcgcccctgagaggcctgagcacctgctgaacagagtgctggagcggctggccggcggggccacccgggacagcgctgccagtgacatcctgctggatgacatcgtgctgacccacagcctcttcctgcccacagagaagttcctgcaggagctgcaccagtactttgtgcgggccggcggcatggagggccctgagggcctgggcaggaagcaggcctgcctggccatgctgctgcacttcctggacacctaccagggcctgctgcaggaggaggagggcgccggccacatcatcaaggacctgtacctgctgatcatgaaggatgagagcctgtaccagggcctgcgggaggacaccctgcggctgcaccagctggtggagaccgtggagctgaagatccctgaggagaaccagccccccagcaagcaggtgaagcccctcttccgccacttcagaagaattgacagctgcctgcagaccagggtggccttccggggcagtgatgagatcttctgccgggtgtacatgccagaccacagctatgtgaccatccgcagccggctgagcgcctctgtgcaggacatcctgggctctgtgacagagaagctgcagtacagcgaggagcctgctggccgggaggacagcctcatcctggtggccgtgagcagcagtggagagaaggtgctgctgcagcccacagaggactgtgtgttcaccgccctgggcatcaacagccacctgtttgcctgcacccgggacagctatgaggccctggtgcccctgcctgaggagatccaggtgtcccctggggacacagagatccaccgggtggagccagaagatgtggccaaccacctgacagccttccactgggagctgttccgctgtgtgcatgagctggagtttgtggactatgtgttccatggagagcggggccggcgggagacagccaacctggagctgctgctgcagcgctgcagcgaggtgacccactgggtggccacagaggtgctgctgtgtgaggcccctgggaagagggcccagctgctgaagaagttcatcaagattgctgccctgtgcaagcagaaccaggacctgctgtccttctatgctgtggtgatgggcctggacaatgctgctgtgtcccggctgcggctgacctgggagaagctgcccgggaagttcaagaacctcttcaggaagtttgagaacctgacagacccctgcaggaaccacaagagctaccgggaggtgatcagcaagatgaagccccctgtgatcccctttgtgcccctcatcctgaaggacctgaccttcctgcacgagggcagcaagaccctggtggatggcctggtgaacatcgagaagctgcacagcgtggccgagaaggtgaggaccatcaggaagtaccgcagccggcccctgtgcctggacatggaggccagccccaaccacctgcagaccaaggcctacgtgcggcagttccaggtgattgacaaccagaacctgctgtttgagctgagctacaagctggaggccaacagccagtag

SEQ ID NO: 41778 - DNA, 1371 bp, Artificial Sequence
  Description of Artificial Sequence: Synthetic coding sequence
atggagggccctgagggcctgggcaggaagcaggcctgcctggccatgctgctgcacttcctggacacctaccagggcctgctgcaggaggaggagggcgccggccacatcatcaaggacctgtacctgctgatcatgaaggatgagagcctgtaccagggcctgcgggaggacaccctgcggctgcaccagctggtggagaccgtggagctgaagatccctgaggagaaccagccccccagcaagcaggtgaagcccctcttccgccacttcagaagaattgacagctgcctgcagaccagggtggccttccggggcagtgatgagatcttctgccgggtgtacatgccagaccacagctatgtgaccatccgcagccggctgagcgcctctgtgcaggacatcctgggctctgtgacagagaagctgcagtacagcgaggagcccgccggccgggaggacagcctcatcctggtggccgtgagcagcagcggggagaaggtgctgctgcagcccacagaggactgtgtgttcaccgccctgggcatcaacagccacctgtttgcctgcacccgggacagctatgaggccctggtgcccctgcctgaggagatccaggtgtcccctggggacacagagatccaccgggtggagccagaagatgtggccaaccacctgacagccttccactgggagctgttccgctgtgtgcatgagctggagtttgtggactatgtgttccacggggagcggggcagaagagaaacagccaacctggagctgctgctgcagcgctgcagcgaggtgacccactgggtggccacagaggtgctgctgtgtgaggcccctgggaagagggcccagctgctgaagaagttcatcaagattgctgccctgtgcaagcagaaccaggacctgctgtccttctatgctgtggtgatgggcctggacaatgctgctgtgtcccggctgcggctgacctgggagaagctgcccgggaagttcaagaacctcttcaggaagtttgagaacctgacagacccctgcaggaaccacaagagctaccgggaggtgatcagcaagatgaagccccctgtgatcccctttgtgcccctcatcctgaaggacctgaccttcctgcacgagggcagcaagaccctggtggatggcctggtgaacatcgagaagctgcacagcgtggccgagaaggtgaggaccatcaggaagtaccgcagccggcccctgtgcctggacatggaggccagccccaaccacctgcagaccaaggcctacgtgcggcagttccaggtgattgacaaccagaacctgctgtttgagctgagctacaagctggaggccaacagccagtag

SEQ ID NO: 41779 - DNA, 1371 bp, Artificial Sequence; identical to SEQ ID NO: 41778
  Description of Artificial Sequence: Synthetic coding sequence

SEQ ID NO: 41780 - DNA, 63 bp, Artificial Sequence
  Description of Artificial Sequence: Synthetic coding sequence
atggagggccctgagggcctgggcaggaagcaggcctgcctggccatgctgctgcacttctag

SEQ ID NO: 41781 - DNA, 306 bp, Artificial Sequence
  Description of Artificial Sequence: Synthetic coding sequence
atggagggccctgagggcctgggcaggaagcaggcctgcctggccatgctgctgcacttcctggacacctaccagggcctgctgcaggaggaggagggcgccggccacatcatcaaggacctgtacctgctgatcatgaaggatgagagcctgtaccagggcctgcgggaggacaccctgcggctgcaccagctggtggagaccgtggagctgaagatccctgaggagaaccagccccccagcaagcaggtgaagcccctcttccgccacttcagaagaattgacagctgcctgcagaccaggtag

SEQ ID NO: 41782 - DNA, 450 bp, Artificial Sequence
  Description of Artificial Sequence: Synthetic coding sequence
atggagggccctgagggcctgggcaggaagcaggcctgcctggccatgctgctgcacttcctggacacctaccagggcctgctgcaggaggaggagggcgccggccacatcatcaaggacctgtacctgctgatcatgaaggatgagagcctgtaccagggcctgcgggaggacaccctgcggctgcaccagctggtggagaccgtggagctgaagatccctgaggagaaccagccccccagcaagcaggtgaagcccctcttccgccacttcagaagaattgacagctgcctgcagaccagggtggccttccggggcagtgatgagatcttctgccgggtgtacatgccagaccacagctatgtgaccatccgcagccggctgagcgcctctgtgcaggacatcctgggctctgtgacagagaagctgcagtacagcgaggagccctag

SEQ ID NO: 41783 - DNA, 1359 bp, Artificial Sequence
  Description of Artificial Sequence: Synthetic coding sequence
atgccagacctgccccacctgctggccttcctgagcgccagcagagatgtgctgcccaggaccctgctgctgcccccacccaccctgggccccagagatgagcacacagatcctgtgcagatcggccgggtgcagcaggacaccccaggcaaggtgctgagcatcgtgaaccagctgtacctggagacccaccggggctggggccgggagcagaccccccaggagacagagcctgaggccgcccagagacatgaccctgcccccagaaatcctgccccccacggcgtgtcctgggtgaagggccccctgagccctgaggtggaccaccctggccctgccctggccagcctgctggaggaggaggaggaggacctggagggcaaggaggagggcagagaagatgatcctgaggaggagggcccagaagatgtgctgaccatccacgtgcagagcctggtgcgggcccggagcagctatgtggcccggcagtaccgcagcctgcgggtgagaattgccagtgacagcggcggcccccacggcagcggggaccctgccacagagctgctgcaggatgtgcgccacctgctgacagacctgcaggaccacctggccaaggacagctacatccgggctgtgtttggcagccggggccctggcctgcccaagaaggatgaagatcctggccctgccctggagacagctgtgtgccaggccgtgctggcccccctgaagccagccctgtggacccggctgcggaccctgcgggcccctgagctgcggcggctgcggcggcggcagacagccctgcgggccggggccggccccccaggggcccagggccctggccctgagggccagagccctgccccagccctgcggagccgcatccacgagcggctggcccacctgcatgctgcctgtgcccccaggaggaaggtggccctgctgctggaggtgtgcagagatgtgtatgccggcctggcccggggggagaaccaggaccccctgggcgcagatgccttcctgcctgccctgacagaggagctgatctggagcccagacattggagacacccagctggatgtggagttcctgatggagctgctggaccctgatgagctgcggggggaggccggctactacctgaccacctggtttggagccctgcaccacatcgcccactaccagcctgagacagaccgggccccccggggcctgagcagcgaggcccgggccagcctgcaccagtggcacagaagaaggaccctgcacaggaaggaccacccccgggcccaggccaacctgcccttcaaggagccctgggccgaggagaccgtgacaggcaccagtgacaactag

SEQ ID NO: 41784 - DNA, 1359 bp, Artificial Sequence; identical to SEQ ID NO: 41783
  Description of Artificial Sequence: Synthetic coding sequence

SEQ ID NO: 41785 - DNA, 1260 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggcgggagcccaagaggaagagcctgaccttcaccggcggggccaagggcctgatggacatctttgggaagggcaaggagacagagttcaagcagaaggtgctgaacaactgcaagaccacagcagatgagctgaagaagctgatccggctgcagacagagaagctgcagagcattgagaagcagctggagagcaatgaaattgagatccgcttctgggagcagaagtacaacagcaacctggaggaggagatcgtgcggctggagcagaagatcaagagaaatgatgtggagattgaggaggaggagttctgggagaatgagctgcagatcgagcaggagaatgagaagcagctgaaggaccagctgcaggagatccggcagaagatcacagaatgtgagaacaagctgaaggactacctggcccagatccgcaccatggagagcggcctggaggccgagaagctgcagcgggaggtgcaggaggcccaggtgaatgaggaggaggtgaagggcaagattggcaaggtgaagggggagattgacatccagggccagcagagcctgcggctggagaatggcatcaaggctgtggagaggagcctgggccaggccaccaagaggctgcaggacaaggagcaggagctggagcagctgaccaaggagctgcggcaggtgaacctgcagcagttcatccagcagacaggcaccaaggtgacagtgctgcctgctgagcccatcgagattgaggccagccatgctgacatcgagcgggaggcccccttccagagcggcagcctgaagaggcctggcagcagccggcagctgcccagcaacctgcgcatcctgcagaaccccatcagcagcggcttcaaccctgagggcatctacgtgtag

SEQ ID NO: 41786 - DNA, 1179 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggcgggagcccaagaggaagagcctgaccttcaccggcggggccaagggcctgatggacatctttgggaagggcaaggagacagagttcaagcagaaggtgctgaacaactgcaagaccacagcagatgagctgaagaagctgatccggctgcagacagagaagctgcagagcattgagaagcagctggagagcaatgaaattgagatccgcttctgggagcagaagtacaacagcaacctggaggaggagatcgtgcggctggagcagaagatcaagagaaatgatgtggagattgaggaggaggagttctgggagaatgagctgcagatcgagcaggagaatgagaagcagctgaaggaccagctgcaggagatccggcagaagatcacagaatgtgagaacaagctgaaggactacctggcccagatccgcaccatggagagcggcctggaggccgagaagctgcagcgggaggtgcaggaggcccaggtgaatgaggaggaggtgaagggcaagattggcaaggtgaagggggagattgacatccagggccagcagagcctgcggctggagaatggcatcaaggctgtggagaggagcctgggccaggccaccaagaggctgcaggacaaggagcaggagctggagcagctgaccaaggagctgcggcaggtgaacctgcagcagttcatccagcagacaggcaccaaggtgacagtgctgcctgctgagcccatcgagattgaggccagccatgctgacatcgagcggggcatcatcatcctgagtgacaagcaggagtgcaaggactag

SEQ ID NO: 41787 - DNA, 1260 bp, Artificial Sequence; identical to SEQ ID NO: 41785
  Description of Artificial Sequence: Synthetic coding sequence

SEQ ID NO: 41788 - DNA, 276 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgactag

SEQ ID NO: 41789 - DNA, 90 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgcctag

SEQ ID NO: 41790 - DNA, 627 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggcgggagcccaagaggaagagcctgaccttcaccggcggggccaagggcctgatggacatctttgggaagggcaaggagacagagttcaagcagaaggtgctgaacaactgcaagaccacagcagatgagctgaagaagctgatccggctgcagacagagaagctgcagagcattgagaagcagctggagagcaatgaaattgagatccgcttctgggagcagaagtacaacagcaacctggaggaggagatcgtgaggtag

SEQ ID NO: 41791 - DNA, 1260 bp, Artificial Sequence; identical to SEQ ID NO: 41785
  Description of Artificial Sequence: Synthetic coding sequence

SEQ ID NO: 41792 - DNA, 330 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgcccctgtcctag

SEQ ID NO: 41793 - DNA, 660 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggcgggagcccaagaggaagagcctgaccttcaccggcggggccaagggcctgatggacatctttgggaagggcaaggagacagagttcaagcagaaggtgctgaacaactgcaagaccacagcagatgagctgaagaagctgatccggctgcagacagagaagctgcagagcattgagaagcagctggagagcaatgaaattgagatccgcttctgggagcagaagtacaacagcaacctggaggaggagatcgtgcggctggagcagaagatcaagagaaatgatgtggagtag

SEQ ID NO: 41794 - DNA, 369 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggtag

SEQ ID NO: 41795 - DNA, 1260 bp, Artificial Sequence; identical to SEQ ID NO: 41785
  Description of Artificial Sequence: Synthetic coding sequence

SEQ ID NO: 41796 - DNA, 480 bp, Artificial Sequence
  Description of Artificial Sequence: Synthetic coding sequence
atggagctgaaggtgtgggtggatggagtgcagagaattgtgtgtggggtgacagaggtgaccacctgccaggaggtggtgattgccctggcccaggccatcggccgcacaggccgctacaccctgattgagaagtggagggacacagagcggcacctggcccctcatgagaaccccatcatcagcctgaacaagtggggccagtatgccagtgatgtgcagctgatcctgcggaggacaggccccagcctgtctgagcggcccaccagtgacagcgtggcccgcatccctgagaggaccctgtaccggcagagcctgccccccctggccaagctgcggccccagattgacaagagcatcaagaggcgggagcccaagaggaagagcctgaccttcaccggcggggccaagggcctgatggacatctttgggaagggcaaggagacagagttcaagcagaaggtgctgaacaactgctag

SEQ ID NO: 41797 - DNA, 2412 bp, Artificial Sequence
  Description of Artificial Sequence: Synthetic coding sequence
atggccaagaggagcagcctgtacatcagaattgtggagggcaagaacctgcctgccaaggacatcaccggcagcagtgacccctactgcatcgtgaaggtggacaatgagcccatcatcagaacagccaccgtgtggaagaccctgtgccccttctggggcgaggagtaccaggtgcacctgccccccaccttccacgctgtggccttctacgtgatggatgaagatgccctgagcagagatgatgtgattggcaaggtgtgcctgacccgggacaccatcgccagccaccccaagggcttcagcggctgggcccacctgacagaggtggaccctgatgaggaggtgcagggcgagatccacctgcggctggaggtgtggccaggggcccgggcctgccgcctgcgctgcagcgtgctggaggcccgggacctggcccccaaggacagaaatggcaccagtgacccctttgtgcgggtgcgctacaagggccgcacccgggagaccagcatcgtgaagaagagctgctacccccgctggaatgagacctttgaatttgagctgcaggagggcgccatggaggccctgtgtgtggaggcctgggactgggacctggtgtccagaaatgacttcctgggcaaggtggtgattgatgtgcagaggctgcgggtggtgcagcaggaggagggctggttccggctgcagcctgaccagagcaagagcagaagacatgatgagggcaacctgggcagcctgcagctggaggtgcggctgagagatgagaccgtgctgcccagcagctactaccagcccctggtgcacctgctgtgccacgaggtgaagctgggcatgcagggccctggccagctgatccccctcatcgaggagaccaccagcacagaatgtcggcaggatgtggccaccaacctgctgaagctgttcctgggccagggcctggccaaggacttcctggacctgctcttccagctggagctgagcaggaccagcgagaccaacaccctcttccgcagcaacagcctggccagcaagtctgtggagagcttcctgaaggtggccggcatgcagtacctgcatggagtgctgggccccatcatcaacaaggtgtttgaggagaagaagtatgtggagctggaccccagcaaggtggaggtgaaggatgtgggctgcagcggcctgcaccggccccagacagaggccgaggtgctggagcagagcgcccagaccctgcgggcccacctgggcgccctgctgagcgccctgagccgctctgtgcgggcctgcccagctgtggtgcgggccaccttccggcagctgttcagaagagtgcgggagcgcttccctggggcccagcatgaaaatgtgcccttcatcgctgtgaccagcttcctgtgcctgcgcttcttctccccagccatcatgagccccaagctgttccacctgcgggagagacatgctgatgcccggaccagcaggaccctgctgctgctggccaaggctgtgcagaatgtgggcaacatggacaccccagccagccgggccaaggaggcctggatggagcccctgcagcccaccgtgcaccagggcgtggcccagctgaaggacttcatcaccaagctggtggacatcgaggagaaggatgagctggacctgcagaggaccctgagcctgcaggcccctcctgtgaaggagggccccctcttcatccacaggaccaagggcaagggccccctgatgagcagcagcttcaagaagctgtacttcagcctgaccacagaggccctgagctttgccaagacccccagcagcaagaagagcgccctgatcaagctggccaacatccgggctgctgagaaggtggaggagaagagctttggaggcagccacgtgatgcaggtgatctacacagatgatgctggccggccccagacagcctacctgcagtgcaagtgtgtgaatgagctgaaccagtggctgagcgccctgaggaaggtgtccatcaacaacacaggcctgctgggcagctaccaccctggggtcttccggggggacaagtggagctgctgccaccagaaggagaagacaggccagggctgtgacaagaccaggagccgggtgaccctgcaggagtggaatgaccccctggaccatgacctggaggcccagctgatctaccgccacctgctgggcgtggaggccatgctgtgggagcggcaccgggagctgtctggaggagctgaggccggcaccgtgcccaccagccctgggaaggtgcctgaggacagcctggcccggctgctgcgggtgctgcaggacctgcgggaggcccacagcagcagccctgctggcagccccccatctgagcccaactgcctgctggagctgcagacctag

SEQ ID NO: 41798 - DNA, 2274 bp, Artificial Sequence
  Description of Artificial Sequence: Synthetic coding sequence
atggccaagaggagcagcctgtacatcagaattgtggagggcaagaacctgcctgccaaggacatcaccggcagcagtgacccctactgcatcgtgaaggtggacaatgagcccatcatcagaacagccaccgtgtggaagaccctgtgccccttctggggcgaggagtaccaggtgcacctgccccccaccttccacgctgtggccttctacgtgatggatgaagatgccctgagcagagatgatgtgattggcaaggtgtgcctgacccgggacaccatcgccagccaccccaagggcttcagcggctgggcccacctgacagaggtggaccctgatgaggaggtgcagggcgagatccacctgcggctggaggtgtggccaggggcccgggcctgccgcctgcgctgcagcgtgctggaggcccgggacctggcccccaaggacagaaatggcaccagtgacccctttgtgcgggtgcgctacaagggccgcacccgggagaccagcatcgtgaagaagagctgctacccccgctggaatgagacctttgaatttgagctgcaggagggcgccatggaggccctgtgtgtggaggcctgggactgggacctggtgtccagaaatgacttcctgggcaaggtggtgattgatgtgcagaggctgcgggtggtgcagcaggaggagggctggttccggctgcagcctgaccagagcaagagcagaagacatgatgagggcaacctgggcagcctgcagctggaggtgcggctgagagatgagaccgtgctgcccagcagctactaccagcccctggtgcacctgctgtgccacgaggtgaagctgggcatgcagggccctggccagctgatccccctcatcgaggagaccaccagcacagaatgtcggcaggatgtggccaccaacctgctgaagctgttcctgggccagggcctggccaaggacttcctggacctgctcttccagctggagctgagcaggaccagcgagaccaacaccctcttccgcagcaacagcctggccagcaagtctgtggagagcttcctgaaggtggccggcatgcagtacctgcatggagtgctgggccccatcatcaacaaggtgtttgaggagaagaagtatgtggagctggaccccagcaaggtggaggtgaaggatgtgggctgcagcggcctgcaccggccccagacagaggccgaggtgctggagcagagcgcccagaccctgcgggcccacctgggcgccctgctgagcgccctgagccgctctgtgcgggcctgcccagctgtggtgcgggccaccttccggcagctgttcagaagagtgcgggagcgcttccctggggcccagcatgaaaatgtgcccttcatcgctgtgaccagcttcctgtgcctgcgcttcttctccccagccatcatgagccccaagctgttccacctgcgggagagacatgctgatgcccggaccagcaggaccctgctgctgctggccaaggctgtgcagaatgtgggcaacatggacaccccagccagccgggccaaggaggcctggatggagcccctgcagcccaccgtgcaccagggcgtggcccagctgaaggacttcatcaccaagctggtggacatcgaggagaaggatgagctggacctgcagaggaccctgagcctgcaggcccctcctgtgaaggagggccccctcttcatccacaggaccaagggcaagggccccctgatgagcagcagcttcaagaagctgtacttcagcctgaccacagaggccctgagctttgccaagacccccagcagcaaatgtgtgaatgagctgaaccagtggctgagcgccctgaggaaggtgtccatcaacaacacaggcctgctgggcagctaccaccctggggtcttccggggggacaagtggagctgctgccaccagaaggagaagacaggccagggctgtgacaagaccaggagccgggtgaccctgcaggagtggaatgaccccctggaccatgacctggaggcccagctgatctaccgccacctgctgggcgtggaggccatgctgtgggagcggcaccgggagctgtctggaggagctgaggccggcaccgtgcccaccagccctgggaaggtgcctgaggacagcctggcccggctgctgcgggtgctgcaggacctgcgggaggcccacagcagcagccctgctggcagccccccatctgagcccaactgcctgctggagctgcagacctag

SEQ ID NO: 41799 - DNA, 3774 bp, Artificial Sequence
  Description of Artificial Sequence: Synthetic coding sequence
atgcagaagggcatccggctgaatgatggccacgtggccagcctgggcctgctggccaggaaggatggcaccaggaagggctacctgagcaagaggagcagtgacaacaccaagtggcagaccaagtggtttgccctgctgcagaacctgctcttctactttgaaagtgacagcagcagccggcccagcggcctgtacctgctggagggctgtgtgtgtgaccgggcccccagccccaagccagccctgagcgccaaggagcccctggagaagcagcactacttcaccgtgaacttcagccatgagaaccagaaggccctggagctgaggacagaagatgccaaggactgtgatgagtgggtggccgccatcgcccacgccagctaccgcaccctggccacagagcacgaggccctgatgcagaagtacctgcacctgctgcagatcgtggagacagagaagacagtggccaagcagctgcggcagcagattgaagatggagaaattgaaattgagcggctgaaggccgagatcaccagcctgctgaaggacaatgaaagaatccagagcacccagacagtggccccaaatgatgaagattctgacatcaagaagatcaagaaggtgcagagcttcctgcggggctggctgtgcaggaggaagtggaagaccatcatccaggactacatccgcagcccccatgctgacagcatgaggaagaggaaccaggtggtgttctccatgctggaggccgaggccgagtatgtgcagcagctgcacatcctggtgaacaacttcctgcggcccctgaggatggccgccagcagcaagaagccacccatcacccatgatgatgtgagcagcatcttcctgaacagcgagaccatcatgttcctgcaccagatcttctaccagggcctgaaggcccgcatcagctcctggcccaccctggtgctggccgacctgtttgacatcctgctgcccatgctgaacatctaccaggagtttgtgaggaaccaccagtacagcctgcagatcctggcccactgcaagcagaacagagactttgacaagctgctgaagcactatgaggccaagccagactgtgaggagaggaccctggagaccttcctgacctaccccatgttccagatcccccgctacatcctgaccctgcacgagctgctggcccacacccctcatgaacatgtggagaggaacagcctggactatgccaagagcaagctggaggagctgagccgcatcatgcatgatgaggtgtctgaaacagagaacatcaggaagaacctggccattgaaagaatgatcatcgagggctgtgagatcctgctggacaccagccagacctttgtgcggcagggcagcctcatccaggtgcccatgtctgagaagggcaagatcacccggggccgcctgggcagcctgagcctgaagaaggagggggagcggcagtgcttcctgttcagcaagcacctgatcatctgcacccggggcagcggcggcaagctgcacctgaccaagaatggagtcatcagcctgattgactgcaccctgctggaggagcctgagagcacagaggaggaggccaagggcagcggccaggacatcgaccacctggacttcaagattggagtggagcccaaggacagcccccccttcaccgtcatcctggtggccagcagccggcaggagaaggccgcctggaccagtgacatcagccagtgtgtggacaacatccgctgcaatggcctgatgatgaatgcctttgaggagaacagcaaggtgacagtgccccagatgatcaagagtgatgccagcctgtactgtgatgatgtggacatccgcttcagcaagaccatgaacagctgcaaggtgctgcagatccgctatgcctctgtggagcggctgctggagcggctgacagacctgcgcttcctgagcattgacttcctgaacaccttcctgcacagctacagagtcttcaccacagccatcgtggtgctggacaagctgatcaccatctacaagaagcccatcagcgccatcccagcccggagcctggagctgctgtttgccagcggccagaacaacaagctgctgtatggagagccccccaagagcccccgggccaccaggaagttcagcagccccccacccctgagcatcaccaagaccagcagccccagcagaagaaggaagctgagcctgaacatccccatcatcactggaggcaaggccctggacctggccgccctgagctgcaacagcaatggctacacctccatgtacagcgccatgagccccttcagcaaggccaccctggacaccagcaagctgtatgtgagcagcagcttcaccaacaagatcccagatgaaggagacaccaccccagagaagccagaggaccccagcgccctgagcaagcagagcagcgaggtgtccatgagggaggagagtgacatcgaccagaaccagagtgatgatggagacacagagaccagccccaccaagagccccaccacccccaagtctgtgaagaacaagaacagcagcgagttccccctcttctcctacaacaatggagtggtgatgaccagctgccgggagctggacaacaacagaagtgccctgtctgctgccagcgcctttgccatcgccacagctggggccaatgaaggcacccccaacaaggagaagtacagaaggatgagcctggccagcgctggcttccccccagaccagagaaatggagacaaggagtttgtgatcagaagagctgccaccaacagagtgctgaatgtgctgcggcactgggtgtccaagcacagccaggactttgagaccaatgatgagctgaagtgcaaggtgattggcttcctggaggaggtgatgcatgaccctgagctgctgacccaggagaggaaggccgccgccaacatcatccgcaccctgacccaggaggaccccggggacaaccagatcaccctggaggagatcacccagatggccgagggcgtgaaggccgagccctttgagaaccacagcgccctggagattgctgagcagctgaccctgctggaccacctggtgttcaagaagatcccctatgaggagttcttcggccagggctggatgaagctggagaagaatgaaagaacaccctacatcatgaagaccaccaagcacttcaatgacatcagcaacctgattgccagcgagatcatcagaaatgaagacatcaatgcccgggtgtctgccatcgagaagtgggtggccgtggccgacatctgccgctgcctgcacaactacaatgctgtgctggagatcaccagctccatgaacagaagtgccatcttccggctgaagaagacctggctgaaggtgtccaagcagaccaaggccctgattgacaagctgcagaagctggtgagcagcgagggccgcttcaagaacctgcgggaggccctgaagaactgtgaccccccctgtgtgccctacctgggcatgtacctgacagacctggccttcatcgaggagggcacccccaactacacagaagatggcctggtgaacttcagcaagatgaggatgatcagccacatcatccgggagatccggcagttccagcagacagcctacaagattgagcaccaggccaaggtgacccagtacctgctggaccagagctttgtgatggatgaggagagcctgtatgagagcagcctgagaattgagcccaagctgcccacctag

SEQ ID NO: 41800 - DNA, 1470 bp, Artificial Sequence
  Description of Artificial Sequence: Synthetic coding sequence
atgtacagcgccatgagccccttcagcaaggccaccctggacaccagcaagctgtatgtgagcagcagcttcaccaacaagatcccagatgaaggagacaccaccccagagaagccagaggaccccagcgccctgagcaagcagagcagcgaggtgtccatgagggaggagagtgacatcgaccagaaccagagtgatgatggagacacagagaccagccccaccaagagccccaccacccccaagtctgtgaagaacaagaacagcagcgagttccccctcttctcctacaacaatggagtggtgatgaccagctgccgggagctggacaacaacagaagtgccctgtctgctgccagcgcctttgccatcgccacagctggggccaatgaaggcacccccaacaaggagaagtacagaaggatgagcctggccagcgctggcttccccccagaccagagaaatggagacaaggagtttgtgatcagaagagctgccaccaacagagtgctgaatgtgctgcggcactgggtgtccaagcacagccaggactttgagaccaatgatgagctgaagtgcaaggtgattggcttcctggaggaggtgatgcatgaccctgagctgctgacccaggagaggaaggccgccgccaacatcatccgcaccctgacccaggaggaccccggggacaaccagatcaccctggaggagatcacccagatggccgagggcgtgaaggccgagccctttgagaaccacagcgccctggagattgctgagcagctgaccctgctggaccacctggtgttcaagaagatcccctatgaggagttcttcggccagggctggatgaagctggagaagaatgaaagaacaccctacatcatgaagaccaccaagcacttcaatgacatcagcaacctgattgccagcgagatcatcagaaatgaagacatcaatgcccgggtgtctgccatcgagaagtgggtggccgtggccgacatctgccgctgcctgcacaactacaatgctgtgctggagatcaccagctccatgaacagaagtgccatcttccggctgaagaagacctggctgaaggtgtccaagcagaccaaggccctgattgacaagctgcagaagctggtgagcagcgagggccgcttcaagaacctgcgggaggccctgaagaactgtgaccccccctgtgtgccctacctgggcatgtacctgacagacctggccttcatcgaggagggcacccccaactacacagaagatggcctggtgaacttcagcaagatgaggatgatcagccacatcatccgggagatccggcagttccagcagacagcctacaagattgagcaccaggccaaggtgacccagtacctgctggaccagagctttgtgatggatgaggagagcctgtatgagagcagcctgagaattgagcccaagctgcccacctag

SEQ ID NO: 41801 - DNA, 3822 bp, Artificial Sequence
  Description of Artificial Sequence: Synthetic coding sequence
atgcagaagggcatccggctgaatgatggccacgtggccagcctgggcctgctggccaggaaggatggcaccaggaagggctacctgagcaagaggagcagtgacaacaccaagtggcagaccaagtggtttgccctgctgcagaacctgctcttctactttgaaagtgacagcagcagccggcccagcggcctgtacctgctggagggctgtgtgtgtgaccgggcccccagccccaagccagccctgagcgccaaggagcccctggagaagcagcactacttcaccgtgaacttcagccatgagaaccagaaggccctggagctgaggacagaagatgccaaggactgtgatgagtgggtggccgccatcgcccacgccagctaccgcaccctggccacagagcacgaggccctgatgcagaagtacctgcacctgctgcagatcgtggagacagagaagacagtggccaagcagctgcggcagcagattgaagatggagaaattgaaattgagcggctgaaggccgagatcaccagcctgctgaaggacaatgaaagaatccagagcacccagacagtggccccaaatgatgaagattctgacatcaagaagatcaagaaggtgcagagcttcctgcggggctggctgtgcaggaggaagtggaagaccatcatccaggactacatccgcagcccccatgctgacagcatgaggaagaggaaccaggtggtgttctccatgctggaggccgaggccgagtatgtgcagcagctgcacatcctggtgaacaacttcctgcggcccctgaggatggccgccagcagcaagaagccacccatcacccatgatgatgtgagcagcatcttcctgaacagcgagaccatcatgttcctgcaccagatcttctaccagggcctgaaggcccgcatcagctcctggcccaccctggtgctggccgacctgtttgacatcctgctgcccatgctgaacatctaccaggagtttgtgaggaaccaccagtacagcctgcagatcctggcccactgcaagcagaacagagactttgacaagctgctgaagcactatgaggccaagccagactgtgaggagaggaccctggagaccttcctgacctaccccatgttccagatcccccgctacatcctgaccctgcacgagctgctggcccacacccctcatgaacatgtggagaggaacagcctggactatgccaagagcaagctggaggagctgagccgcatcatgcatgatgaggtgtctgaaacagagaacatcaggaagaacctggccattgaaagaatgatcatcgagggctgtgagatcctgctggacaccagccagacctttgtgcggcagggcagcctcatccaggtgcccatgtctgagaagggcaagatcacccggggccgcctgggcagcctgagcctgaagaaggagggggagcggcagtgcttcctgttcagcaagcacctgatcatctgcacccggggcagcggcggcaagctgcacctgaccaagaatggagtcatcagcctgattgactgcaccctgctggaggagcctgagagcacagaggaggaggccaagggcagcggccaggacatcgaccacctggacttcaagattggagtggagcccaaggacagcccccccttcaccgtcatcctggtggccagcagccggcaggagaaggccgcctggaccagtgacatcagccagtgtgtggacaacatccgctgcaatggcctgatgatgaatgcctttgaggagaacagcaaggtgacagtgccccagatgatcaagaggacccgggagggcacccgggaggccgagatgagcagaagtgatgccagcctgtactgtgatgatgtggacatccgcttcagcaagaccatgaacagctgcaaggtgctgcagatccgctatgcctctgtggagcggctgctggagcggctgacagacctgcgcttcctgagcattgacttcctgaacaccttcctgcacagctacagagtcttcaccacagccatcgtggtgctggacaagctgatcaccatctacaagaagcccatcagcgccatcccagcccgctggctgcggagcctggagctgctgtttgccagcggccagaacaacaagctgctgtatggagagccccccaagagcccccgggccaccaggaagttcagcagccccccacccctgagcatcaccaagaccagcagccccagcagaagaaggaagctgagcctgaacatccccatcatcactggaggcaaggccctggacctggccgccctgagctgcaacagcaatggctacacctccatgtacagcgccatgagccccttcagcaaggccaccctggacaccagcaagctgtatgtgagcagcagcttcaccaacaagatcccagatgaaggagacaccaccccagagaagccagaggaccccagcgccctgagcaagcagagcagcgaggtgtccatgagggaggagagtgacatcgaccagaaccagagtgatgatggagacacagagaccagccccaccaagagccccaccacccccaagtctgtgaagaacaagaacagcagcgagttccccctcttctcctacaacaatggagtggtgatgaccagctgccgggagctggacaacaacagaagtgccctgtctgctgccagcgcctttgccatcgccacagctggggccaatgaaggcacccccaacaaggagaagtacagaaggatgagcctggccagcgctggcttccccccagaccagagaaatggagacaaggagtttgtgatcagaagagctgccaccaacagagtgctgaatgtgctgcggcactgggtgtccaagcacagccaggactttgagaccaatgatgagctgaagtgcaaggtgattggcttcctggaggaggtgatgcatgaccctgagctgctgacccaggagaggaaggccgccgccaacatcatccgcaccctgacccaggaggaccccggggacaaccagatcaccctggaggagatcacccagatggccgagggcgtgaaggccgagccctttgagaaccacagcgccctggagattgctgagcagctgaccctgctggaccacctggtgttcaagaagatcccctatgaggagttcttcggccagggctggatgaagctggagaagaatgaaagaacaccctacatcatgaagaccaccaagcacttcaatgacatcagcaacctgattgccagcgagatcatcagaaatgaagacatcaatgcccgggtgtctgccatcgagaagtgggtggccgtggccgacatctgccgctgcctgcacaactacaatgctgtgctggagatcaccagctccatgaacagaagtgccatcttccggctgaagaagacctggctgaaggtgtccaagcagaccaaggccctgattgacaagctgcagaagctggtgagcagcgagggccgcttcaagaacctgcgggaggccctgaagaactgtgaccccccctgtgtgccctacctgggcatgtacctgacagacctggccttcatcgaggagggcacccccaactacacagaagatggcctggtgaacttcagcaagatgaggatgatcagccacatcatccgggagatccggcagttccagcagacagcctacaagattgagcaccaggccaaggtgacccagtacctgctggaccagagctttgtgatggatgaggagagcctgtatgagagcagcctgagaattgagcccaagctgcccacctag

SEQ ID NO: 41802 - DNA, 3783 bp, Artificial Sequence
  Description of Artificial Sequence: Synthetic coding sequence
atgcagaagggcatccggctgaatgatggccacgtggccagcctgggcctgctggccaggaaggatggcaccaggaagggctacctgagcaagaggagcagtgacaacaccaagtggcagaccaagtggtttgccctgctgcagaacctgctcttctactttgaaagtgacagcagcagccggcccagcggcctgtacctgctggagggctgtgtgtgtgaccgggcccccagccccaagccagccctgagcgccaaggagcccctggagaagcagcactacttcaccgtgaacttcagccatgagaaccagaaggccctggagctgaggacagaagatgccaaggactgtgatgagtgggtggccgccatcgcccacgccagctaccgcaccctggccacagagcacgaggccctgatgcagaagtacctgcacctgctgcagatcgtggagacagagaagacagtggccaagcagctgcggcagcagattgaagatggagaaattgaaattgagcggctgaaggccgagatcaccagcctgctgaaggacaatgaaagaatccagagcacccagacagtggccccaaatgatgaagattctgacatcaagaagatcaagaaggtgcagagcttcctgcggggctggctgtgcaggaggaagtggaagaccatcatccaggactacatccgcagcccccatgctgacagcatgaggaagaggaaccaggtggtgttctccatgctggaggccgaggccgagtatgtgcagcagctgcacatcctggtgaacaacttcctgcggcccctgaggatggccgccagcagcaagaagccacccatcacccatgatgatgtgagcagcatcttcctgaacagcgagaccatcatgttcctgcaccagatcttctaccagggcctgaaggcccgcatcagctcctggcccaccctggtgctggccgacctgtttgacatcctgctgcccatgctgaacatctaccaggagtttgtgaggaaccaccagtacagcctgcagatcctggcccactgcaagcagaacagagactttgacaagctgctgaagcactatgaggccaagccagactgtgaggagaggaccctggagaccttcctgacctaccccatgttccagatcccccgctacatcctgaccctgcacgagctgctggcccacacccctcatgaacatgtggagaggaacagcctggactatgccaagagcaagctggaggagctgagccgcatcatgcatgatgaggtgtctgaaacagagaacatcaggaagaacctggccattgaaagaatgatcatcgagggctgtgagatcctgctggacaccagccagacctttgtgcggcagggcagcctcatccaggtgcccatgtctgagaagggcaagatcacccggggccgcctgggcagcctgagcctgaagaaggagggggagcggcagtgcttcctgttcagcaagcacctgatcatctgcacccggggcagcggcggcaagctgcacctgaccaagaatggagtcatcagcctgattgactgcaccctgctggaggagcctgagagcacagaggaggaggccaagggcagcggccaggacatcgaccacctggacttcaagattggagtggagcccaaggacagcccccccttcaccgtcatcctggtggccagcagccggcaggagaaggccgcctggaccagtgacatcagccagtgtgtggacaacatccgctgcaatggcctgatgatgaatgcctttgaggagaacagcaaggtgacagtgccccagatgatcaagagtgatgccagcctgtactgtgatgatgtggacatccgcttcagcaagaccatgaacagctgcaaggtgctgcagatccgctatgcctctgtggagcggctgctggagcggctgacagacctgcgcttcctgagcattgacttcctgaacaccttcctgcacagctacagagtcttcaccacagccatcgtggtgctggacaagctgatcaccatctacaagaagcccatcagcgccatcccagcccgctggctgcggagcctggagctgctgtttgccagcggccagaacaacaagctgctgtatggagagccccccaagagcccccgggccaccaggaagttcagcagccccccacccctgagcatcaccaagaccagcagccccagcagaagaaggaagctgagcctgaacatccccatcatcaccggcggcaaggccctggacctggccgccctgagctgcaacagcaatggctacacctccatgtacagcgccatgagccccttcagcaaggccaccctggacaccagcaagctgtatgtgagcagcagcttcaccaacaagatcccagatgaaggagacaccaccccagagaagccagaggaccccagcgccctgagcaagcagagcagcgaggtgtccatgagggaggagagtgacatcgaccagaaccagagtgatgatggagacacagagaccagccccaccaagagccccaccacccccaagtctgtgaagaacaagaacagcagcgagttccccctcttctcctacaacaacggggtggtgatgaccagctgccgggagctggacaacaacagaagtgccctgtctgctgccagcgcctttgccatcgccacagctggggccaatgaaggcacccccaacaaggagaagtacagaaggatgagcctggccagcgctggcttccccccagaccagagaaatggagacaaggagtttgtgatccggcgggccgccaccaacagagtgctgaatgtgctgcggcactgggtgtccaagcacagccaggactttgagaccaatgatgagctgaagtgcaaggtgattggcttcctggaggaggtgatgcatgaccctgagctgctgacccaggagaggaaggctgctgccaacatcatccgcaccctgacccaggaggaccccggggacaaccagatcaccctggaggagatcacccagatggccgagggcgtgaaggccgagccctttgagaaccacagcgccctggagattgctgagcagctgaccctgctggaccacctggtgttcaagaagatcccctatgaggagttcttcggccagggctggatgaagctggagaagaatgaaagaacaccctacatcatgaagaccaccaagcacttcaatgacatcagcaacctgattgccagcgagatcatcagaaatgaagacatcaatgcccgggtgtctgccatcgagaagtgggtggccgtggccgacatctgccgctgcctgcacaactacaatgctgtgctggagatcaccagctccatgaacagaagtgccatcttccggctgaagaagacctggctgaaggtgtccaagcagaccaaggccctgattgacaagctgcagaagctggtgtcctctgagggccgcttcaagaacctgcgggaggccctgaagaactgtgaccccccctgtgtgccctacctgggcatgtacctgacagacctggccttcatcgaggagggcacccccaactacacagaagatggcctggtgaacttcagcaagatgaggatgatcagccacatcatccgggagatccggcagttccagcagacagcctacaagattgagcaccaggccaaggtgacccagtacctgctggaccagagctttgtgatggatgaggagagcctgtatgagagcagcctgcgcatcgagcccaagctgcccacctag

SEQ ID NO: 41803 - DNA, 1470 bp, Artificial Sequence
  Description of Artificial Sequence: Synthetic coding sequence
atgttcctggagccccaggagaccatgccccagacctctgtggtgttcagcagcatcctgggccccagctgcagcggccaggtgcagcccggcatgggagagcggggcggcggggccggcggcggcagcggggacctgatcttccaggacggccacctgatcagcggcagcctggaggccctgatggagcacctggtgcccaccgtggactactacccagacaggacctacatcttcaccttcctgctgagcagcagggtcttcatgcctcctcatgacctgctggcccgggtgggccagatctgtgtggagcagaagcagcagctggaggccggccctgagaaggccaagctgaagagcttcagcgccaagatcgtgcagctgctgaaggagtggacagaggccttcccctatgacttccaggatgagaaggccatggccgagctgaaggccatcacccaccgggtgacccagtgtgatgaggagaatggaacagtgaagaaggccatcgcccagatgacccagagcctgctgctgagcctggccgcccggagccagctgcaggagctgcgggagaagctgcggcccccagctgtggacaagggccccatcctgaagaccaagcccccagctgcccagaaggacatcctgggcgtgtgctgtgaccccctggtgctggcccagcagctgacccacatcgagctggacagagtgagcagcatctacccagaggacctgatgcagatcgtgagccacatggacagcctggacaaccaccgctgccgcggggacctgaccaagacctacagcctggaggcctatgacaactggttcaactgcctgtccatgctggtggccacagaggtgtgccgggtggtgaagaagaagcacaggaccaggatgctggagttcttcattgatgtggcccgggagtgcttcaacatcggcaacttcaacagcatgatggccatcatcagcggcatgaacctgagccctgtggcccggctgaagaagacctggagcaaggtgaagacagccaagtttgatgtgctggagcaccacatggaccccagcagcaacttctgcaactacagaacagccctgcagggcgccacccagaggagccagatggccaacagcagccgggagaagatcgtcatccctgtgttcaacctgtttgtgaaggacatctacttcctgcacaagatccacaccaaccacctgcccaacggccacatcaacttcaagaagttctgggagatcagccggcagatccacgagttcatgacctggacccaggtggagtgcccctttgagaaggacaagaagatccagagctacctgctgacagcccccatctacagcgaggaggccctgtttgtggccagctttgagagcgagggccctgagaaccacatggagaaggacagctggaagaccctgcggaccaccctgctgaacagagcctag

SEQ ID NO: 41804 - DNA, 1446 bp, Artificial Sequence
  Description of Artificial Sequence: Synthetic coding sequence
atgccccagacctctgtggtgttcagcagcatcctgggccccagctgcagcggccaggtgcagcccggcatgggagagcggggcggcggggccggcggcggcagcggggacctgatcttccaggacggccacctgatcagcggcagcctggaggccctgatggagcacctggtgcccaccgtggactactacccagacaggacctacatcttcaccttcctgctgagcagcagggtcttcatgcctcctcatgacctgctggcccgggtgggccagatctgtgtggagcagaagcagcagctggaggccggccctgagaaggccaagctgaagagcttcagcgccaagatcgtgcagctgctgaaggagtggacagaggccttcccctatgacttccaggatgagaaggccatggccgagctgaaggccatcacccaccgggtgacccagtgtgatgaggagaatggaacagtgaagaaggccatcgcccagatgacccagagcctgctgctgagcctggccgcccggagccagctgcaggagctgcgggagaagctgcggcccccagctgtggacaagggccccatcctgaagaccaagcccccagctgcccagaaggacatcctgggcgtgtgctgtgaccccctggtgctggcccagcagctgacccacatcgagctggacagagtgagcagcatctacccagaggacctgatgcagatcgtgagccacatggacagcctggacaaccaccgctgccgcggggacctgaccaagacctacagcctggaggcctatgacaactggttcaactgcctgtccatgctggtggccacagaggtgtgccgggtggtgaagaagaagcacaggaccaggatgctggagttcttcattgatgtggcccgggagtgcttcaacatcggcaacttcaacagcatgatggccatcatcagcggcatgaacctgagccctgtggcccggctgaagaagacctggagcaaggtgaagacagccaagtttgatgtgctggagcaccacatggaccccagcagcaacttctgcaactacagaacagccctgcagggcgccacccagaggagccagatggccaacagcagccgggagaagatcgtcatccctgtgttcaacctgtttgtgaaggacatctacttcctgcacaagatccacaccaaccacctgcccaacggccacatcaacttcaagaagttctgggagatcagccggcagatccacgagttcatgacctggacccaggtggagtgcccctttgagaaggacaagaagatccagagctacctgctgacagcccccatctacagcgaggaggccctgtttgtggccagctttgagagcgagggccctgagaaccacatggagaaggacagctggaagaccctgcggaccaccctgctgaacagagcctag

SEQ ID NO: 41805 - DNA, 1446 bp, Artificial Sequence; identical to SEQ ID NO: 41804
  Description of Artificial Sequence: Synthetic coding sequence

SEQ ID NO: 41806 - DNA, 1422 bp, Artificial Sequence
  Description of Artificial Sequence: Synthetic coding sequence
atgccccagaccccacccttcagcgccatgtttgacagcagcggctacaacagaaacctgtaccagagcgctgaggacagctgtggcggcctgtactaccatgacaacaacctgctgagcggcagcctggaggccctgatccagcacctggtgcccaacgtggactactacccagacaggacctacatcttcaccttcctgctgagcagccgcctcttcatgcacccctatgagctgatggccaaggtgtgccacctgtgtgtggagcaccagaggctgagtgaccctgacagcgacaagaaccagatgaggaagatcgcccccaagatcctgcagctgctgacagagtggacagagaccttcccctatgacttcagagatgagaggatgatgaggaacctgaaggacctggcccacagaattgccagcggggaggagcagacctacaggaagaatgtgcagcagatgatgcagtgcctgatcaggaagctggccgccctgagccagtatgaggaggtgctggccaagatcagcagcaccagcacagaccggctgactgtgctgaagaccaagccccagagcatccagagggacatcatcaccgtgtgcaatgacccctacaccctggcccagcagctgacccacatcgagctggagcggctgaactacatcggccctgaggagtttgtgcaggcctttgtgcagaaggaccccctggacaatgacaagagctgctacagcgagaggaagaagaccaggaacctggaggcctacgtggagtggttcaaccggctgagctacctggtggccacagagatctgcatgcctgtgaagaagaagcaccgggccaggatgattgagtacttcattgatgtggcccgggagtgcttcaacatcggcaacttcaacagcctgatggccatcatcagcggcatgaacatgagccctgtgtcccggctgaagaagacctgggccaaggtgaagacagccaagtttgacatcctggagcaccagatggaccccagcagcaacttctacaactacagaacagccctgcggggagctgcccagaggagcctgacagcccacagcagccgggagaagatcgtcatccccttcttcagcctgctgatcaaggacatctacttcctgaatgaaggctgtgccaaccggctgcccaacggccacgtgaactttgagaagttctgggagctggccaagcaggtgtctgagttcatgacctggaagcaggtggagtgcccctttgagcgggacaggaagatcctgcagtacctgctgactgtgcctgtgttttctgaagatgccctgtacctggccagctatgagagcgagggccctgagaaccacatcgagaaggaccgctggaagagcctgcggagcagcctgctgggccgggtgtag

SEQ ID NO: 41807 - DNA, 1296 bp, Artificial Sequence
  Description of Artificial Sequence: Synthetic coding sequence
atgccccagaccccacccttcagcgccatgtttgacagcagcggctacaacagaaacctgtaccagagcgctgaggacagctgtggcggcctgtactaccatgacaacaacctgctgagcggcagcctggaggccctgatccagcacctggtgcccaacgtggactactacccagacaaccagatgaggaagatcgcccccaagatcctgcagctgctgacagagtggacagagaccttcccctatgacttcagagatgagaggatgatgaggaacctgaaggacctggcccaccgcatcgccagcggggaggagacctacaggaagaatgtgcagcagatgatgcagtgcctgatcaggaagctggccgccctgagccagtatgaggaggtgctggccaagatcagcagcaccagcacagaccggctgactgtgctgaagaccaagccccagagcatccagagggacatcatcaccgtgtgcaatgacccctacaccctggcccagcagctgacccacatcgagctggagcggctgaactacatcggccctgaggagtttgtgcaggcctttgtgcagaaggaccccctggacaatgacaagagctgctacagcgagaggaagaagaccaggaacctggaggcctacgtggagtggttcaaccggctgagctacctggtggccacagagatctgcatgcctgtgaagaagaagcaccgggccaggatgattgagtacttcattgatgtggcccgggagtgcttcaacatcggcaacttcaacagcctgatggccatcatcagcggcatgaacatgagccctgtgtcccggctgaagaagacctgggccaaggtgaagacagccaagtttgacatcctggagcaccagatggaccccagcagcaacttctacaactacagaacagccctgcggggagctgcccagaggagcctgacagcccacagcagccgggagaagatcgtcatccccttcttcagcctgctgatcaaggacatctacttcctgaatgaaggctgtgccaaccggctgcccaacggccacgtgaactttgagaagttctgggagctggccaagcaggtgtctgagttcatgacctggaagcaggtggagtgcccctttgagcgggacaggaagatcctgcagtacctgctgactgtgcctgtgttttctgaagatgccctgtacctggccagctatgagagcgagggccctgagaaccacatcgagaaggaccgctggaagagcctgcggagcagcctgctgggccgggtgtag

SEQ ID NO: 41808 - DNA, 633 bp, Artificial Sequence
  Description of Artificial Sequence: Synthetic coding sequence
atgccccagaccccacccttcagcgccatgtttgacagcagcggctacaacagaaacctgtaccagagcgctgaggacagctgtggcggcctgtactaccatgacaacaacctgctgagcggcagcctggaggccctgatccagcacctggtgcccaacgtggactactacccagacaggacctacatcttcaccttcctgctgagcagccgcctcttcatgcacccctatgagctgatggccaaggtgtgccacctgtgtgtggagcaccagaggctgagtgaccctgacagcgacaagaaccagatgaggaagatcgcccccaagatcctgcagctgctgacagagtggacagagaccttcccctatgacttcagagatgagaggatgatgaggaacctgaaggacctggcccacagaattgccagcggggaggaggtgggcaacctgaacctggcccggctgctggagttccctggccgggcctgggtgggcaatggagctgagctgtgcatcctgatcagcacagccagcagcctcttctgcctgtgggccagccccccccaccacatcctggtgtacctggtgtgccaggtgaggatgatcatccccagccacttcaagggcatctag

SEQ ID NO: 41809 - DNA, 633 bp, Artificial Sequence; identical to SEQ ID NO: 41808
  Description of Artificial Sequence: Synthetic coding sequence

SEQ ID NO: 41810 - DNA, 1419 bp, Artificial Sequence
  Description of Artificial Sequence: Synthetic coding sequence
atgccccagaccccacccttcagcgccatgtttgacagcagcggctacaacagaaacctgtaccagagcgctgaggacagctgtggcggcctgtactaccatgacaacaacctgctgagcggcagcctggaggccctgatccagcacctggtgcccaacgtggactactacccagacaggacctacatcttcaccttcctgctgagcagccgcctcttcatgcacccctatgagctgatggccaaggtgtgccacctgtgtgtggagcaccagaggctgagtgaccctgacagcgacaagaaccagatgaggaagatcgcccccaagatcctgcagctgctgacagagtggacagagaccttcccctatgacttcagagatgagaggatgatgaggaacctgaaggacctggcccacagaattgccagcggggaggagacctacaggaagaatgtgcagcagatgatgcagtgcctgatcaggaagctggccgccctgagccagtatgaggaggtgctggccaagatcagcagcaccagcacagaccggctgactgtgctgaagaccaagccccagagcatccagagggacatcatcaccgtgtgcaatgacccctacaccctggcccagcagctgacccacatcgagctggagcggctgaactacatcggccctgaggagtttgtgcaggcctttgtgcagaaggaccccctggacaatgacaagagctgctacagcgagaggaagaagaccaggaacctggaggcctacgtggagtggttcaaccggctgagctacctggtggccacagagatctgcatgcctgtgaagaagaagcaccgggccaggatgattgagtacttcattgatgtggcccgggagtgcttcaacatcggcaacttcaacagcctgatggccatcatcagcggcatgaacatgagccctgtgtcccggctgaagaagacctgggccaaggtgaagacagccaagtttgacatcctggagcaccagatggaccccagcagcaacttctacaactacagaacagccctgcggggggccgcccagaggagcctgacagcccacagcagccgggagaagatcgtcatccccttcttcagcctgctgatcaaggacatctacttcctgaatgaaggctgtgccaaccggctgcccaatggacatgtgaactttgagaagttctgggagctggccaagcaggtgtctgagttcatgacctggaagcaggtggagtgcccctttgagcgggacaggaagatcctgcagtacctgctgactgtgcctgtgttttctgaagatgccctgtacctggccagctatgaaagtgagggccctgagaaccacatcgagaaggaccgctggaagagcctgcggagcagcctgctgggccgggtgtag

SEQ ID NO: 41811 - DNA, 1401 bp, Artificial Sequence
  Description of Artificial Sequence: Synthetic coding sequence
atgccccagaccctgagcgccagtgacatggtgaccccaggcagcctgagccccccacccacagagcccacagatggagagcaggccggccagcccctgctggatggagcccccagcagcgccagcctggagaccctcatccagcacctggtgcccacagctgactactacccagagaaggcctacatcttcaccttcctgctgagcagccgcctcttcatcgagccccgggagctgctggcccgggtgtgccacctgtgcatcgagcagcagcagctggacaagcctgtgctggacaaggcccgggtgaggaagtttggccccaagctgctgcagctgctggccgagtggacagagaccttcccccgggacttccaggaggagagcaccatcggccacctgaaggatgtggtgggcagaattgccccctgtgatgaggcctacaggaagaggatgcaccagctgctgcaggccctgcaccagaagctggccgccctgcggcagggccctgagggcctggtgggcgctgacaagcccatctcctaccgcaccaagcccccagccagcatccaccgggagctgctgggcgtgtgcagcgacccctacaccctggcccagcagctgacccacgtggagctggagcggctgcggcacatcggccctgaggagtttgtgcaggcctttgtgaacaaggaccccctggccagcaccaagccctgcttcagtgacaagaccagcaacctggaggcctacgtgaagtggttcaaccggctgtgctacctggtggccacagagatctgcatgcctgccaagaagaagcagagggcccaggtgattgagttcttcattgatgtggcccgggagtgcttcaacatcggcaacttcaacagcctgatggccatcatcagcggcatgaacatgagccctgtgtcccggctgaagaagacctgggccaaggtgaggacagccaagttcttcatcctggagcaccagatggaccccactggaaacttctgcaactacagaacagccctgcggggggccgcccacaggagcctgacagcccacagcagccgggagaagatcgtcatccccttcttcagcctgctgatcaaggacatctacttcctgaatgaaggctgtgccaaccggctgcccaatggacatgtgaactttgagaagttcctggagctggccaagcaggtgggggagttcatcacctggaagcaggtggagtgcccctttgagcaggatgccagcatcacccactacctgtacacagcccccatcttctctgaagatggcctgtacctggccagctatgaaagtgagagccctgagaaccagacagagaaggagcgctggaaggccctgcggagcagcatcctgggcaagacctag

SEQ ID NO: 41812 - DNA, 1401 bp, Artificial Sequence; identical to SEQ ID NO: 41811
  Description of Artificial Sequence: Synthetic coding sequence

SEQ ID NO: 41813 - DNA, 1170 bp, Artificial Sequence
  Description of Artificial Sequence: Synthetic coding sequence
atgagggtgctggtgcggcgctgctggggcccccccctggcccatggagcccggcggggccggcccagcccccagtggagggccctggcccggctgggctgggaggactgccgggacagccgggtgcgggagaagccaccctggagggtgctcttctttggaacagaccagtttgcccgggaggccctgcgggccctgcacgccgcccgggagaacaaggaggaggagctgattgacaagctggaggtggtgaccatgcccagccccagccccaagggcctgcctgtgaagcagtatgctgtgcagagccagctgcctgtgtatgagtggccagatgtgggcagcggggagtatgatgtgggcgtggtggccagctttggccgcctgctgaatgaggccctgatcctgaagttcccctacggcatcctgaatgtgcaccccagctgcctgccccgctggaggggccctgcccctgtgatccacacagtgctgcatggagacacagtgactggagtgaccatcatgcagatccggcccaagagatttgatgtgggccccatcctgaagcaggagaccgtgcctgtgccccccaagagcacagccaaggagctggaggccgtgctgagccggctgggcgccaacatgctgatctctgtgctgaagaacctgcctgagagcctgagcaatggccggcagcagcccatggagggcgccacctacgcccccaagatctctgctggcaccagctgcatcaagtgggaggagcagaccagcgagcagatcttccggctgtaccgggccatcggcaacatcatccccctgcagaccctgtggatggccaacaccatcaagctgctggacctggtggaggtgaacagctctgtgctggccgaccccaagctgaccggccaggccctgatccctggcagcgtcatctaccacaagcagagccagatcctgctggtgtactgcaaggatggctggattggagtgcgctctgtgatgctgaagaagagcctgacagccacagacttctacaacggctacctgcacccctggtaccagaagaacagccaggcccagcccagccagtgccgcttccagaccctgcggctgcccaccaagaagaagcagaagaagacagtggccatgcagcagtgcatcgagtag

SEQ ID NO: 41814 - DNA, 744 bp, Artificial Sequence
  Description of Artificial Sequence: Synthetic coding sequence
atgagctctgtgtttgggaagccccgggccggcagcggcccccagagcgcccccctggaggtgaacctggccatcctgggcagaagaggagctgggaagtctgaggacacctacagcagcgaggagaccgtggaccaccagcctgtgcacctgcgggtgatggacacagctgacctggacaccccaagaaactgtgagcgctacctgaactgggcccacgccttcctggtggtgtacagcgtggacagccggcagagctttgacagcagcagcagctacctggagctgctggccctgcacgccaaggagacccagaggagcatcccagccctgctgctgggcaacaagctggacatggcccagtaccggcaggtgaccaaggccgagggcgtggccctggccggccgcttcggctgcctcttctttgaggtgtctgcctgcctggactttgagcacgtgcagcacgtgttccacgaggccgtgcgggaggcccggcgggagctggagaagagccccctgacccggcccctcttcatcagcgaggagcgggccctgccccaccaggcccccctgacagcccggcacggcctggccagctgcaccttcaacaccctgagcaccatcaacctgaaggagatgcccaccgtggcccaggccaagctggtgacagtgaagagcagccgggcccagagcaagaggaaggcccccaccctgaccctgctgaagggcttcaagatcttctag

SEQ ID NO: 41815 - DNA, 768 bp, Artificial Sequence
  Description of Artificial Sequence: Synthetic coding sequence
atggtgatcatgggccctgagctggtgggctcctggagcgacttcaagaatgaagctgctgacccccgggccctgactgtgaagttcctgaccaagcgcttcatcagtgaatatgaccccaacctggaggacacctacagcagcgaggagaccgtggaccaccagcctgtgcacctgcgggtgatggacacagctgacctggacaccccaagaaactgtgagcgctacctgaactgggcccacgccttcctggtggtgtacagcgtggacagccggcagagctttgacagcagcagcagctacctggagctgctggccctgcacgccaaggagacccagaggagcatcccagccctgctgctgggcaacaagctggacatggcccagtaccggcaggtgaccaaggccgagggcgtggccctggccggccgcttcggctgcctcttctttgaggtgtctgcctgcctggactttgagcacgtgcagcacgtgttccacgaggccgtgcgggaggcccggcgggagctggagaagagccccctgacccggcccctcttcatcagcgaggagcgggccctgccccaccaggcccccctgacagcccggcacggcctggccagctgcaccttcaacaccctgagcaccatcaacctgaaggagatgcccaccgtggcccaggccaagctggtgacagtgaagagcagccgggcccagagcaagaggaaggcccccaccctgaccctgctgaagggcttcaagatcttctag

SEQ ID NO: 41816 - DNA, 1131 bp, Artificial Sequence
  Description of Artificial Sequence: Synthetic coding sequence
atggccgaggagaggcctggggcctggtttggcttcggcttctgtggcttcggccaggagctgggcagcggccggggccggcaggtgcacagccccagccccctgcgggccggcgtggacatctgccgggtgtctgcctcctggagctacacagcctttgtgacccggggcggccgcctggagctgagcggcagcgccagcggggccgccggccgctgcaaggatgcctgggccagcgagggcctgctggccgtgctgcgggccggccctggccctgaggccctgctgcaggtgtgggccgctgagagcgccctgcggggggagcccctgtgggcccagaatgtggtgcctgaggccgagggggaggatgatcctgctggggaggcccaggccggccgcctgcccctgctgccctgtgcccgggcctacgtgagcccccgggcccccttctaccggcccctggcccctgagctgcgggcccggcagctggagctgggcgctgagcacgccctgctgctggatgctgctggccaggtgttctcctggggcggcggcagacatggccagctgggccacggcaccctggaggccgagctggagccccggctgctggaggccctgcagggcctggtgatggccgaggtggccgccggcggctggcacagcgtgtgtgtgtctgagaccggggacatctacatctggggctggaatgaaagtggccagctggccctgcccaccaggaacctggctgaagatggagaaacagtggcccgggaggccacagagctgaatgaagatggcagccaggtgaagaggactggaggagcagaagatggagccccagcccccttcatcgctgtgcagcccttccctgccctgctggacctgcccatgggcagtgatgctgtgaaggccagctgtggcagccgccacacagctgtggtgaccaggactggagagctgtacacctggggctggggcaagtatggccagctgggccacgaggacaccaccagcctggaccggccccggcgggtggagtactttgtggacaagcagctgcaggtgaaggctgtgacctgtggcccctggaacacctacgtgtatgctgtggagaagggcaagagctag

SEQ ID NO: 41817 - DNA, 1131 bp, Artificial Sequence; identical to SEQ ID NO: 41816
  Description of Artificial Sequence: Synthetic coding sequence

SEQ ID NO: 41818 - DNA, 594 bp, Artificial Sequence
  Description of Artificial Sequence: Synthetic coding sequence
atggaggagaggcctgctgagaccaatgccaacgtggacaacagcgccagccccagcgtggcccagctggccggccgcttccgggagcaggccgctgctgccaaggagaccccagccagcaagcccaccaggaggaagccaccctgcagcctgcccctcttcccccccaaggtggacctgggccagaatggagaggaggccaacctgacctttgatcctgctgccctgctgcccggggccagccccaagagccctggcctgaaggccatggtgagccccttccacagcccccccagcacccccagcagccctggggtgcgcagccggcccagcgaggccgaggaggtgcctgtgtcctttgaccagcccccagagggcagccacctgccctgctacaacaaggtgaggacccggggcagcatcaagagaagaccacccagccgccgcttcagaagaagccagagcgactgtggggagctgggggacttccgggctgtggagagcagccagcagaatggagccaaggaggaggatggagatgaggtgctgcccagcaagagcaaggcccctggcagccccctgagcagcgagtag

SEQ ID NO: 41819 - DNA, 1251 bp, Artificial Sequence
  Description of Artificial Sequence: Synthetic coding sequence
atggaggagaggcctgctgagaccaatgccaacgtggacaacagcgccagccccagcgtggcccagctggccggccgcttccgggagcaggccgctgctgccaaggagaccccagccagcaagcccaccaggaggaagccaccctgcagcctgcccctcttcccccccaaggtggacctgggccagaatggagaggagaagagccccccaaatgccagccacccccccaagttcaaggtgaagagcagccccctcatcgagaagctgcaggccaacctgacctttgatcctgctgccctgctgcccggggccagccccaagagccctggcctgaaggccatggtgagccccttccacagcccccccagcacccccagcagccctggggtgcgcagccggcccagcgaggccgaggaggtgcctgtgtcctttgaccagcccccagagggcagccacctgccctgctacaacaaggtgaggacccggggcagcatcaagagaagaccacccagccgccgcttcagaagaagccagagcgactgtggggagctgggggacttccgggctgtggagagcagccagcagaatggagccaaggaggaggatggagatgaggtgctgcccagcaagagcaaggcccctggcagccccctgagcagcgagggcgccgccggggagggcgtgaggaccctgggccctgctgagaagccacccctgcggcgcagccccagcaggacagagaagcaggaggaggaccgggccacagaggaggccaagaatggagagaaggcccggcgcagcagcgaggaggtggatggccagcacccagcccaggaggaggtgcctgagagcccccagaccagcggccctgaggctgaaaatagatgtggcagcccccgggaggagaagccagctggggaggaggccgagatggagaaggccacagaggtgaagggggagcgggtgcagaatgaggaggtgggccctgagcatgacagccaggagaccaagaagctggaggagggcgctgctgtgaaggagaccccccacagccccccaggaggagtgaagggaggagatgtgcccaagcaggagaagggcaaggagaagcagcaggagggcgctgtgctggagcccggctgcagcccccagacaggccctgcccagctggagaccagcagcgaggtgcagagcgagcctgctgtgcccaagccagaagatgacacccctgtgcaggacaccaagatgtag

SEQ ID NO: 41820 - DNA, 1161 bp, Artificial Sequence
  Description of Artificial Sequence: Synthetic coding sequence
atggaggagaggcctgctgagaccaatgccaacgtggacaacagcgccagccccagcgtggcccagctggccggccgcttccgggagcaggccgctgctgccaaggagaagagccccccaaatgccagccacccccccaagttcaaggtgaagagcagccccctcatcgagaagctgcaggccaacctgacctttgatcctgctgccctgctgcccggggccagccccaagagccctggcctgaaggccatggtgagccccttccacagcccccccagcacccccagcagccctggggtgcgcagccggcccagcgaggccgaggaggtgcctgtgtcctttgaccagcccccagagggcagccacctgccctgctacaacaaggtgaggacccggggcagcatcaagagaagaccacccagccgccgcttcagaagaagccagagcgactgtggggagctgggggacttccgggctgtggagagcagccagcagaatggagccaaggaggaggatggagatgaggtgctgcccagcaagagcaaggcccctggcagccccctgagcagcgagggcgccgccggggagggcgtgaggaccctgggccctgctgagaagccacccctgcggcgcagccccagcaggacagagaagcaggaggaggaccgggccacagaggaggccaagaatggagagaaggcccggcgcagcagcgaggaggtggatggccagcacccagcccaggaggaggtgcctgagagcccccagaccagcggccctgaggctgaaaatagatgtggcagcccccgggaggagaagccagctggggaggaggccgagatggagaaggccacagaggtgaagggggagcgggtgcagaatgaggaggtgggccctgagcatgacagccaggagaccaagaagctggaggagggcgctgctgtgaaggagaccccccacagccccccaggaggagtgaagggaggagatgtgcccaagcaggagaagggcaaggagaagcagcaggagggcgctgtgctggagcccggctgcagcccccagacaggccctgcccagctggagaccagcagcgaggtgcagagcgagcctgctgtgcccaagccagaagatgacacccctgtgcaggacaccaagatgtag

SEQ ID NO: 41821 - DNA, 561 bp, Artificial Sequence
  Description of Artificial Sequence: Synthetic coding sequence
atggagcccacccgggactgccccctgtttggaggagccttcagcgccatcctgcccatgggcgccattgatgtgtctgacctgcggcctgtgcctgacaaccaggaggtgttctgccaccctgtgacagaccagagcctcatcgtggagctgctggagctgcaggcccacgtgcggggggaggccgccgcccgctaccactttgaagatgtgggcggcgtgcagggcgcccgggctgtgcacgtggagagcgtgcagcccctgagcctggagaacctggccctgcggggccgctgccaggaggcctgggtgctgagcggcaagcagcagatcgccaaggagaaccagcaggtggccaaggatgtgaccctgcaccaggccctgctgcggctgccccagtaccagacagacctgctgctgaccttcaaccagcccccaccagacaacagaagcagcctgggccctgagaacctgagccctgccccctggagcctgggggactttgagcagctggtgaccagcctgaccctgcatgaccccaacatcttcggcccccagtag

SEQ ID NO: 41822 - DNA, 870 bp, Artificial Sequence
  Description of Artificial Sequence: Synthetic coding sequence
atgtctgccttcagcgaggccgccctggagaagaagctgtctgagctgagcaacagccagcagagcgtgcagaccctgagcctgtggctgatccaccacaggaagcacagccggcccatcgtgacagtgtgggagcgggagctgaggaaggccaagcccaacaggaagctgaccttcctgtacctggccaatgatgtgatccagaacagcaagaggaaaggacctgagttcaccaaggactttgcccctgtgattgtggaggccttcaagcacgtgagcagcgagacagatgagagctgcaagaagcacctgggccgggtgctgagcatctgggaggagaggtctgtgtatgaaaatgatgtgctggagcagctgaagcaggccctgtatggagacaagaagcccaggaagaggacctatgagcagatcaaggtggatgaaaatgaaaactgcagcagcctgggcagccccagcgagcccccccagaccctggacctggtgcgggccctgcaggacctggagaatgctgccagcggagatgctgctgtgcaccagagaattgccagcctgcctgtggaggtgcaggaggtgtccctgctggacaagatcacagacaaggagagcggggagcggctgagcaagatggtggaggatgcctgcatgctgctggccgactacaacggccgcctggccgctgagattgatgacaggaagcagctgaccaggatgctggccgacttcctgcgctgccagaaggaggccctggccgagaaggagcacaagctggagatcctggacatgggcgtgagcagcaatgatgtggtgaccatcagcatcttcttcctgctgaagatcaacatcaagccctag

SEQ ID NO: 41823 - DNA, 831 bp, Artificial Sequence
  Description of Artificial Sequence: Synthetic coding sequence
atgaggaacagcaactggaggttctgccagacaggcatctacagcaagcccaacaggaagctgaccttcctgtacctggccaatgatgtgatccagaacagcaagaggaaaggacctgagttcaccaaggactttgcccctgtgattgtggaggccttcaagcacgtgagcagcgagacagatgagagctgcaagaagcacctgggccgggtgctgagcatctgggaggagaggtctgtgtatgaaaatgatgtgctggagcagctgaagcaggccctgtatggagacaagaagcccaggaagaggacctatgagcagatcaaggtggatgaaaatgaaaactgcagcagcctgggcagccccagcgagcccccccagaccctggacctggtgcgggccctgcaggacctggagaatgctgccagcggagatgctgctgtgcaccagagaattgccagcctgcctgtggaggtgcaggaggtgtccctgctggacaagatcacagacaaggagagcggggagcggctgagcaagatggtggaggatgcctgcatgctgctggccgactacaacggccgcctggccgctgagattgatgacaggaagcagctgaccaggatgctggccgacttcctgcgctgccagaaggaggccctggccgagaaggagcacaagctggaggagtacaagaggaagctggcccgggtgtccctggtgaggaaggagctgcggagccgcatccagagcctgcctgacctgagccggctgcccaacgtgacaggcagccacatgcacctgccctttgctggggacatctacagtgaagattag

SEQ ID NO: 41824 - DNA, 939 bp, Artificial Sequence
  Description of Artificial Sequence: Synthetic coding sequence
atgtctgccttcagcgaggccgccctggagaagaagctgtctgagctgagcaacagccagcagagcgtgcagaccctgagcctgtggctgatccaccacaggaagcacagccggcccatcgtgacagtgtgggagcgggagctgaggaaggccaagcccaacaggaagctgaccttcctgtacctggccaatgatgtgatccagaacagcaagaggaaaggacctgagttcaccaaggactttgcccctgtgattgtggaggccttcaagcacgtgagcagcgagacagatgagagctgcaagaagcacctgggccgggtgctgagcatctgggaggagaggtctgtgtatgaaaatgatgtgctggagcagctgaagcaggccctgtatggagacaagaagcccaggaagaggacctatgagcagatcaaggtggatgaaaatgaaaactgcagcagcctgggcagccccagcgagcccccccagaccctggacctggtgcgggccctgcaggacctggagaatgctgccagcggagatgctgctgtgcaccagagaattgccagcctgcctgtggaggtgcaggaggtgtccctgctggacaagatcacagacaaggagagcggggagcggctgagcaagatggtggaggatgcctgcatgctgctggccgactacaacggccgcctggccgctgagattgatgacaggaagcagctgaccaggatgctggccgacttcctgcgctgccagaaggaggccctggccgagaaggagcacaagctggaggagtacaagaggaagctggcccgggtgtccctggtgaggaaggagctgcggagccgcatccagagcctgcctgacctgagccggctgcccaacgtgacaggcagccacatgcacctgccctttgctggggacatctacagtgaagattag

SEQ ID NO: 41825 - DNA, 939 bp, Artificial Sequence; identical to SEQ ID NO: 41824
  Description of Artificial Sequence: Synthetic coding sequence

SEQ ID NO: 41826 - DNA, 981 bp, Artificial Sequence
  Description of Artificial Sequence: Synthetic coding sequence
atgagcagcttcagcgagagcgccctggagaagaagctgtctgagctgagcaacagccagcagagcgtgcagaccctgagcctgtggctgatccaccacaggaagcatgctggccccatcgtgtctgtgtggcaccgggagctgaggaaggccaagagcaacaggaagctgaccttcctgtacctggccaatgatgtgatccagaacagcaagaggaaaggacctgagttcacccgggagtttgaatctgtgctggtggatgccttcagccacgtggcccgggaggctgatgagggctgcaagaagcccctggagcggctgctgaacatctggcaggagaggtctgtgtatggaggagagttcatccagcagctgaagctgtccatggaggacagcaagagccccccacccaaggccacagaggagaagaagagcctgaagaggaccttccagcagatccaggaggaggaggatgatgactacccaggcagctacagcccccaggaccccagcgctggccccctgctgacagaggagctgatcaaggccctgcaggacctggagaatgctgccagcggagatgccaccgtgcggcagaagatcgccagcctgccccaggaggtgcaggatgtgtccctgctggagaagatcacagacaaggaggccgctgagcggctgagcaagacagtggatgaggcctgcctgctgctggccgagtacaacggccgcctggccgctgagctggaggaccggcggcagctggccaggatgctggtggagtacacccagaaccagaaggatgtgctgtctgagaaggagaagaagctggaggagtacaagcagaagctggcccgggtgacccaggtgaggaaggagctgaagagccacatccagagcctgcctgacctgagcctgctgcccaacgtgactggaggcctggcccccctgcccagcgctggggacctcttcagcacagactag

SEQ ID NO: 41827 - DNA, 459 bp, Artificial Sequence
  Description of Artificial Sequence: Synthetic coding sequence
atggctgctgggggcggcggcggcagcagcaaggccagcagcagcagcgccagcagcgctggggccctggagagcagcctggacaggaagttccagagcgtgaccaacaccatggagagcatccagggcctgagctcctggtgcatcgagaacaagaagcaccacagcaccatcgtgtaccactggatgaagtggctgcggcgcagcgcctacccccaccggctgaacctcttctacctggccaatgatgtgatccagaactgcaagaggaagaatgccatcatcttccgggagagctttgctgatgtgctgcctgaggccgccgccctggtgaaggaccccagcgtgtccaagtctgtggagcgcatcttcaagatctgggaggacagaaatgtgtacccagaggagatgattgtggccctgcgggaggccctgagcaaatgtctcttcctgtcctag

SEQ ID NO: 41828 - DNA, 4386 bp, Artificial Sequence
  Description of Artificial Sequence: Synthetic coding sequence
atggctgctgggggcggcggcggcagcagcaaggccagcagcagcagcgccagcagcgctggggccctggagagcagcctggacaggaagttccagagcgtgaccaacaccatggagagcatccagggcctgagctcctggtgcatcgagaacaagaagcaccacagcaccatcgtgtaccactggatgaagtggctgcggcgcagcgcctacccccaccggctgaacctcttctacctggccaatgatgtgatccagaactgcaagaggaagaatgccatcatcttccgggagagctttgctgatgtgctgcctgaggccgccgccctggtgaaggaccccagcgtgtccaagtctgtggagcgcatcttcaagatctgggaggacagaaatgtgtacccagaggagatgattgtggccctgcgggaggccctgagcaccaccttcaagacccagaagcagctgaaggagaacctgaacaagcagcccaacaagcagtggaagaagagccagaccagcaccaaccccaaggccgccctgaagagcaagatcgtggccgagttccgcagccaggccctgattgaggagctgctgctgtacaagaggtctgaggaccagatcgagctgaaggagaagcagctgagcaccatgagggtggatgtgtgcagcacagagaccctgaagtgcctgaaggacaagacaggaggcaagaagttcagcaaggagtttgaggaggccagcagcaagctggaggagtttgtgaatggcctggacaagcaggtgaagaatggccccagcctgacagaggccctggagaatgccggcatcttctatgaggcccagtacaaggaggtgaaggtggtggccaatgcctacaagacctttgccaacagagtgaacaacctgaagaagaagctggaccagctgaagagcaccctgcctgaccctgaggagagccctgtgcccagccccagcatggatgcccccagccccaccggcagcgagagccccttccagggcatgggcggggaggagagccagagccccaccatggagagcgagaagagcgccaccccagagcctgtgacagacaacagagatgtggaggacatggagctgagtgatgtggaggatgatggcagcaagatcatcgtggaggacaggaaggagaagccagctgagaagtctgctgtgtccacctctgtgcccaccaagcccacagagaacatcagcaaggccagcagctgcacccctgtgcctgtgaccatgacagccaccccacccctgcccaagcctgtgaacaccagcctgagccccagccctgccctggccctgcccaacctggccaacgtggacctggccaagatcagcagcatcctgagcagcctgacctctgtgatgaagaacacaggagtgtccccagccagccggcccagccctggcacccccaccagccccagcaacctgaccagcggcctgaagaccccagccccagccaccaccaccagccacaaccccctggccaacatcctgagcaaggtggagatcaccccagagagcatcctgagcgccctgagcaagacccagacccagagcgccccagccctgcagggcctgagcagcctgctgcagagcgtgactggaaatcctgtgcctgccagcgaggccgccagccagagcaccagcgccagccctgccaacaccaccgtgtccaccatcaagggcaggaacctgcccagcagcgcccagcccttcatccccaagagcttcaactacagccccaacagcagcaccagcgaggtgagcagcaccagcgccagcaaggccagcatcggccagagccctggcctgcccagcaccaccttcaagctgcccagcaacagcctgggcttcaccgccacccacaacaccagccctgctgccccacccacagaggtgaccatctgccagagcagcgaggtgtccaagcccaagctggagagcgagagcaccagccccagcctggagatgaagatccacaacttcctgaagggcaaccctggcttcagcggcctgaacctgaacatccccatcctgagcagcctgggcagcagcgcccccagcgagagccaccccagcgacttccagaggggccccaccagcaccagcattgacaacattgatggcacccctgtgagagatgagaggagcggcacccccacccaggatgagatgatggacaagcccaccagcagctctgtggacaccatgagcctgctgagcaagatcatcagccctggcagcagcacccccagcagcaccaggagccccccacctggaagagatgagagctacccccgggagctgagcaacagcgtgtccacctaccggcccttcggcctgggcagcgagagcccctacaagcagcccagtgatggcatggagcggcccagcagcctgatggacagcagccaggagaagttctacccagacaccagcttccaggaggatgaggactacagagactttgagtacagcggccccccacccagcgccatgatgaacctggagaagaagccagccaagagcatcctgaagagcagcaagctgagtgacaccacagagtaccagcccatcctgagcagctacagccaccgggcccaggagtttggagtgaagagcgccttcccccccagcgtgcgggccctgctggacagcagcgagaactgtgaccggctgagcagcagccctggcctgtttggagccttctctgtgagaggaaatgaacctggcagtgacaggagccccagccccagcaagaatgacagcttcttcaccccagacagcaaccacaacagcctgagccagagcaccaccggccacctgagcctgccccagaagcagtacccagacagcccccaccctgtgccccacaggagcctcttcagcccccagaacaccctggccgcccccaccggccacccccccaccagcggcgtggagaaggtgctggccagcaccatcagcaccaccagcaccatcgagttcaagaacatgctgaagaatgccagcaggaagcccagtgatgacaagcacttcggccaggcccccagcaagggcacccccagtgatggagtgtccctgagcaacctgacccagcccagcctgacagccacagaccagcagcagcaggaggagcactacagaattgagaccagggtgagcagcagctgcctggacctgcctgacagcacagaggagaagggggcccccatcgagaccctgggctaccacagcgccagcaacagaaggatgtctggagagcccatccagacagtggagagcatccgggtgcctgggaagggcaacagaggacatggccgggaggccagccgggtgggctggtttgacctgagcaccagcggcagcagctttgacaatggccccagcagcgccagcgagctggccagcctgggcggcggcggcagcggcggcctgaccggcttcaagacagccccctacaaggagcgggccccccagttccaggagagcgtgggcagcttccgcagcaacagcttcaacagcacctttgagcaccacctgccccccagccccctggagcacggcacccccttccagcgggagcctgtgggccccagcagcgcccctcctgtgccccccaaggaccatggaggcatcttcagcagagatgcccccacccacctgcccagcgtggacctgagcaaccccttcaccaaggaggccgccctggcccatgctgcccctcctcctcctcctggagagcacagcggcatccccttccccaccccacctcctcctcctcctcctggagagcacagcagcagcggcggcagcggcgtgcccttcagcaccccacctcctcctcctcctcctgtggaccacagcggcgtggtgcccttccctgccccacccctggccgagcacggcgtggccggggctgtggccgtgttccccaaggaccacagcagcctgctgcagggcaccctggccgagcactttggagtgctgcccggcccccgggaccatggaggccccacccagagggacctgaatggacctggcctgagccgggtgcgggagagcctgaccctgcccagccacagcctggagcacctgggcccccctcatggaggcggcggcggcggcggcagcaacagcagcagcggcccccccctgggccccagccaccgggacaccatcagccgcagcggcatcatcctgcggagccccaggccagacttccggccccgggagcccttcctgagccgggaccccttccacagcctgaagaggccccggcccccatttgcccggggcccccccttctttgcccccaagaggcccttcttccccccacgctactag

SEQ ID NO: 41829 - DNA, 4308 bp, Artificial Sequence
  Description of Artificial Sequence: Synthetic coding sequence
atggctgctgggggcggcggcggcagcagcaaggccagcagcagcagcgccagcagcgctggggccctggagagcagcctggacaggaagttccagagcgtgaccaacaccatggagagcatccagggcctgagctcctggtgcatcgagaacaagaagcaccacagcaccatcgtgtaccactggatgaagtggctgcggcgcagcgcctacccccaccggctgaacctcttctacctggccaatgatgtgatccagaactgcaagaggaagaatgccatcatcttccgggagagctttgctgatgtgctgcctgaggccgccgccctggtgaaggaccccagcgtgtccaagtctgtggagcgcatcttcaagatctgggaggacagaaatgtgtacccagaggagatgattgtggccctgcgggaggccctgaccagcaccaaccccaaggccgccctgaagagcaagatcgtggccgagttccgcagccaggccctgattgaggagctgctgctgtacaagaggtctgaggaccagatcgagctgaaggagaagcagctgagcaccatgagggtggatgtgtgcagcacagagaccctgaagtgcctgaaggacaagacaggaggcaagaagttcagcaaggagtttgaggaggccagcagcaagctggaggagtttgtgaatggcctggacaagcaggtgaagaatggccccagcctgacagaggccctggagaatgccggcatcttctatgaggcccagtacaaggaggtgaaggtggtggccaatgcctacaagacctttgccaacagagtgaacaacctgaagaagaagctggaccagctgaagagcaccctgcctgaccctgaggagagccctgtgcccagccccagcatggatgcccccagccccaccggcagcgagagccccttccagggcatgggcggggaggagagccagagccccaccatggagagcgagaagagcgccaccccagagcctgtgacagacaacagagatgtggaggacatggagctgagtgatgtggaggatgatggcagcaagatcatcgtggaggacaggaaggagaagccagctgagaagtctgctgtgtccacctctgtgcccaccaagcccacagagaacatcagcaaggccagcagctgcacccctgtgcctgtgaccatgacagccaccccacccctgcccaagcctgtgaacaccagcctgagccccagccctgccctggccctgcccaacctggccaacgtggacctggccaagatcagcagcatcctgagcagcctgacctctgtgatgaagaacacaggagtgtccccagccagccggcccagccctggcacccccaccagccccagcaacctgaccagcggcctgaagaccccagccccagccaccaccaccagccacaaccccctggccaacatcctgagcaaggtggagatcaccccagagagcatcctgagcgccctgagcaagacccagacccagagcgccccagccctgcagggcctgagcagcctgctgcagagcgtgactggaaatcctgtgcctgccagcgaggccgccagccagagcaccagcgccagccctgccaacaccaccgtgtccaccatcaagggcaggaacctgcccagcagcgcccagcccttcatccccaagagcttcaactacagccccaacagcagcaccagcgaggtgagcagcaccagcgccagcaaggccagcatcggccagagccctggcctgcccagcaccaccttcaagctgcccagcaacagcctgggcttcaccgccacccacaacaccagccctgctgccccacccacagaggtgaccatctgccagagcagcgaggtgtccaagcccaagctggagagcgagagcaccagccccagcctggagatgaagatccacaacttcctgaagggcaaccctggcttcagcggcctgaacctgaacatccccatcctgagcagcctgggcagcagcgcccccagcgagagccaccccagcgacttccagaggggccccaccagcaccagcattgacaacattgatggcacccctgtgagagatgagaggagcggcacccccacccaggatgagatgatggacaagcccaccagcagctctgtggacaccatgagcctgctgagcaagatcatcagccctggcagcagcacccccagcagcaccaggagccccccacctggaagagatgagagctacccccgggagctgagcaacagcgtgtccacctaccggcccttcggcctgggcagcgagagcccctacaagcagcccagtgatggcatggagcggcccagcagcctgatggacagcagccaggagaagttctacccagacaccagcttccaggaggatgaggactacagagactttgagtacagcggccccccacccagcgccatgatgaacctggagaagaagccagccaagagcatcctgaagagcagcaagctgagtgacaccacagagtaccagcccatcctgagcagctacagccaccgggcccaggagtttggagtgaagagcgccttcccccccagcgtgcgggccctgctggacagcagcgagaactgtgaccggctgagcagcagccctggcctgtttggagccttctctgtgagaggaaatgaacctggcagtgacaggagccccagccccagcaagaatgacagcttcttcaccccagacagcaaccacaacagcctgagccagagcaccaccggccacctgagcctgccccagaagcagtacccagacagcccccaccctgtgccccacaggagcctcttcagcccccagaacaccctggccgcccccaccggccacccccccaccagcggcgtggagaaggtgctggccagcaccatcagcaccaccagcaccatcgagttcaagaacatgctgaagaatgccagcaggaagcccagtgatgacaagcacttcggccaggcccccagcaagggcacccccagtgatggagtgtccctgagcaacctgacccagcccagcctgacagccacagaccagcagcagcaggaggagcactacagaattgagaccagggtgagcagcagctgcctggacctgcctgacagcacagaggagaagggggcccccatcgagaccctgggctaccacagcgccagcaacagaaggatgtctggagagcccatccagacagtggagagcatccgggtgcctgggaagggcaacagaggacatggccgggaggccagccgggtgggctggtttgacctgagcaccagcggcagcagctttgacaatggccccagcagcgccagcgagctggccagcctgggcggcggcggcagcggcggcctgaccggcttcaagacagccccctacaaggagcgggccccccagttccaggagagcgtgggcagcttccgcagcaacagcttcaacagcacctttgagcaccacctgccccccagccccctggagcacggcacccccttccagcgggagcctgtgggccccagcagcgcccctcctgtgccccccaaggaccatggaggcatcttcagcagagatgcccccacccacctgcccagcgtggacctgagcaaccccttcaccaaggaggccgccctggcccatgctgcccctcctcctcctcctggagagcacagcggcatccccttccccaccccacctcctcctcctcctcctggagagcacagcagcagcggcggcagcggcgtgcccttcagcaccccacctcctcctcctcctcctgtggaccacagcggcgtggtgcccttccctgccccacccctggccgagcacggcgtggccggggctgtggccgtgttccccaaggaccacagcagcctgctgcagggcaccctggccgagcactttggagtgctgcccggcccccgggaccatggaggccccacccagagggacctgaatggacctggcctgagccgggtgcgggagagcctgaccctgcccagccacagcctggagcacctgggcccccctcatggaggcggcggcggcggcggcagcaacagcagcagcggcccccccctgggccccagccaccgggacaccatcagccgcagcggcatcatcctgcggagccccaggccagacttccggccccgggagcccttcctgagccgggaccccttccacagcctgaagaggccccggcccccatttgcccggggcccccccttctttgcccccaagaggcccttcttccccccacgctactag

SEQ ID NO: 41830 - DNA, 2805 bp, Artificial Sequence
  Description of Artificial Sequence: Synthetic coding sequence
atggctgctgggggcggcggcggcagcagcaaggccagcagcagcagcgccagcagcgctggggccctggagagcagcctggacaggaagttccagagcgtgaccaacaccatggagagcatccagggcctgagctcctggtgcatcgagaacaagaagcaccacagcaccatcgtgtaccactggatgaagtggctgcggcgcagcgcctacccccaccggctgaacctcttctacctggccaatgatgtgatccagaactgcaagaggaagaatgccatcatcttccgggagagctttgctgatgtgctgcctgaggccgccgccctggtgaaggaccccagcgtgtccaagtctgtggagcgcatcttcaagatctgggaggacagaaatgtgtacccagaggagatgattgtggccctgcgggaggccctgaccagcaccaaccccaaggccgccctgaagagcaagatcgtggccgagttccgcagccaggccctgattgaggagctgctgctgtacaagaggtctgaggaccagatcgagctgaaggagaagcagctgagcaccatgagggtggatgtgtgcagcacagagaccctgaagtgcctgaaggacaagacaggaggcaagaagttcagcaaggagtttgaggaggccagcagcaagctggaggagtttgtgaatggcctggacaagcaggtgaagaatggccccagcctgacagaggccctggagaatgccggcatcttctatgaggcccagtacaaggaggtgaaggtggtggccaatgcctacaagacctttgccaacagagtgaacaacctgaagaagaagctggaccagctgaagagcaccctgcctgaccctgaggagagccctgtgcccagccccagcatggatgcccccagccccaccggcagcgagagccccttccagggcatgggcggggaggagagccagagccccaccatggagagcgagaagagcgccaccccagagcctgtgacagacaacagagatgtggaggacatggagctgagtgatgtggaggatgatggcagcaagatcatcgtggaggacaggaaggagaagccagctgagaagtctgctgtgtccacctctgtgcccaccaagcccacagagaacatcagcaaggccagcagctgcacccctgtgcctgtgaccatgacagccaccccacccctgcccaagcctgtgaacaccagcctgagccccagccctgccctggccctgcccaacctggccaacgtggacctggccaagatcagcagcatcctgagcagcctgacctctgtgatgaagaacacaggagtgtccccagccagccggcccagccctggcacccccaccagccccagcaacctgaccagcggcctgaagaccccagccccagccaccaccaccagccacaaccccctggccaacatcctgagcaaggtggagatcaccccagagagcatcctgagcgccctgagcaagacccagacccagagcgccccagccctgcagggcctgagcagcctgctgcagagcgtgactggaaatcctgtgcctgccagcgaggccgccagccagagcaccagcgccagccctgccaacaccaccgtgtccaccatcaagggcaggaacctgcccagcagcgcccagcccttcatccccaagagcttcaactacagccccaacagcagcaccagcgaggtgagcagcaccagcgccagcaaggccagcatcggccagagccctggcctgcccagcaccaccttcaagctgcccagcaacagcctgggcttcaccgccacccacaacaccagccctgctgccccacccacagaggtgaccatctgccagagcagcgaggtgtccaagcccaagctggagagcgagagcaccagccccagcctggagatgaagatccacaacttcctgaagggcaaccctggcttcagcggcctgaacctgaacatccccatcctgagcagcctgggcagcagcgcccccagcgagagccaccccagcgacttccagaggggccccaccagcaccagcattgacaacattgatggcacccctgtgagagatgagaggagcggcacccccacccaggatgagatgatggacaagcccaccagcagctctgtggacaccatgagcctgctgagcaagatcatcagccctggcagcagcacccccagcagcaccaggagccccccacctggaagagatgagagctacccccgggagctgagcaacagcgtgtccacctaccggcccttcggcctgggcagcgagagcccctacaagcagcccagtgatggcatggagcggcccagcagcctgatggacagcagccaggagaagttctacccagacaccagcttccaggaggatgaggactacagagactttgagtacagcggccccccacccagcgccatgatgaacctggagaagaagccagccaagagcatcctgaagagcagcaagctgagtgacaccacagagtaccagcccatcctgagcagctacagccaccgggcccaggagtttggagtgaagagcgccttcccccccagcgtgcgggccctgctggacagcagcgagaactgtgaccggctgagcagcagccctggcctgtttggagccttctctgtgagaggaaatgaacctggcagtgacaggagccccagccccaagcacccctgccgcagccacggcagccccacccacgtgagaagaggagagagccctggcctgcaccacttccaccacgtggatgactag

SEQ ID NO: 41831 - DNA, 3231 bp, Artificial Sequence
  Description of Artificial Sequence: Synthetic coding sequence
atgagcagcgctgagatcatcggcagcaccaacctgatcatcctgctggaggatgaggtgtttgctgacttcttcaacaccttcctgagcctgcctgtgtttggccagacccccttctacacagtggagaacagccagtggagcctgtggccagagatcccctgcaacctgattgccaagtacaagggcctgctgacctggctggagaagtgccgcctgcccttcttctgcaagaccaacctgtgcttccactacatcctgtgccaggagttcatctccttcatcaagagccctgagggcggggaggagctggtggacttctggatcctggccgagaacatcctgagcattgatgagatggacctggaggtgcgggactactacctgagcctgctgctgatgctgcgggccacccacctgcaggagggcagccgggtggtgaccctgtgcaacatgaacatcaagagcctgctgaacctgagcatctggcaccccaaccagagcaccacccggcgggagatcctgagccacatgcagaaggtggccctcttcaagctgcagagctactggctgcccaacttctacacccacaccaagatgaccatggccaaggaggaggcctgccacggcctgatgcaggagtatgagacccggctgtacagcgtgtgctacacccacatcggcggcctgcccctgaacatgagcatcaagaagtgccaccacttccagaagcgctacagcagcaggaaggccaagaggaagatgtggcagctggtggaccctgacagctggagcctggagatggacctgaagccagatgccatcggcatgcccctgcaggagacctgcccccaggagaaggtggtgatccagatgcccagcctgaagatggccagcagcaaggagacccgcatcagcagcctggagaaggacatgcactacgccaagatcagctccatggagaacaaggccaagagccacctgcacatggaggccccctttgagaccaaggtgtccacccacctgaggacagtcatccccatcgtgaaccacagcagcaagatgaccatccagaaggccatcaagcagagcttcagcctgggctacatccacctggccctgtgtgctgatgcctgtgccggcaaccccttccgggaccacctgaagaagctgaacctgaaggtggagatccagctgctggacctgtggcaggacctgcagcacttcctgtctgtgctgctgaacaacaagaagaatggaaatgccatcttccgccacctgctgggggaccgcatctgtgagctgtacctgaatgagcagatcggcccctgcctgcccctgaagagccagaccatccagggcctgaaggagctgctgcccagcggagatgtgatcccctggatccccaaggcccagaaggagatctgcaagatgctgagcccctggtatgatgagttcctggatgaggaggactactggttcctgctcttcaccacccagaaccgcttcatcagcagccggcagcacaagcgggagttcatcggcaaggaggagaacatcctgctgtacaagaggatccagcagagcctggagctgagccaggccctggccgacatgaaggagatggactaccggcagtggaggaagatcgccacagaggacctgaagcagggcggcagcctgcaggtggagctgaccagccctgtgttcctgacagacatcaccaagatgagctttgaggagctgtgctacaagaaccccaagatggccatccagaagatcagtgatgactacaagatctactgtgagaaggcccccaagattgacttcaagatggagatcatcaaggagaccaagacagtgagccgcagcaacaggaagatgagcctgctgaagaggaccctggtgaggaagcccagcatgaggcccaggaacctgacagaggtgctgctgaacacccagcacctggagttcttccgggagttcctgaaggagaggaaggccaagatccccctgcagttcctgacagctgtgcagaagatcagcattgagaccaatgagaagatctgcaagagcctgattgaaaatgtcatcaagaccttcttccagggccagctgagccctgaggagatgctgcagtgtgatgcccccatcatcaaggagatcgcctccatgagacatgtgaccaccagcaccctgctgaccctgcagggccacgtgatgaagagcattgaggagaagtggttcaaggactaccaggacctcttccccccccaccaccaggaggtggaggtgcagagcgaggtgcagatcagcagcaggaagcccagcaagatcgtgtccacctacctgcaggagagccagaagaagggctggatgaggatgatctccttcatccgctccttctgcaagtaccgccgcttcatgctgaaccccagcaagaggcaggagtttgaggactacctgcaccaggagatgcagaacagcaaagaaaacttcaccacagcccacaacaccagcggccgcagcgccccacccagcaccaacgtgcgctctgctgaccaggagaatggagagatcaccctggtgaagaggcgcatcttcggccaccgcatcatcaccgtgaactttgccatcaatgacctgtacttcttcagcgagatggagaagttcaatgacctggtgtcctctgcccacatgctgcaggtgaacagagcctacaatgaaaatgatgtgatcctgatgaggagcaagatgaacatcatccagaagctgttcctgaacagcgacatcccccccaagctgcgggtgaatgtgcctgagttccagaaggatgccatcctggccgccatcacagagggctacctggacagatctgtgttccacggggccatcatgtctgtgtttcctgtggtgatgtacttctggaagcgcttctgcttctggaaggccaccaggagctacctgcagtaccggggcaagaagttcaaggacaggaagagcccccccaagagcacagacaagtaccccttcagcagtggaggagacaatgccatcctgcgcttcaccctgctgcggggcatcgagtggctgcagccccagcgggaggccatcagctctgtgcagaacagcagcagcagcaagctgacccagccccggctggtggtgtctgccatgcagctgcaccctgtgcagggccagaagctgagctacatcaagaaggagaagtag

SEQ ID NO: 41832 - DNA, 309 bp, Artificial Sequence
  Description of Artificial Sequence: Synthetic coding sequence
atgctgtctgtgagaagagtgtctgaggacatctgcagccgcatctatgagagcgcccagagaattgacagcatcaccttcctgcccagcagcggcttccacctgaagtggaagatccagaccagaattgccaatgagaagtacctgcggacccacaaggaggtggagtggctgatcagcggcttcttccgggagatcttcctgaagaggccagacaacatcctggagtttgctgctgactacttcacagacccccggctgcccaacaagatccacatgcagctgatcaaggacaagaaggccgcctag

SEQ ID NO: 41833 - DNA, 1176 bp, Artificial Sequence
  Description of Artificial Sequence: Synthetic coding sequence
atggaccagtgtgtgacagtggagcgggagctggagaaggtgctgcacaagttcagcggctacggccagctgtgtgagcggggcctggaggagctgattgactacacaggaggcctgaagcatgagatcctgcagagccacggccaggatgctgagctgagcggcaccctgagcctggtgctgacccagtgctgcaagaggatcaaggacacagtgcagaagctggccagtgaccacaaggacatccacagctctgtgtcccgggtgggcaaggccatcgacaagaactttgacagcgacatcagctctgtgggcattgatggctgctggcaggccgacagccagaggctgctgaatgaggtgatggtggagcacttcttccggcagggcatgctggatgtggccgaggagctgtgccaggagagcggcctgtctgtggaccccagccagaaggagccctttgtggagctgaaccgcatcctggaggccctgaaggtgcgggtgctgcggcctgccctggagtgggccgtgagcaaccgggagatgctgattgcccagaacagcagcctggagttcaagctgcaccggctgtacttcatcagcctgctgatgggcggcaccaccaaccagcgggaggccctgcagtatgccaagaacttccagccctttgccctgaaccaccagaaggacatccaggtgctgatgggcagcctggtgtacctgcggcagggcatcgagaacagcccctacgtgcacctgctggatgccaaccagtgggccgacatctgtgacatcttcaccagagatgcctgtgccctgctgggcctgtctgtggagagccccctgtctgtgtccttctctgctggctgtgtggccctgcctgccctgatcaacatcaaggctgtgattgagcagaggcagtgcacaggagtgtggaaccagaaggatgagctgcccatcgaggtggacctgggcaagaagtgctggtaccacagcatctttgcctgccccatcctgcggcagcagaccacagacaacaacccccccatgaagctggtgtgtggccacatcatcagcagagatgccctgaacaagatgttcaacggcagcaagctgaagtgcccctactgccccatggagcagagccctggagatgccaagcagatcttcttctag

SEQ ID NO: 41834 - DNA, 1182 bp, Artificial Sequence
  Description of Artificial Sequence: Synthetic coding sequence
atggagcagtgtgcctgtgtggagcgggagctggacaaggtgctgcagaagttcctgacctacggccagcactgtgagaggagcctggaggagctgctgcactacgtgggccagctgcgggcagagctggccagcgctgccctgcagggcacccccctgagcgccaccctgagcctggtgatgagccagtgctgcaggaagatcaaggacacagtgcagaagctggccagtgaccacaaggacatccacagctctgtgtcccgggtgggcaaggccatcgacaggaactttgattctgagatctgtggggtggtgtctgatgctgtgtgggatgcccgggagcagcagcagcagatcctgcagatggccatcgtggagcacctgtaccagcagggcatgctgtctgtggccgaggagctgtgccaggagagcaccctgaatgtggacctggacttcaagcagcccttcctggagctgaaccgcatcctggaggccctgcacgagcaggacctgggccctgccctggagtgggccgtgagccaccggcagaggctgctggagctgaacagcagcctggagttcaagctgcaccggctgcacttcatccggctgctggccggcggccctgccaagcagctggaggccctgtcctatgcccggcacttccagccctttgcccggctgcaccagcgggagatccaggtgatgatgggcagcctggtgtacctgcggctgggcctggagaagagcccctactgccacctgctggacagcagccactgggccgagatctgtgagaccttcaccagagatgcctgcagcctgctgggcctgtctgtggagagccccctgtctgtgtcctttgccagcggctgtgtggccctgcctgtgctgatgaacatcaaggctgtgattgagcagaggcagtgcacaggagtgtggaaccacaaggatgagctgcccatcgagattgagctgggcatgaagtgctggtaccacagcgtgtttgcctgccccatcctgcggcagcagaccagtgacagcaacccccccatcaagctgatctgtggccacgtgatcagcagagatgccctgaacaagctgatcaatggaggcaagctgaagtgcccctactgccccatggagcagaacccagcagatggcaagaggatcatcttctag

SEQ ID NO: 41835 - DNA, 345 bp, Artificial Sequence
  Description of Artificial Sequence: Synthetic coding sequence
atggagcagtgtgcctgtgtggagcgggagctggacaaggtgctgcagaagttcctgacctacggccagcactgtgagaggagcctggaggagctgctgcactacgtgggccagctgcgggcagagctggccagcgctgccctgcagggcacccccctgagcgccaccctgagcctggtgatgagccagtgctgcaggaagatcaaggacacagtgcagaagctggccagtgaccacaaggacatccacagctctgtgtcccgggtgggcaaggccatcgacaggaactttgattctgagatctgtggggtggtgtctgatgctgtgtgggatgcccgggagtag

SEQ ID NO: 41836 - DNA, 447 bp, Artificial Sequence
  Description of Artificial Sequence: Synthetic coding sequence
atggagcagtgtgcctgtgtggagcgggagctggacaaggtgctgcagaagttcctgacctacggccagcactgtgagaggagcctggaggagctgctgcactacgtgggccagctgcgggcagagctggccagcgctgccctgcagggcacccccctgagcgccaccctgagcctggtgatgagccagtgctgcaggaagatcaaggacacagtgcagaagctggccagtgaccacaaggacatccacagctctgtgtcccgggtgggcaaggccatcgacaggaactttgattctgagatctgtggggtggtgtctgatgctgtgtgggatgcccgggagcagcagcagcagatcctgcagatggccatcgtggagcacctgtaccagcagggcatgctgtctgtggccgaggagctgtgccaggagagcaccctgaatgtgtag

SEQ ID NO: 41837 - DNA, 174 bp, Artificial Sequence
  Description of Artificial Sequence: Synthetic coding sequence
atggagcagtgtgcctgtgtggagcgggagctggacaaggtgctgcagaagttcctgacctacggccagcactgtgagaggagcctggaggagctgctgcactacgtgggccagctgcgggcagagctggccagcgctgccctgcagggcacccccctgagcgccaccctgtag

SEQ ID NO: 41838 - DNA, 1182 bp, Artificial Sequence; identical to SEQ ID NO: 41834
  Description of Artificial Sequence: Synthetic coding sequence

SEQ ID NO: 41839 - DNA, 1143 bp, Artificial Sequence
  Description of Artificial Sequence: Synthetic coding sequence
atggctgactgcagcctggacctgcccggcagcagcagcccccccagccacctgagcctgctgcgctcctgggaccacagaagagtgcccccctgcccagccctgcagggcacccccctgagcgccaccctgagcctggtgatgagccagtgctgcaggaagatcaaggacacagtgcagaagctggccagtgaccacaaggacatccacagctctgtgtcccgggtgggcaaggccatcgacaggaactttgacagcgagatctgtggggtggtgtctgatgctgtgtgggatgcccgggagcagcagcagcagatcctgcagatggccatcgtggagcacctgtaccagcagggcatgctgtctgtggccgaggagctgtgccaggagagcaccctgaatgtggacctggacttcaagcagcccttcctggagctgaaccgcatcctggaggccctgcacgagcaggacctgggccctgccctggagtgggccgtgagccaccggcagaggctgctggagctgaacagcagcctggagttcaagctgcaccggctgcacttcatccggctgctggccggcggccctgccaagcagctggaggccctgtcctatgcccggcacttccagccctttgcccggctgcaccagcgggagatccaggtgatgatgggcagcctggtgtacctgcggctgggcctggagaagagcccctactgccacctgctggacagcagccactgggccgagatctgtgagaccttcaccagagatgcctgcagcctgctgggcctgtctgtggagagccccctgtctgtgtcctttgccagcggctgtgtggccctgcctgtgctgatgaacatcaaggccgtcatcgagcagaggcagtgcaccggggtgtggaaccacaaggatgagctgcccattgaaattgagctgggcatgaagtgctggtaccacagcgtgtttgcctgccccatcctgcggcagcagaccagtgacagcaacccccccatcaagctgatctgtggccacgtgatcagcagagatgccctgaacaagctgatcaatggaggcaagctgaagtgcccctactgccccatggagcagaacccagcagatggcaagaggatcatcttctag

SEQ ID NO: 41840 - DNA, 804 bp, Artificial Sequence
  Description of Artificial Sequence: Synthetic coding sequence
atggtgctgggcaacagccacctgttcatgaacagaagcaacaagctggccgtgattgccagccacatccaggagagccgcttcctgtacccaggcaagaatggccgcctgggggacttctttggagaccccggcaaccccccagagttcaaccccagcggcagcaaggatggcaagtatgagctgctgaccagcgccaatgaagtcatcgtggaggagatcaaggacctgatgaccaagagtgacatcaagggccagcacacagagaccctgctggccggcagcctggccaaggccctgtgctacatccacaggatgaacaaggaggtgaaggacaaccaggagatgaagagccgcatcctggtgatcaaggccgcagaagattctgccctgcagtacatgaacttcatgaatgtcatctttgctgcccagaagcagaacatcctgattgatgcctgtgtgctggacagcgacagcggcctgctgcagcaggcctgtgacatcactggaggcctgtacctgaaggtgccccagatgcccagcctgctgcagtacctgctgtgggtgttcctgcctgaccaggaccagaggagccagctgatcctgcccccacctgtgcacgtggactaccgggccgcctgcttctgccacaggaacctgattgaaattggctacgtgtgcagcgtgtgcctgagcatcttctgcaacttcagccccatctgcaccacctgtgaaacagccttcaagatcagcctgccccctgtgctgaaggccaagaagaagaagctgaaggtgtctgcctag

SEQ ID NO: 41841 - DNA, 864 bp, Artificial Sequence
  Description of Artificial Sequence: Synthetic coding sequence
atggccgagcacttcaagcagatcatccgctgccctgtgtgcctgaaggacctggaggaggccgtgcagctgaagtgtggctacgcctgctgcctgcagtgcctgaacagcctgcagaaggagccagatggagagggcctgctgtgccgcttctgcagcgtggtgtcccagaaggatgacatcaagcccaagtacaagctgcgggccctggtgtccatcatcaaggagctggagcccaagctgaagtctgtgctgaccatgaaccccaggatgaggaagttccaggtggacatgacctttgatgtggacacagccaacaactacctgatcatcagcgaggacctgcgctccttccgcagcggggacctgagccagaacaggaaggagcaggccgagagatttgacacagccctgtgtgtgctgggcaccccccgcttcaccagcggccgccactactgggaggtggatgtgggcaccagccaggtgtgggatgtgggcgtgtgcaaggagagcgtgaaccggcagggcaagatcgtgctgagcagcgagcacggcttcctgactgtgggctgccgggagggcaaggtgtttgctgccagcacagtgcccatgacccccctgtgggtgagcccccagctgcaccgggtgggcatcttcctggatgtgggcatgaggagcatcgccttctacaacgtgtctgatggctgccacatctacaccttcatcgagatccctgtgtgtgagccctggaggcccttctttgcccacaagaggggcagccaggatgaccagagcatcctgagcatctgcagcgtcatcaaccccagcgctgccagcgcccctgtgagcagcgagggcaagtag

SEQ ID NO: 41842 - DNA, 792 bp, Artificial Sequence
  Description of Artificial Sequence: Synthetic coding sequence
atggccaagaggctgcaggccgagctgagctgccctgtgtgcctggacttcttcagctgcagcatcagcctgagctgcacccacgtgttctgctttgactgcatccagcgctacatcctggagaaccacgacttccgggccatgtgccccctgtgcagagatgtggtgaaggtgcctgccctggaggagtggcaggtgtctgtgctgaccctgatgaccaagcagcacaacagccggctggagcagagcctgcacgtgcgggaggagctgcggcacttcagagaagatgtgaccctggatgctgccacagccagcagcctgctggtgttcagcaatgacctgcggagcgcccagtgcaagaagatccaccacgacctgaccaaggacccccggctggcctgtgtgctgggcaccccctgcttcagcagcggccagcactactgggaggtggaggtgggggaggtgaagtcctggagcctgggcgtgtgcaaggagcctgctgacaggaagagcaatgacctcttccctgagcacggcttctggatctccatgaaggccggggccatccacgccaacacccacctggagcgcatcccagccagcccccggctgcggcgggtgggcatcttcctggatgctgacctggaggagatccagttctttgatgtggacaacaacgtgctgatctacacccatgatggcttcttcagcctggagctgctgtgccccttcttctgcctggagctgctgggggagggggagagcggaaatgtgctgaccatctgcccctag

SEQ ID NO: 41843 - DNA, 597 bp, Artificial Sequence
  Description of Artificial Sequence: Synthetic coding sequence
atgcccctgtttggctggatgaagtggcccaagaatgacagctacaagcccacccactacccaggcagtgacatcgtgaccaagaccctgctgcgggagctgaagtggcacctgaaggagcgggagcggctcatccaggagattgaaaatgagcagaaggtgaagaagacaggagtggactacaactggctgaggaactaccagaacccccacaccaccatccctgtgacagagcagaggcagctggaggtgctgtgcagccaggtgcagccctgccagacaggcaccatcctgagccgcttccgggaggtgctggctgaaaatgatgtgctgccctgggagatcgtgtacatcttcaagcaggtgctgaaggacttcctgagcagcagtgaccggggcagcgagcaggaggacctggaggacagcggctccatggactgcagcgcccccagcgtcatccagggcgacagcagcaagagagctgacaaggatgagatccccaccatcagcagctatgtggacaagaacaccaaggaccgcttccctgtgttcagccaccgcatctggaacctgccctactaccaccccagcagctag

SEQ ID NO: 41844 - DNA, 4167 bp, Artificial Sequence
  Description of Artificial Sequence: Synthetic coding sequence
atgagcatccccctgcacagcctgcgcttcaacaacaccatgagagaagaaaatgtggagccccagaacaagcagatggccttctgccggcccatgacagagaccagggcagatgtgcagatcctgcacagccacgtgcagctgcccatcgtgtccaccagcgccagtgaccccggcggcaccagcacccagctgatgaccagccctgtgtttgacaccatgtctgcccccctgatgggcgtgcccaacagcggggccctgagcccccccctgatgcctgccagtgacagcggggccctgagccccctgctgatgcctgccagtgacagcggggccctgagccccctgctgatgcctgccctggacagcggcaccctgagccccctgctgagcaccagtgaatatggagtgatgagccctggcatgatgaccatcccagactttggcaccatgtctgccaccctgatggtggccccagattctgctgagatcagccccctggccatgcctgcccccagcagcggcgtggtgtgcacccccatcatgagcaccagcagcagcgaggccatgagcacccccctgatgctggccccagacagcggggagctgagccccatcctgatgcaggacatgaaccctggggtgatgagcacccagcctgtgcctgcccccagcagcgaggccatgagccccctgcagatcacagatgaggacacagaggccatgagcaaggtgctgatgacagccctggccagcggggagatcagcagcctgctgatgtctggaacagattctgaggccatcagcagcctcatcatgtctgctgtggccagcggcggcaccagcccccagcccaccagcacccagaacagcggcggcatccccacccccctgatgtctgacctggacagcggcatcatgagcagcctgctgatgagcagccctggcagcgaggtgatgagcacccccctgctgtctgtgcctgatgctggggagatgagcaccctgcccaagccagccccagatgctgaggccatgagccctgccctgatgacagccctgcccagcggcgtgatgcccacccagaccatgcctgcccctggcagcggggccatgagcccctggagcacccagaatgtggacagcgagatgatgagcaacccccctgtgcgggccacagccagcggcgtgatgtctgcccctcctgtgcgggccctggacagcggggccatgagcacccccctgatgggcgccccagccagcggcaacatgagcaccctgcagaagacagtgcctgccagcggggccatgaccaccagcctgatgacagtgcccagcagtggagtgatgagcacagagcagatgtctgccacagccagccgggtgatgtctgcccagctgaccatggccaagaccagcggggccatgcccaccggctccatgaaggctgtggccaagcagtacaagagggccacagccagcggcaagatgagcacccccctgcggcgggcccccaccagcggggccatgagcacccagcctgtgacagccacagccagcgagaccatgtccatgccccagctgactgtgcctgccagcggctccatgtccatgctgcagatgagggcccctgtgtctgaggccatgtccatgccccagatgaggaccatggccagcggcctgaccagcgctgcccagatgaaggccatgaccagcggggccatgagcacccccctgatgacagcccagaccagcggcagcaccagcaccctgctgatgagggacacagccagcggcgtgatgagctgcccccagatgaggagcctggccagcggggccctgagcaagcccctgatgacccccaaggccagcggcaccatgttcacagagaagatgaccaccacagccagcgaggccatgcccaccctgctgatgagggacacagtgtctggggccctgtccatgccccagatgacagacacagccagcggcggcctgagcgccagcctgatgagggacacagccagcggggccatgagcaccagccagatgacagccaccgtgtctgggggcatgtccatgcccctgatgagggcccaggaccccggggtgatgcctgccagcctgatgagggccaaggtgtctgggaagatgctgagccagcccatgagcacccaggaccccggcggcatgtccatgagccccatgaagtccatgacagctgggggcatgcagatgaacagccccaccagtgatgtgatgagcacccccaccgtgcgggcctggaccagcgagaccatgagcacccccctgatgaggaccagtgaccctggagagcggcccagcctgctgacccgggccagcagcagcggggagatgagcctgcccctgatgagggccccagccagcggggagatcgccacccccctgcggagccctgcctatggagccatgtctgccccccagatgacagccacagccagcggcatgatgagctccatgccccaggtgaaggcccccatcagcggggccatgtccatgcccctgaccaggagcacagccagcggcggcatgtccatgcccctgatgagggccccagacagccgggtgaccagcaccagccagatgatgcccacagccagcggggacatgtgcaccctgcctgtgcgggccccagccagcggcggcgtgagcagccccctggtgcgggccccagccagcggcaccatgagcacccccctgcggcggcccagcgcctgtgagaccgtgtccacagagctgatgagggccagcgccagcggccacatgagcacagcccagaccacagccatggtgtctgggggcatgagcaagcccctgatgagggccccagccagcggcaccatgcccatgcccctgatgtctgccatggccagcggggagatgtccatgcccctgatggagaccatggccagcggggccaccagcaccctgcagacctctgtggccaacagccgctccatgagcctgagccagaccacctacacagtgtctggccgcatggccacagcccccatccgggccagcgccagcggggcccggagcaccagcttcatgagggcctctgtgtctggctccatgcccatgcccctgccccgggccacagccagcggctgcggcatgggcatgtccatgccccagatgacagccacagacagccggggcatgagcacccccctgatgagggccagcggccctggcaccatgagcaccccccagacagcctttggagtgatgagcaccccagagatcaaggccacagacagcggggaggccagcaccagccacatcaacatcacagccagcggcagcaagcccaccagccacatgacagccaccaccccagagacagccaagcccccacccaaggaggtgcccagctttggcatgctgaccccagccctgtgctacctgctggaggagcaggaggccgcccggggcagctgcagcgtggaggaggagatggagattgatgaggagaagcagatgaagggcttcctggatgattctgagaggatggccttcctggtgtccctgcacctgggcgctgctgagcgctggttcatcctgcagatggaggtgggggagcccctgagccatgagaacaagagcttcctgcggcgcagccagggcatctatgacagcctgtctgaaattgacatcctgtctgctgtgctgtgccaccccaagcagggccagaagtctgtgcggcagtatgccacagacttcctgctgctggcccggcacctgtcctggagcgatgccatcctgcggacccgcttcctggagggcctgtctgaggccgtgaccaccaagatgggccgcatcttcctgaaggtggccggcagcctgaaggagctgattgacaggagcctgtacacagagtgccagctggccgaggagaaggacagccctggcaacagcagccaggtgctgcccacagcctgcaagagaaataatgaggaggccatgggaaatgagctgagcagccagcagcagacagaggagcaccagcacgtgtccaagcgctgctactacctgaaggagcacggggacccccaggagggcctgcatgaccacctgggccagagcacaggccaccaccagaaggcccacaccaacaagtag

SEQ ID NO: 41845 - DNA, 267 bp, Artificial Sequence
  Description of Artificial Sequence: Synthetic coding sequence
atgagcatccccctgcacagcctgcgcttcaacaacaccatgagagaagaaaatgtggagccccagaacaagcagatggccttctgccggcccatgacagagaccagggcagatgtgcagatcctgcacagccacgtgcagctgcccatcgtgtccaccagcgccagtgaccccggcggcaccagcacccagctgatgaccagccctgtgtttgacaccatgtctgcccccctgatgggcgtgcccaacagcggggccctgtcctag

SEQ ID NO: 41846 - DNA, 4167 bp, Artificial Sequence; identical to SEQ ID NO: 41844
  Description of Artificial Sequence: Synthetic coding sequence

SEQ ID NO: 41847 - DNA, 2850 bp, Artificial Sequence
  Description of Artificial Sequence: Synthetic coding sequence
atgagcatccccctgcacagcctgcgcttcaacaacaccatgagagaagaaaatgtggagccccagaacaagcagatggccttctgccggcccatgacagagaccagggcagatgtgcagatcctgcacagccacgtgcagctgcccatcgtgtccaccagcgccagtgaccccggcggcaccagcacccagctgatgaccagccctgtgtttgacaccatgtctgcccccctgatgggcgtgcccaacagcggggccctgagcccccccctgatgcctgccagtgacagcggggccctgagccccctgctgatgcctgccagtgacagcggggccctgagccccctgctgatgcctgccctggacagcggcaccctgagccccctgctgagcaccagtgaatatggagtgatgagccctggcatgatgaccatcccagactttggcaccatgtctgccaccctgatggtggccccagattctgctgagatcagccccctggccatgcctgcccccagcagcggcgtggtgtgcacccccatcatgagcaccagcagcagcgaggccatgagcacccccctgatgctggccccagacagcggggagctgagccccatcctgatgcaggacatgaaccctggggtgatgagcacccagcctgtgcctgcccccagcagcgaggccatgagccccctgcagatcacagatgaggacacagaggccatgagcaaggtgctgatgacagccctggccagcggggagatcagcagcctgctgatgtctggaacagattctgaggccatcagcagcctcatcatgtctgctgtggccagcggcggcaccagcccccagcccaccagcacccagaacagcggcggcatccccacccccctgatgtctgacctggacagcggcatcatgagcagcctgctgatgagcagccctggcagcgaggtgatgagcacccccctgctgtctgtgcctgatgctggggagatgagcaccctgcccaagccagccccagatgctgaggccatgagccctgccctgatgacagccctgcccagcggcgtgatgcccacccagaccatgcctgcccctggcagcggggccatgagcccctggagcacccagaatgtggacagcgagatgatgagcaacccccctgtgcgggccacagccagcggcgtgatgtctgcccctcctgtgcgggccctggacagcggggccatgagcacccccctgatgggcgccccagccagcggcaacatgagcaccctgcagaagacagtgcctgccagcggggccatgaccaccagcctgatgacagtgcccagcagtggagtgatgagcacagagcagatgtctgccacagccagccgggtgatgtctgcccagctgaccatggccaagaccagcggggccatgcccaccggctccatgaaggctgtggccaagcagtacaagagggccacagccagcggcaagatgagcacccccctgcggcgggcccccaccagcggggccatgagcacccagcctgtgacagccacagccagcgagaccatgtccatgccccagctgactgtgcctgccagcggctccatgtccatgctgcagatgagggcccctgtgtctgaggccaccagcaccctgcagacctctgtggccaacagccgctccatgagcctgagccagaccacctacacagtgtctggccgcatggccacagcccccatccgggccagcgccagcggggcccggagcaccagcttcatgagggcctctgtgtctggctccatgcccatgcccctgccccgggccacagccagcggctgcggcatgggcatgtccatgccccagatgacagccacagacagccggggcatgagcacccccctgatgagggccagcggccctggcaccatgagcaccccccagacagccttcggcgtgatgagcaccccagagatcaaggccacagattctggagaggccagcaccagccacatcaacatcacagccagcggcagcaagcccaccagccacatgacagccaccaccccagagacagccaagcccccacccaaggaggtgcccagctttggcatgctgaccccagccctgtgctacctgctggaggagcaggaggccgcccggggcagctgcagcgtggaggaggagatggagattgatgaggagaagcagatgaagggcttcctggatgacagcgagaggatggccttcctggtgtccctgcacctgggcgctgctgagcgctggttcatcctgcagatggaggtgggggagcccctgagccatgagaacaagagcttcctgcggcgcagccagggcatctatgacagcctgtctgaaattgacatcctgtctgctgtgctgtgccaccccaagcagggccagaagtctgtgcggcagtatgccacagacttcctgctgctggcccggcacctgtcctggagcgatgccatcctgcggacccgcttcctggagggcctgtctgaggccgtgaccaccaagatgggccgcatcttcctgaaggtggccggcagcctgaaggagctgattgacaggagcctgtacacagagtgccagctggccgaggagaaggacagccctggcaacagcagccaggtgctgcccacagcctgcaagaggaacaatgaggaggccatgggaaatgagctgagcagccagcagcagacagaggagcaccagcacgtgtccaagcgctgctactacctgaaggagcacggggacccccaggagggcctgcatgaccacctgggccagagcacaggccaccaccagaaggcccacaccaacaagtag

SEQ ID NO: 41848 - DNA, 1710 bp, Artificial Sequence
  Description of Artificial Sequence: Synthetic coding sequence
atgtctgaggccagcggcaacctgaacagcctgaggatggccaacgtggccctgcgggaggagctgaatgccctgcggggggagaatgccaacctgggcctgcagctgggccgggccctggccgaggtgaacagcctgcggggaaatgtgagcagctacatccgctggcctgtgcccatcgtgcctgtgctggccgaggagaacctggagtttgccctgtctgaaattgaggtgattcctggaggagagctgcccttcctgtgccggcccccacccagggctgagccagactgcatcagtgatgacctgctgatcaacgtcatccaggacaggagcaccccagatggccctgctgacccccccctgctgcccatccccccacctccagccctgcccccaccagccagcaaggagcccccaccccagccccccctggcccccctggagaggcctgagattgagcccttcagcggggaccctgtgtacctggccgagttcctgatgcagctggagaccttcatcgctgaccacgaggtgcacttccctgggggcgctgagcgggtggccttcctgatctccttcttcaccggggaggccaaggactgggccatctctgtgacccaggagggcagccccctgcacgccaacttcccccgcttcctggatgagatcaggaaggagttctgtggccccatccccccccgggtggccaagaaggccatcaggaagctgaagcagggccactgcaccctgggcagctatgcagatgccttccagttcctggcccagttcctgtcctgggatgactgccgcctgcagaaccagttcctgaagggcctgtctgagttcttcaggaaggagctgctgtggagcacagagatggctgacctggatgagctgatcctggagtgtgtggagattgaaaggaaggtgcgggtgcccaagcccatccccctgcccggggtgaggaacatcatcttcccctttgcccccagccccaatgaggaggagagtgaagatgaggagtactacagtgaagatgaggaccaggaggcccggcggcaccggctgcacagcaaggaccagaggaagaggatgagggccttccagcaggagatgaaggagaaggaggaggaggagatgaagaaggaggaggagatgaagaagaaggaggagaaggaggaggaggaggaggaggagatgaagcagaaggaggaggaggaggagatccggaacaagaatgaggaggagggggagagcaaggatgaggaggatgaagatgaagatggcggccagaagccagagggggagccccagcaggaccccggcacagaggagacctacggggaggtggaggaggagcccctggatgaggcccaggatgatgacctggatgagctgatggagatggagcccacctttgtgcacgccagcagccagaccagcggccccaccagcggctaccacgccgagaacttcctgggcgccagcccccccatcatccagcccagcagaagaagaaaccagaacagagtgcccctgctggagggcctgcccggcaccaacagccccttctacagcagcccccagctgatcagaagaacaggccgcctgggccagaggcaggtgagaagaagacctcctgtgctcttccggctgaccccccggcagggcggccaccgggccgcccggggccgcatccgggtgtag

SEQ ID NO: 41849 - DNA, 1710 bp, Artificial Sequence; identical to SEQ ID NO: 41848
  Description of Artificial Sequence: Synthetic coding sequence

SEQ ID NO: 41850 - DNA, 2028 bp, Artificial Sequence
  Description of Artificial Sequence: Synthetic coding sequence
atgctgcgggccacagccccctgctggttccccccaggctacccagaggccaagaaggtggccgaggaggccgccctggaggccagccgccacctgggcggggagcagagccaggccggggcccctgagggcagcaagatgctgcgggccacagccccctgctggttccggcccggctacccagaggccaagaaggtggccaaggaggccgcccctgaggccagccgccacctgggcgctgagcagagccctgctggggcccctgagggcagcaagatgctgcgggccacagccccctgctggttccccccaggctacccagaggccaagaaggtggccgaggaggccgccctggaggcccctgagttccccctgcccagccaccagcctgcccagagctttggcctgtgggtgccccagatgcacaagcaggccagcgcctttgtggacatccaggccgagccccagaacagaggccctgctgtgcccccagcctggcccaagatggtgacagagagctgctacttccctgcccagaggggcagcgcctgccgcctgcctgctgccccccggctgacagagcggcccagcggcgtgcgcatcagcgcccccaggaagaggaagaccatcgcccacagcagcagcccctgcctggtgacaggctacacagatgccaagaggaccagggtggccagcagcagccagaggagccggggcagcaaggtgggccggcagcccgggaagaccaggaacagaagtggcatggcctgcaagaccacagccaccaccagcagcaagagaattgtgcggcgggccagcctgcccagcctgagcctgaagaagcccatcatcctgcggagcagcggctgccaggtgcccaccgtgctgcggcggggctacctgcagctgttcacagaagaatgtctgaagttctgtgccagcaagcaggaggccgaggagaaggccctgaatgaggagaaggtggcctatgactgcagccccaacaagaaccgctacctgaatgtggtgctgaacaccctgaagaggctgaagggcctgacccccagctccatgcctggcctgagccgggccgccctgtacagccggctgcaggagttcctgctgacccaggaccagctgaaggaaaatggctaccccttcccccaccctgagaggcctggaggagctgtgctcttcaccggccagggcaagggccctggggacagcagctgccgggtgtgctgccgctgtggcacagagtacctggtgagcagcagcggccgctgtgtgcgggaccagctgtgctactaccactggggccgggtgcgcagcagccaggtggccggcggccgggtgtcccagtacacctgctgtgccgccgcccctggctctgtgggctgccaggtggccaagcagcacgtgagagatggcaggaaggagagcctggatggctttgtggagaccttcaagaaggagctgagcagagatgcctacccaggcatctatgccctggactgtgagatgtgctacaccacccacggcctggagctgaccagggtgacagtggtggatgctgacatgagggtggtgtatgacacctttgtgaagccagacaatgaaattgtggactacaacacccgcttctctggagtgacagaagcagatgtggccaagaccagcatcaccctgccccaggtgcaggccatcctgctgtccttcttcagcgcccagaccatcctgattggccacagcctggagagtgacctgctggccctgaagctgatccacagcacagtggtggacacagctgtgctcttcccccactacctgggcttcccctacaagaggagcctgaggaacctggccgctgactacctggcccagatcatccaggacagccaggacggccacaacagcagtgaagatgccaatgcctgcctgcagctggtgatgtggaaggtgcggcagagggcccagatccagcccaggcacaggtctgccagccctgctgccctggcctgcccctag

SEQ ID NO: 41851 - DNA, 2028 bp, Artificial Sequence; identical to SEQ ID NO: 41850
  Description of Artificial Sequence: Synthetic coding sequence

SEQ ID NO: 41852 - DNA, 3864 bp, Artificial Sequence
  Description of Artificial Sequence: Synthetic coding sequence
atggtggcccggagcacagacagcctggatggccctggagagggctctgtgcagcccctgcccacagctgggggccccagcgtgaagggcaagccaggcaagaggctgagcgccccccggggccccttcccccggctggccgactgtgcccacttccactatgaaaatgtggactttggccacatccagctgctgctgagcccagaccgggagggccccagcctgagcggggagaatgagctggtgtttggagtgcaggtgacctgccagggccgctcctggcctgtgctgcggagctatgatgacttccgcagcctggatgcccacctgcaccgctgcatctttgaccggcgcttcagctgcctgcctgagctgcccccacctcctgagggcgcccgggccgcccagatgctggtgcccctgctgctgcagtacctggagaccctgagcggcctggtggacagcaacctgaactgtggccctgtgctgacctggatggagctggacaaccacggccgccgcctgctgctgtctgaggaggccagcctgaacatcccagctgtggccgccgcccacgtgatcaagcgctacacagcccaggccccagatgagctgagctttgaggtgggggacatcgtgtctgtcatcgacatgccacccacagaggaccgctcctggtggaggggcaagaggggcttccaggtgggcttcttccccagtgaatgtgtggagctgttcacagagcggcccggccctggcctgaaggcagatgctgatggccccccctgtggcatcccagccccccagggcatcagcagcctgaccagcgctgtgccccggccccggggcaagctggccggcctgctgcggaccttcatgaggagccggcccagccggcagaggctgcggcagaggggcatcctgcggcagagggtgtttggctgtgacctgggggagcacctgagcaacagcggccaggatgtgccccaggtgctgcgctgctgcagcgagttcatcgaggcccacggcgtggtggatggcatctaccgcctgagcggcgtgagcagcaacatccagaggctgcggcatgaatttgattctgagcgcatccctgagctgagcggccctgccttcctgcaggacatccacagcgtgagcagcctgtgcaagctgtacttccgggagctgcccaaccccctgctgacctaccagctgtatggcaagttcagcgaggccatgtctgtgcctggagaggaggagcggctggtgcgggtgcatgatgtgatccagcagctgcccccaccccactaccgcaccctggagtacctgctgcggcacctggccaggatggcccggcacagcgccaacacctccatgcacgccaggaacctggccatcgtgtgggcccccaacctgctgcgctccatggagctggagagcgtgggcatgggcggcgctgctgccttccgggaggtgcgggtgcagagcgtggtggtggagttcctgctgacccacgtggatgtgctcttcagtgacaccttcaccagcgctggcctggaccctgctggccgctgcctgctgccccggcccaagagcctggccggcagctgccccagcacccggctgctgaccctggaggaggcccaggcccggacccagggccgcctgggcacccccacagagcccaccacccccaaggccccagccagccctgctgagaggaggaagggggagcggggggagaagcagaggaagccaggcggcagctcctggaagaccttctttgccctgggccggggccccagcgtgcccaggaagaagcccctgccctggctgggcggcacccgggccccaccccagcccagcggcagcaggccagacacagtgaccctgcggagcgccaagtctgaggagagcctgagcagccaggccagcggggccggcctgcagaggctgcaccggctgcggcggccccacagcagcagtgatgccttccctgtgggccctgccccagctggcagctgtgagagcctgagcagcagcagcagcagcgagagcagcagcagcgagagcagcagcagcagcagcgagagcagcgctgctggcctgggcgccctgagcggcagccccagccacaggaccagcgcctggctggatgatggagatgagctggacttcagccccccacgctgcctggagggcctgcggggcctggactttgaccccctgaccttccgctgcagcagccccacccctggggaccctgcccccccagccagccctgcccccccagccccagccagcgccttccccccccgggtgaccccccaggccatcagcccccggggccccaccagccctgccagccctgctgccctggacatcagcgagcccctggccgtgtctgtgcccccagctgtgctggagctgctgggcgccggcggggccccagccagcgccacccccaccccagccctgagccctggccgcagcctgcggccccacctgatccccctgctgctgcggggagctgaggcccccctgacagatgcctgccagcaggagatgtgcagcaagctgcggggggcccagggccccctgggccctgacatggagagccccctgcccccaccacccctgagcctgctgcggcctggaggagcccctcctcctccacccaagaacccagcccggctgatggccctggccctggccgagcgggcccagcaggtggccgagcagcagagccagcaggagtgtggcggcaccccaccagccagccagagccccttccacaggagcctgagcctggaggtgggcggggagcccctgggcaccagcggcagcggccccccacccaacagcctggcccaccctggggcctgggtgcccggccccccaccctacctgccccggcagcagagtgatggcagcctgctgcggagccagaggcccatgggcaccagccggcggggcctgcggggccctgcccaggtgtctgcccagctgcgggccggcggcggcggcagagatgcccctgaggccgccgcccagagcccctgcagcgtgcccagccaggtgcccaccccaggcttcttctccccagcccccagagaatgtctgccccccttcctgggcgtgcccaagccaggcctgtaccccctgggccccccatccttccagcccagcagccctgcccctgtgtggaggagcagcctgggccccccagcccccctggacagaggagaaaatctctactatgaaattggagccagcgagggcagcccctacagcggccccaccaggtcctggagccccttccgctccatgcccccagaccggctgaatgccagctatggcatgctgggccagagcccccccctgcacaggagcccagacttcctgctgagctaccccccagcccccagctgcttccccccagaccacctgggctacagcgccccccagcacccagcccggcggcccaccccacctgagcccctgtatgtgaacctggccctgggcccccggggccccagccctgccagcagcagcagcagcagccccccagcccaccccaggagcagaagtgaccccggcccccctgtgccccggctgccccagaagcagagggccccctggggccccaggaccccccaccgggtgcccggcccctggggccccccagagcccctgctgctgtacagagctgcccccccagcctacggccggggcggggagctgcaccggggcagcctgtacagaaatggaggccagagaggagagggcgccggccccccaccaccctaccccacccccagctggagcctgcacagcgagggccagaccaggagctactgctag

SEQ ID NO: 41853 - DNA, 2604 bp, Artificial Sequence
  Description of Artificial Sequence: Synthetic coding sequence
atgaggagccgcagccccccccggcccaagtggcacagcagagatggcagcagccagagcgacagcggggaggagcagagccggggccagtgggccaggagaagaagaagagcccgctcctggagccccagcagcagcgccagcagcagcgccagccctggccgcagccagagccccagggctgctgctgctgccctgagccagcagcagagcctgcaggagcggctgcggctgcgggaggagaggaagcagcaggaggagctgatgaaggcctttgagaccccagaggagaagagggcccggcggctggccaagaaggaggccaaggagaggaagaagcgggagaagatgggctggggcgaggagtacatgggctacaccaacacagacaacccctttggagacaacaacctgctgggcaccttcatctggaacaaggccctggagaagaagggcatcagccacctggaggagaaggagctgaaggagaggaacaagaggatccaggaggacaaccggctggagctgcagaaggtgaagcagctgcggctggagcgggagcgggagaaggccatgagggagcaggagctggagatgctgcagcgggagaaggaggccgagcacttcaagacctgggaggagcaggaggacaacttccacctgcagcaggccaagctgcggagcaagatccgcatcagagatggccgggccaagcccatcgacctgctggccaagtacatctctgcagaagatgatgacctggccgtggagatgcatgagccctacaccttcctgaatggcctgactgtggccgacatggaggacctgctggaggacatccaggtgtacatggagctggagcagggcaagaatgctgacttctggagggacatgaccaccatcacagaagatgagatcagcaagctgaggaagctggaggccagcgggaaaggacctggagagcggcgggagggcgtgaatgcctctgtgtccagtgatgtgcagagcgtcttcaagggcaagacctacaaccagctgcaggtgatcttccagggcatcgagggcaagatccgggccggcggccccaacctggacatgggctactgggagagcctgctgcagcagctgcgggcccacatggcccgggcccggctgcgggagcggcaccaggatgtgctgcggcagaagctgtacaagctgaagcaggagcagggcgtggagagcgagcccctcttccccatcctgaagcaggagccccagagccccagccgcagcctggagccagaagatgctgcccccaccccacctggccccagcagcgagggcggccctgctgaggccgaggtggatggagccacccccacagaaggagatggagatggagatggagagggggagggggagggggaggccgtgctgatggaggaggacctgatccagcagagcctggatgattatgatgctggccgctacagcccccggctgctgacagcccacgagctgcccctggatgcccacgtgctggagccagatgaggacctgcagaggctgcagctgagccggcagcagctgcaggtgactggagatgccagcgagagcgctgaggacatcttcttccggcgggccaaggagggcatgggccaggatgaggcccagttctctgtggagatgcccctgaccgggaaggcctacctgtgggccgacaagtaccggcccaggaagccccgcttcttcaacagagtgcacactggatttgagtggaacaagtacaaccagacccactatgactttgacaaccccccacccaagatcgtgcagggctacaagttcaacatcttctacccagacctgattgacaagaggagcaccccagagtacttcctggaggcctgtgccgacaacaaggactttgccatcctgcgcttccacgccggccccccctatgaagatattgccttcaagatcgtgaaccgggagtgggagtacagccaccgccacggcttccgctgccagtttgccaacggcatcttccagctgtggttccacttcaagcgctaccgctacagaagacctggcccctgctggaggcccatccgccactgccggcgggaccccctgtggacccccaccctgtgccgggactggccacccacccaccctgtgctggccggcggcgtgcacttccctgctgctggcatccccccacctggcctgctgaccggcccctggagcatgaggcctgtgacccccagctttgcccacatcagaacagtggcccccagccacagccccttcagcggccaggagggccggggcccccacggctgccacagccctggccgcagcggccctgctggccgcctggtgctgcagcaccccaccggcaccagccccacagaggccaagaggaaggtgcccccaggccccccagagggccaccccaccagccctgtgaccagccccaggcctcccacagccccacccaggcacccagccagcagcggcaacagctctgtgtgcttcagcaagaagacctgccgctgggagaagaagagctttgtgctgatggagctggcctactggcaggacaggatgttcttctag

SEQ ID NO: 41854 - DNA, 3381 bp, Artificial Sequence
  Description of Artificial Sequence: Synthetic coding sequence
atggtggcccggagcacagacagcctggatggccctggagagggctctgtgcagcccctgcccacagctgggggccccagcgtgaagggcaagccaggcaagaggctgagcgccccccggggccccttcccccggctggccgactgtgcccacttccactatgaaaatgtggactttggccacatccagctgctgctgagcccagaccgggagggccccagcctgagcggggagaatgagctggtgtttggagtgcaggtgacctgccagggccgctcctggcctgtgctgcggagctatgatgacttccgcagcctggatgcccacctgcaccgctgcatctttgaccggcgcttcagctgcctgcctgagctgcccccacctcctgagggcgcccgggccgcccagatgctggtgcccctgctgctgcagtacctggagaccctgagcggcctggtggacagcaacctgaactgtggccctgtgctgacctggatggagctggacaaccacggccgccgcctgctgctgtctgaggaggccagcctgaacatcccagctgtggccgccgcccacgtgatcaagcgctacacagcccaggccccagatgagctgagctttgaggtgggggacatcgtgtctgtcatcgacatgccacccacagaggaccgctcctggtggaggggcaagaggggcttccaggtgggcttcttccccagtgaatgtgtggagctgttcacagagcggcccggccctggcctgaaggcagatgctgatggccccccctgtggcatcccagccccccagggcatcagcagcctgaccagcgctgtgccccggccccggggcaagctggccggcctgctgcggaccttcatgaggagccggcccagccggcagaggctgcggcagaggggcatcctgcggcagagggtgtttggctgtgacctgggggagcacctgagcaacagcggccaggatgtgccccaggtgctgcgctgctgcagcgagttcatcgaggcccacggcgtggtggatggcatctaccgcctgagcggcgtgagcagcaacatccagaggctgcggcatgaatttgattctgagcgcatccctgagctgagcggccctgccttcctgcaggacatccacagcgtgagcagcctgtgcaagctgtacttccgggagctgcccaaccccctgctgacctaccagctgtatggcaagttcagcgaggccatgtctgtgcctggagaggaggagcggctggtgcgggtgcatgatgtgatccagcagctgcccccaccccactaccgcaccctggagtacctgctgcggcacctggccaggatggcccggcacagcgccaacacctccatgcacgccaggaacctggccatcgtgtgggcccccaacctgctgcgctccatggagctggagagcgtgggcatgggcggcgctgctgccttccgggaggtgcgggtgcagagcgtggtggtggagttcctgctgacccacgtggatgtgctcttcagtgacaccttcaccagcgctggcctggaccctgctggccgctgcctgctgccccggcccaagagcctggccggcagctgccccagcacccggctgctgaccctggaggaggcccaggcccggacccagggccgcctgggcacccccacagagcccaccacccccaaggccccagccagccctgctgagaggaggaagggggagcggggggagaagcagaggaagccaggcggcagctcctggaagaccttctttgccctgggccggggccccagcgtgcccaggaagaagcccctgccctggctgggcggcacccgggccccaccccagcccagcggcagcaggccagacacagtgaccctgcggagcgccaagtctgaggagagcctgagcagccaggccagcggggctgagctgctgggcgctgggggcgccccagccagcgccacccccaccccagccctgagccctggccgcagcctgcggccccacctgatccccctgctgctgcggggagctgaggcccccctgacagatgcctgccagcaggagatgtgcagcaagctgcggggggcccagggccccctgggccctgacatggagagccccctgcccccaccacccctgagcctgctgcggcctgggggcgcccctcctcctccacccaagaacccagcccggctgatggccctggccctggccgagcgggcccagcaggtggccgagcagcagagccagcaggagtgtggcggcaccccaccagccagccagagccccttccacaggagcctgagcctggaggtgggcggggagcccctgggcaccagcggcagcggccccccacccaacagcctggcccaccctggggcctgggtgcccggccccccaccctacctgccccggcagcagagtgatggcagcctgctgcggagccagaggcccatgggcaccagcagaagaggcctgcggggccctgcccaggtgtctgcccagctgcgggccggcggcggcggcagagatgcccctgaggccgccgcccagagcccctgcagcgtgcccagccaggtgcccaccccaggcttcttcagccctgccccccgggagtgcctgccccccttcctgggcgtgcccaagccaggcctgtaccccctgggcccccccagcttccagcccagcagccctgcccctgtgtggaggagcagcctgggccccccagcccccctggacagaggagagaacctgtactatgagatcggggccagcgagggcagcccctacagcggccccaccaggtcctggagccccttccgctccatgcccccagaccggctgaatgccagctatggcatgctgggccagagcccccccctgcacaggagcccagacttcctgctgagctaccccccagcccccagctgcttccccccagaccacctgggctacagcgccccccagcacccagcccggcggcccaccccacctgagcccctgtatgtgaacctggccctgggcccccggggccccagccctgccagcagcagcagcagcagccccccagcccaccccaggagcagaagtgaccccggcccccctgtgccccggctgccccagaagcagagggccccctggggccccaggaccccccaccgggtgcccggcccctggggccccccagagcccctgctgctgtaccgggccgcccccccagcctacggccggggcggggagctgcaccggggcagcctgtacagaaatggaggccagagaggagagggcgccggccccccaccaccctaccccacccccagctggagcctgcacagcgagggccagaccaggagctactgctag

SEQ ID NO: 41855 - DNA, 3372 bp, Artificial Sequence
  Description of Artificial Sequence: Synthetic coding sequence
atgctggtgcccctgctgctgcagtacctggagaccctgagcggcctggtggacagcaacctgaactgtggccctgtgctgacctggatggagctggacaaccacggccgccgcctgctgctgtctgaggaggccagcctgaacatcccagctgtggccgccgcccacgtgatcaagcgctacacagcccaggccccagatgagctgagctttgaggtgggggacatcgtgtctgtcatcgacatgccacccacagaggaccgctcctggtggaggggcaagaggggcttccaggtgggcttcttccccagtgaatgtgtggagctgttcacagagcggcccggccctggcctgaaggcagatgctgatggccccccctgtggcatcccagccccccagggcatcagcagcctgaccagcgctgtgccccggccccggggcaagctggccggcctgctgcggaccttcatgaggagccggcccagccggcagaggctgcggcagaggggcatcctgcggcagagggtgtttggctgtgacctgggggagcacctgagcaacagcggccaggatgtgccccaggtgctgcgctgctgcagcgagttcatcgaggcccacggcgtggtggatggcatctaccgcctgagcggcgtgagcagcaacatccagaggctgcggcatgaatttgattctgagcgcatccctgagctgagcggccctgccttcctgcaggacatccacagcgtgagcagcctgtgcaagctgtacttccgggagctgcccaaccccctgctgacctaccagctgtatggcaagttcagcgaggccatgtctgtgcctggagaggaggagcggctggtgcgggtgcatgatgtgatccagcagctgcccccaccccactaccgcaccctggagtacctgctgcggcacctggccaggatggcccggcacagcgccaacacctccatgcacgccaggaacctggccatcgtgtgggcccccaacctgctgcgctccatggagctggagagcgtgggcatgggcggcgctgctgccttccgggaggtgcgggtgcagagcgtggtggtggagttcctgctgacccacgtggatgtgctcttcagtgacaccttcaccagcgctggcctggaccctgctggccgctgcctgctgccccggcccaagagcctggccggcagctgccccagcacccggctgctgaccctggaggaggcccaggcccggacccagggccgcctgggcacccccacagagcccaccacccccaaggccccagccagccctgctgagaggaggaagggggagcggggggagaagcagaggaagccaggcggcagctcctggaagaccttctttgccctgggccggggccccagcgtgcccaggaagaagcccctgccctggctgggcggcacccgggccccaccccagcccagcggcagcaggccagacacagtgaccctgcggagcgccaagtctgaggagagcctgagcagccaggccagcggggccggcctgcagaggctgcaccggctgcggcggccccacagcagcagtgatgccttccctgtgggccctgccccagctggcagctgtgagagcctgagcagcagcagcagcagcgagagcagcagcagcgagagcagcagcagcagcagcgagagcagcgctgctggcctgggcgccctgagcggcagccccagccacaggaccagcgcctggctggatgatggagatgagctggacttcagccccccacgctgcctggagggcctgcggggcctggactttgaccccctgaccttccgctgcagcagccccacccctggggaccctgcccccccagccagccctgcccccccagccccagccagcgccttccccccccgggtgaccccccaggccatcagcccccggggccccaccagccctgccagccctgctgccctggacatcagcgagcccctggccgtgtctgtgcccccagctgtgctggagctgctgggcgccggcggggccccagccagcgccacccccaccccagccctgagccctggccgcagcctgcggccccacctgatccccctgctgctgcggggagctgaggcccccctgacagatgcctgccagcaggagatgtgcagcaagctgcggggggcccagggccccctgggccctgacatggagagccccctgcccccaccacccctgagcctgctgcggcctggaggagcccctcctcctccacccaagaacccagcccggctgatggccctggccctggccgagcgggcccagcaggtggccgagcagcagagccagcaggagtgtggcggcaccccaccagccagccagagccccttccacaggagcctgagcctggaggtgggcggggagcccctgggcaccagcggcagcggccccccacccaacagcctggcccaccctggggcctgggtgcccggccccccaccctacctgccccggcagcagagtgatggcagcctgctgcggagccagaggcccatgggcaccagccggcggggcctgcggggccctgcccaggtgcccaccccaggcttcttctccccagcccccagagaatgtctgccccccttcctgggcgtgcccaagccaggcctgtaccccctgggccccccatccttccagcccagcagccctgcccctgtgtggaggagcagcctgggccccccagcccccctggacagaggagaaaatctctactatgaaattggagccagcgagggcagcccctacagcggccccaccaggtcctggagccccttccgctccatgcccccagaccggctgaatgccagctatggcatgctgggccagagcccccccctgcacaggagcccagacttcctgctgagctaccccccagcccccagctgcttccccccagaccacctgggctacagcgccccccagcacccagcccggcggcccaccccacctgagcccctgtatgtgaacctggccctgggcccccggggccccagccctgccagcagcagcagcagcagccccccagcccaccccaggagcagaagtgaccccggcccccctgtgccccggctgccccagaagcagagggccccctggggccccaggaccccccaccgggtgcccggcccctggggccccccagagcccctgctgctgtacagagctgcccccccagcctacggccggggcggggagctgcaccggggcagcctgtacagaaatggaggccagagaggagagggcgccggccccccaccaccctaccccacccccagctggagcctgcacagcgagggccagaccaggagctactgctag

SEQ ID NO: 41856 - DNA, 2625 bp, Artificial Sequence
  Description of Artificial Sequence: Synthetic coding sequence
atgggcctgcccaccctggagttcagtgacagctacctggacagcccagacttccgggagcggctgcagtgccatgaaattgagctggagaggaccaacaagttcatcaaggagctgatcaaggatggcagcctgctgattggagccctgaggaacctgtccatggctgtgcagaagttcagccagagcctgcaggacttccagtttgagtgcattggagatgctgagacagatgatgagatcagcatcgcccagagcctgaaggagtttgcccggctgctgattgctgtggaggaggagcggcggcggctcatccagaatgccaatgatgtgctgattgcccccctggagaagttcaggaaggagcagatcggggccgccaaggatggcaagaagaagtttgacaaggagagcgagaagtactacagcatcctggagaagcacctgaacctgagcgccaagaagaaggagagccacctgcaggaggccgacacccagattgaccgggagcaccagaacttctatgaggccagcctggagtatgtgttcaagatccaggaggtgcaggagaagaagaagtttgaatttgtggagcccctgctgtccttcctgcagggcctcttcaccttctaccacgagggctatgagctggcccaggagtttgccccctacaagcagcagctgcagttcaacctgcagaacaccaggaacaactttgagagcacccggcaggaggtggagcggctgatgcagaggatgaagagcgccaaccaggactaccggccccccagccagtggaccatggagggctacctgtatgtgcaggagaagaggcccctgggcttcacctggatcaagcactactgcacctatgacaagggcagcaagaccttcaccatgtctgtgtctgagatgaagagcagcggcaagatgaatggcctggtgaccagcagccctgagatgttcaagctgaagagctgcatccggaggaagacagacagcattgacaagcgcttctgctttgatattgaggtggtggagagacatggcatcatcaccctgcaggccttcagcgaggccaacaggaagctgtggctggaggccatggatggcaaggagcccatctacaccctgcctgccatcatcagcaagaaggaggagatgtacctgaatgaagctggcttcaactttgtgaggaagtgcatccaggccgtggagacccggggcatcaccatcctgggcctgtaccgcatcggcggcgtgaacagcaaggtgcagaagctgatgaacaccaccttcagccccaagagccccccagacattgatattgatattgagctgtgggacaacaagaccatcaccagcggcctgaagaactacctgcgctgcctggccgagcccctgatgacctacaagctgcacaaggacttcatcatcgctgtgaagagtgatgaccagaactacagagtggaggccgtgcacgccctggtgcacaagctgcctgagaagaaccgggagatgctggacatcctgatcaagcacctggtgaaggtgtccctgcacagccagcagaacctgatgacagtgagcaacctgggcgtcatcttcggccccaccctgatgagggcccaggaggagaccgtggccgccatgatgaacatcaagttccagaacatcgtggtggagatcctgattgagcactatgagaagatcttccacacagccccagaccccagcatccccctgccccagccccagagccgcagcggcagcaggaggacccgggccatctgcctgagcacaggcagcaggaagccccggggccgctacaccccctgcctggccgagccagacagcgacagctacagcagcagcccagacagcacccccatgggcagcattgagagcctgagcagccacagcagcgagcagaacagcaccaccaagagcgccagctgccagccccgggagaagagcggcggcatcccctggatcgccacccccagcagcagcaatggccagaagagcctgggcctgtggaccaccagccctgagagcagcagccgggaggatgccaccaagacagatgctgagagtgactgccagagcgtggcctctgtgaccagccctggagatgtgtccccacccatcgacctggtgaagaaggagccctacggcctgagcggcctgaagagggccagcgccagcagcctgcggagcatctctgctgctgagggcaacaagagctacagcggcagcatccagagcctgacctctgtgggcagcaaggagacccccaaggccagccccaacccagacctgccccccaagatgtgccggcggctgcggctggacacagccagcagcaatggctaccagaggcctggctctgtggtggccgccaaggcccagctgtttgaaaatgtgggcagccccaagcctgtgagcagcggccggcaggccaaggccatgtacagctgcaaggccgagcacagccatgagctgtccttcccccagggcgccatcttcagcaatgtgtaccccagcgtggagcccggctggctgaaggccacctatgagggcaagacaggcctggtgcctgagaactacgtggtgttcctgtag

SEQ ID NO: 41857 - DNA, 1647 bp, Artificial Sequence
  Description of Artificial Sequence: Synthetic coding sequence
atgcagcccggcctgagccctggcagccctggggaccccaggcctcccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcagtgggtgcggctggaggacccccacggcaagccctacttctacaaccctgaggacagctctgtgcgctgggagctgccccaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcatgattctgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcactggagccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgcagggtcatcgagcacggggagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 41858 - DNA, 1200 bp, Artificial Sequence
  Description of Artificial Sequence: Synthetic coding sequence
atggtggacatcatcgccaaggtgacccggcggcagagccgggccctgcctgcccaggtggatgatcctcctgagcctgtgtatgccaacatcgagcggcagccccgggccaccagccctggagctgctgctgcccccctgcccagccctgtgtgggagacccacacagatgctggcaccggccggccctactactacaacccagacaccggggtgaccacctgggagagcccctttgaagctgctgagggcgccgccagccctgccaccagccctgcctctgtggacagccacgtgtccctggagacagagtggggccagtactgggatgaggagagccggcgggtcttcttctacaaccccctgactggagaaacagcctgggaggatgaagcagaaaatgaacctgaggaggagctggagatgcagcccggcctgagccctggcagccctggggacccccggccccccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcagtgggtgcggctggaggacccccacggcaagccctacttctacaaccctgaggacagctctgtgcgctgggagctgccccaggtgcctgtgcctgcccccaggagcatccacaagagcagccaggatggagacaccccagcccaggccagccccccagaggagaagaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcacgacagcgaggccatcatcagcacctggcacaaggccatcgcccagggcatccaggagctggtgtcccgggcccagggcctgtag

SEQ ID NO: 41859 - DNA, 1647 bp, Artificial Sequence; identical to SEQ ID NO: 41857
  Description of Artificial Sequence: Synthetic coding sequence

SEQ ID NO: 41860 - DNA, 2589 bp, Artificial Sequence
  Description of Artificial Sequence: Synthetic coding sequence
atggctgctgatgtggtgggagatgtgtatgtgctggtggagcacccctttgagtacaccgggaaggatggaagaagagtggccatccggcccaatgaaagataccgcctgctgcggcgcagcacagagcactggtggcacgtgagaagagagcccggcggccggcccttctacctgcctgcccagtatgtgcgggagctgcctgccctgggcaacccagctgctgctgcccctcctggcccccaccccagccctgctgcccctgagcccctggcctatgactacagatttgtgtctgctgctgccacagctggcccagatggagcccctgaggagagcggcggccgcaccagcagcctgtgtggccctgcccagagaggagctgccacccagaggagcagcctggcccctggcctgcctgcctgcctgtacctgcggcctgctgcccctgtgcggcctgcccagagcctgaatgacctggcctgtgccgctgtgtccccacctgctggcctgctgggcagcagcggcagcttcaaggcctgcagcgtggccggctcctgggtgtgcccccggcccctggcccggagtgacagtgaaaatgtgtatgaggtgatccaggacctgcacgtgcccccccgggaggagagcgctgagcaggtggatgatcctcctgagcctgtgtatgccaacatcgagcggcagccccgggccaccagccctggagctgctgctgcccccctgcccagccctgtgtgggagacccacacagatgctggcaccggccggccctactactacaacccagacaccggggtgaccacctgggagagcccctttgaagctgctgagggcgccgccagccctgccaccagccctgcctctgtggacagccacgtgtccctggagacagagtggggccagtactgggatgaggagagccggcgggtcttcttctacaaccccctgactggagaaacagcctgggaggatgaagcagaaaatgaacctgaggaggagctggagatgcagcccggcctgagccctggcagccctggggacccccggccccccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcatgattctgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcactggagccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgcagggtcatcgagcacggggagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 41861 - DNA, 792 bp, Artificial Sequence
  Description of Artificial Sequence: Synthetic coding sequence
atggctgctgatgtggtgggagatgtgtatgtgctggtggagcacccctttgagtacaccgggaaggatggaagaagagtggccatccggcccaatgaaagataccgcctgctgcggcgcagcacagagcactggtggcacgtgagaagagagcccggcggccggcccttctacctgcctgcccagtatgtgcgggagctgcctgccctgggcaacccagctgctgctgcccctcctggcccccaccccagccctgctgcccctgagcccctggcctatgactacagatttgtgtctgctgctgccacagctggcccagatggagcccctgaggagagcggcggccgcaccagcagcctgtgtggccctgcccagagaggagctgccacccagaggagcagcctggcccctggcctgcctgcctgcctgtacctgcggcctgctgcccctgtgcggcctgcccagagcctgaatgacctggcctgtgccgctgtgtccccacctgctggcctgctgggcagcagcggcagcttcaaggcctgcagcgtggccggctcctgggtgtgcccccggcccctggcccggagtgacagtgaaaatgtgtatgaggtgatccaggacctgcacgtgcccccccgggaggagagcgctgagcaggtgcccccccgggccctgggccggggcggcggctggagggcccgggaccgggccaggacagagcccggcaggaaggagaccaggtctgcccagaggcgggcccggcggccccccctgtctgaggactttggatag

SEQ ID NO: 41862 - DNA, 2526 bp, Artificial Sequence
  Description of Artificial Sequence: Synthetic coding sequence
atgtctgcccagagcctgcctgctgccaccccacccacccagaagccaccccgcatcatccggccccggccccccagccgcagccgggccgcccagagccctggccccccccacaacggcagcagcccccaggagctgcccaggaacagcaatgatgcccccacccccatgtgcacccccatcttctgggagcccccagctgccagcctgaagcccccagccctgctgcccccatctgccagccgggccagcctggacagccagaccagcccagacagccccagcagcacccccacccccagccctgtgtccagaagaagtgccagccctgagcccgcccccaggagccctgtgcccccacccaagcccagcggcagcccctgcacccccctgctgcccatggccggcgtgctggcccagaatggaagtgccagcgcccctggcaccgtgcggcggctggccggccgctttgaaggaggagctgagggccgggcccaggatgctgatgcccctgagcccggcctgcaggcccgggcagatgtgaatggagagcgggaggcccccctgaccggcagcggcagccaggagaatggagccccagatgctggcctggcctgccccccctgctgcccctgtgtgtgccacaccaccaggcctggcctggagctgcgctgggtgcctgtgggcggctatgaggaggtgccccgggtgccccggcgggccagccccctgcggaccagccgcagccggccccaccccccatccatcggccaccctgctgtggtgctgaccagctaccgcagcacagctgagaggaagctgctgcccctgctgaagccacccaagcccaccagggtgcggcaggatgccaccatctttggagaccccccccagcctgacctggacctgctgtctgaagatggcatccagacaggagacagcccagatgaggccccccagaacaccccaccagccaccgtggagggccgggaggaggagggcctggaggtgctgaaggagcagaactgggagctgcccctgcaggatgagcccctgtaccagacctacagagctgctgtgctgtctgaggagctgtggggcgtgggggaggatggcagccccagccctgccaatgctggagatgcccccaccttcccccggcccccaggccccaggaacaccctgtggcaggagctgcctgctgtgcaggccagcggcctgctggacaccctgagcccccaggagaggaggatgcaggagagcctgtttgaggtggtgaccagcgaggccagctacctgcggagcctgcggctgctgacagacacctttgtgctgagccaggccctgcgggacaccctgaccccccgggaccaccacaccctcttcagcaatgtgcagagggtgcagggcgtgtctgagcgcttcctggccaccctgctgagccgggtgcgcagcagcccccacatcagtgacctgtgtgatgtggtgcacgcccatgctgtgggccccttctctgtgtatgtggactatgtgaggaaccagcagtaccaggaggagacctacagccggctgatggacaccaacgtgcgcttctctgctgagctgcggcggctgcagagcctgcccaagtgtgagcggctgcccctgcccagcttcctgctgctgcccttccagaggatcacccggctgaggatgctgctgcagaacatcctgcggcagacagaggagggcagcagccggcaggagaatgcccagaaggccctgggcgctgtgtccaagatcatcgagcgctgcagcgctgaggtgggccgcatgaagcagacagaggagctgatccggctgacccagaggctgcgcttccacaaggtgaaggccctgcccctggtgtcctggagccggcggctggagttccagggcgagctgacagagctgggctgcagaagaggaggagtgctgtttgccagccggccccgcttcacccccctgtgcctgctgctcttcagtgacctgctgctgatcacccagcccaagagcggccagaggctgcaggtgctggactatgcccacaggagcctggtgcaggcccagcaggtgcctgaccccagcggcccccccaccttccggctgagcctgctgagcaaccaccagggccggcccacccaccggctgctgcaggccagcagcctgagtgacatgcagcgctggctgggcgccttccccaccccaggccccctgccctgcagcccagacaccatctatgaggactgtgactgcagccaggagctgtgcagcgagagcagcgccccagccaagacagagggccgcagcctggagagcagagctgcccccaagcacctgcacaagaccccagagggctggctgaagggcctgcccggggccttccctgcccagctggtgtgtgaggtgactggagaacatgaaagaagaagacacctgcggcagaaccagaggctgctggaggccgtgggcagcagcagcggcaccccaaatgcccccccaccctag

SEQ ID NO: 41863 - DNA, 2526 bp, Artificial Sequence; identical to SEQ ID NO: 41862
  Description of Artificial Sequence: Synthetic coding sequence

SEQ ID NO: 41864 - DNA, 1896 bp, Artificial Sequence
  Description of Artificial Sequence: Synthetic coding sequence
atggcccccctgcacaagaactacccagagacccccatgatgcaccagccccagtgtgccccacccagcagcggcagcccccagctgcaccccagcagccccctgctcttctgccccccccagaatggcagcgccagcgcccctggcaccgtgcggcggctggccggccgctttgagggcggcgctgagggccgggcccaggatgctgatgcccctgagcccggcctgcaggcccgggcagatgtgaatggagagcgggaggcccccctgactggaagtggcagccaggagaatggagcccctggggacagcccagatgaggccccccagaacaccccaccagccaccgtggagggccgggaggaggagggcctggaggtgctgaaggagcagaactgggagctgcccctgcaggatgagcccctgtaccagacctacagagctgctgtgctgtctgaggagctgtggggcgtgggggaggatggcagccccagccctgccaatgctggagatgcccccaccttcccccggcccccaggccccaggaacaccctgtggcaggagctgcctgctgtgcaggccagcggcctgctggacaccctgagcccccaggagaggaggatgcaggagagcctgtttgaggtggtgaccagcgaggccagctacctgcggagcctgcggctgctgacagacacctttgtgctgagccaggccctgcgggacaccctgaccccccgggaccaccacaccctcttcagcaatgtgcagagggtgcagggcgtgtctgagcgcttcctggccaccctgctgagccgggtgcgcagcagcccccacatcagtgacctgtgtgatgtggtgcacgcccatgctgtgggccccttctctgtgtatgtggactatgtgaggaaccagcagtaccaggaggagacctacagccggctgatggacaccaacgtgcgcttctctgctgagctgcggcggctgcagagcctgcccaagtgtgagcggctgcccctgcccagcttcctgctgctgcccttccagaggatcacccggctgaggatgctgctgcagaacatcctgcggcagacagaggagggcagcagccggcaggagaatgcccagaaggccctgggcgctgtgtccaagatcatcgagcgctgcagcgctgaggtgggccgcatgaagcagacagaggagctgatccggctgacccagaggctgcgcttccacaaggtgaaggccctgcccctggtgtcctggagccggcggctggagttccagggcgagctgacagagctgggctgcagaagaggaggagtgctgtttgccagccggccccgcttcacccccctgtgcctgctgctcttcagtgacctgctgctgatcacccagcccaagagcggccagaggctgcaggtgctggactatgcccacaggagcctggtgcaggcccagcaggtgcctgaccccagcggcccccccaccttccggctgagcctgctgagcaaccaccagggccggcccacccaccggctgctgcaggccagcagcctgagtgacatgcagcgctggctgggcgccttccccaccccaggccccctgccctgcagcccagacaccatctatgaggactgtgactgcagccaggagctgtgcagcgagagcagcgccccagccaagacagagggccgcagcctggagagcagagctgcccccaagcacctgcacaagaccccagagggctggctgaagggcctgcccggggccttccctgcccagctggtgtgtgaggtgactggagaacatgaaagaagaagacacctgcggcagaaccagaggctgctggaggccgtgggcagcagcagcggcaccccaaatgcccccccaccctag

SEQ ID NO: 41865 - DNA, 2616 bp, Artificial Sequence
  Description of Artificial Sequence: Synthetic coding sequence
atggatggagagagcgaggtggacttcagcagcaacagcatcacccccctgtggaggcggcgcagcatcccccagccccaccaggtgctgggccgcagcaagccccggccccagagctaccagagccccaacggcctgctgatcacagacttccctgtggaggatggcggcaccctgctggccgcccagatcccagcccaggtgcccacagccagtgacagcaggacagtgcacaggagccccctgctgctgggcgcccagaggagagctgtggccaatggaggaacagccagccctgagtacagagctgccagcccccggctgcggcggcccaagagccccaagctgcccaaggctgtgcctgggggcagccccaagagccctgccaacggggctgtgaccctgcctgcccctcctcctcctcctgtgctgcggccccccaggaccccaaatgccccagccccctgcaccccagaggaggacctgaccggcctgacagccagccctgtgcccagccccacagccaacggcctggccgccaacaatgacagccctggcagcggcagccagagcggcaggaaggccaaggaccctgagcggggcctcttccctggcccccagaagagcagcagcgagcagaagctgcccctgcagaggctgcccagccaggagaatgagctgctggagaaccccagcgtggtgctgagcaccaacagccctgctgccctgaaggtgggcaagcagcagatcatccccaagagcctggccagcgagatcaagatcagcaagagcaacaaccagaatgtggagccccacaagaggctgctgaaggtgcgctccatggtggagggcctgggcggccccctgggccacgccggggaggagagcgaggtggacaatgatgtggacagccctggcagcctgcggcggggcctgcggagcaccagctaccgccgggctgtggtgtctggctttgattttgacagccccaccagcagcaagaagaagaacaggatgagccagcctgtgctgaaggtggtgatggaggacaaggagaagttcagcagcctgggccgcatcaagaagaagatgctgaagggccagggcacctttgatggagaagaaaatgctgtgctgtaccagaactacaaggagaaggccctggacatcgacagtgatgaggagagcgagcccaaggagcagaagagtgatgagaagatcgtcatccaccacaagcccctgcggagcacctggagccagctgtctgctgtgaagaggaagggcctgagccagacagtgtcccaggaggagaggaagaggcaggaggccatctttgaagtcatcagcagcgagcacagctacctgctgagcctggagatcctgatccgcatgttcaagaacagcaaggagctgagtgacaccatgaccaagacagagcggcaccacctgttcagcaacatcacagatgtgtgtgaggccagcaagaagttcttcatcgagctggaggcccggcaccagaacaacatcttcattgatgacatcagtgacatcgtggagaagcacacagccagcacctttgacccctacgtgaagtactgcaccaatgaggtgtaccagcagaggaccctgcagaagctgctggccaccaaccccagcttcaaggaggtgctgagccgcatcgagagccatgaggactgcaggaacctgcccatgatctccttcctgatcctgcccatgcagagggtgacccggctgcccctgctgatggacaccatctgccagaagacccccaaggacagccccaagtatgaggtgtgcaagagggccctgaaggaggtgtccaagctggtgcggctgtgcaatgaaggagccaggaagatggagaggacagagatgatgtacaccatcaacagccagctggagttcaagatcaagcccttccccctggtgagcagcagccgctggctggtgaagagaggagagctgacagcctacgtggaggacacagtgctcttcagcaggaggaccagcaagcagcaggtgtacttcttcctgttcaatgatgtgctgatcatcaccaagaagaagtctgaggagagctacaacgtgaatgactacagcctgcgggaccagctgctggtggagagctgtgacaatgaggagctgaacagcagccctgggaagaacagcagcaccatgctgtacagccggcagagcagcgccagccacctgttcaccctgactgtgctgagcaaccacgccaatgagaaggtggagatgctgctgggcgctgagacccagagcgagcgggcccgctggatcacagccctgggccacagcagcggcaagcccccagctgacaggaccagcctgacccaggtggagatcgtgcgctccttcaccgccaagcagccagatgagctgagcctgcaggtggctgatgtggtgctgatctaccagagggtgtctgatggctggtatgaaggagagcggctgagagatggagagcggggctggttccccatggagtgtgccaaggagatcacctgccaggccaccatcgacaagaatgtggagaggatgggccgcctgctgggcctggagaccaacgtgtag

SEQ ID NO: 41866 - DNA, 2616 bp, Artificial Sequence; identical to SEQ ID NO: 41865
  Description of Artificial Sequence: Synthetic coding sequence

SEQ ID NO: 41867 - DNA, 1341 bp, Artificial Sequence
  Description of Artificial Sequence: Synthetic coding sequence
atggatggagagagcgaggtggacttcagcagcaacagcatcacccccctgtggaggcggcgcagcatcccccagccccaccaggtgctgggccgcagcaagccccggccccagagctaccagagccccaacggcctgctgatcacagacttccctgtggaggatggcggcaccctgctggccgcccagatcccagcccaggtgcccacagccagtgacagcaggacagtgcacaggagccccctgctgctgggcgcccagaggagagctgtggccaatggaggaacagccagccctgagtacagagctgccagcccccggctgcggcggcccaagagccccaagctgcccaaggctgtgcctgggggcagccccaagagccctgccaacggggctgtgaccctgcctgcccctcctcctcctcctgtgctgcggccccccaggaccccaaatgccccagccccctgcaccccagaggaggacctgaccggcctgacagccagccctgtgcccagccccacagccaacggcctggccgccaacaatgacagccctggcagcggcagccagagcggcaggaaggccaaggaccctgagcggggcctcttccctggcccccagaagagcagcagcgagcagaagctgcccctgcagaggctgcccagccaggagaatgagctgctggagaaccccagcgtggtgctgagcaccaacagccctgctgccctgaaggtgggcaagcagcagatcatccccaagagcctggccagcgagatcaagatcagcaagagcaacaaccagaatgtggagccccacaagaggctgctgaaggtgcgctccatggtggagggcctgggcggccccctgggccacgccggggaggagagcgaggtggacaatgatgtggacagccctggcagcctgcggcggggcctgcggagcaccagctaccgccgggctgtggtgtctggctttgattttgacagccccaccagcagcaagaagaagaacaggatgagccagcctgtgctgaaggtggtgatggaggacaaggagaagttcagcagcctgggccgcatcaagaagaagatgctgaagggccagggcacctttgatggagaagaaaatgctgtgctgtaccagaactacaaggagaaggccctggacatcgacagtgatgaggagagcgagcccaaggagcagaagagtgatgagaagatcgtcatccaccacaagcccctgcggagcacctggagccagctgtctgctgtgaagaggaaggtgatcctgattgtgggcttcatggagatgaaggatggccgcctgcggggcggcaagtag

SEQ ID NO: 41868 - DNA, 2376 bp, Artificial Sequence
  Description of Artificial Sequence: Synthetic coding sequence
atggatggagagagcgaggtggacttcagcagcaacagcatcacccccctgtggaggcggcgcagcatcccccagccccaccaggtgctgggccgcagcaagccccggccccagagctaccagagccccaacggcctgctgatcacagacttccctgtggaggatggcggcaccctgctggccgcccagatcccagcccaggtgcccacagccagtgacagcaggacagtgcacaggagccccctgctgctgggcgcccagaggagagctgtggccaatggaggaacagccagccctgagtacagagctgccagcccccggctgcggcggcccaagagccccaagctgcccaaggctgtgcctgggggcagccccaagagccctgccaacggggctgtgaccctgcctgcccctcctcctcctcctgtgctgcggccccccaggaccccaaatgccccagccccctgcaccccagaggaggacctgaccggcctgacagccagccctgtgcccagccccacagccaacggcctggccgccaacaatgacagccctggcagcggcagccagagcggcaggaaggccaaggaccctgagcggggcctcttccctggcccccagaagagcagcagcgagcagaagctgcccctgcagaggctgcccagccaggagaatgagctgctggagaaccccagcgtggtgctgagcaccaacagccctgctgccctgaaggtgggcaagcagcagatcatccccaagagcctggccagcgagatcaagatcagcaagagcaacaaccagaatgtggagccccacaagaggctgctgaaggtgcgctccatggtggagggcctgggcggccccctgggccacgccggggaggagagcgaggtggacaatgatgtggacagccctggcagcctgcggcggggcctgcggagcaccagctaccgccgggctgtggtgtctggctttgattttgacagccccaccagcagcaagaagaagaacaggatgagccagcctgtgctgaaggtggtgatggaggacaaggagaagttcagcagcctgggccgcatcaagaagaagatgctgaagggccagggcacctttgatggagaagaaaatgctgtgctgtaccagaactacaaggagaaggccctggacatcgacagtgatgaggagagcgagcccaaggagcagaagagtgatgagaagatcgtcatccaccacaagcccctgcggagcacctggagccagctgtctgctgtgaagaggaagggcctgagccagacagtgtcccaggaggagaggaagaggcaggaggccatctttgaagtcatcagcagcgagcacagctacctgctgagcctggagatcctgatccgcatgttcaagaacagcaaggagctgagtgacaccatgaccaagacagagcggcaccacctgttcagcaacatcacagatgtgtgtgaggccagcaagaagttcttcatcgagctggaggcccggcaccagaacaacatcttcattgatgacatcagtgacatcgtggagaagcacacagccagcacctttgacccctacgtgaagtactgcaccaatgaggtgtaccagcagaggaccctgcagaagctgctggccaccaaccccagcttcaaggaggtgctgagccgcatcgagagccatgaggactgcaggaacctgcccatgatctccttcctgatcctgcccatgcagagggtgacccggctgcccctgctgatggacaccatctgccagaagacccccaaggacagccccaagtatgaggtgtgcaagagggccctgaaggaggtgtccaagctggtgcggctgtgcaatgaaggagccaggaagatggagaggacagagatgatgtacaccatcaacagccagctggagttcaagatcaagcccttccccctggtgagcagcagccgctggctggtgaagagaggagagctgacagcctacgtggaggacacagtgctcttcagcaggaggaccagcaagcagcaggtgtacttcttcctgttcaatgatgtgctgatcatcaccaagaagaagtctgaggagagctacaacgtgaatgactacagcctgcgggaccagctgctggtggagagctgtgacaatgaggagctgaacagcagccctgggaagaacagcagcaccatgctgtacagccggcagagcagcgccagccacctgttcaccctgactgtgctgagcaaccacgccaatgagaaggtggagatgctgctgggcgctgagacccagagcgagcgggcccgctggatcacagccctgggccacagcagcggcaagcccccagctgacaggacctgtggctag

SEQ ID NO: 41869 - DNA, 2613 bp, Artificial Sequence
  Description of Artificial Sequence: Synthetic coding sequence
atggagaagaccaagaccaagcagggagaaaatgagcacatgcctgtgaacaaccccagcacccagatctaccagctgcaggccctggccagcgagctgaagacaggcttcacagaggccatgcaggagctgagccgcatccagcacggggagtatgccctggaggagaaggtgaagagctgccgctgcagcatggaggagaaggtgacagagatgaagaacagcctgaactacttcaaggaggagctgagcaatgccatgtccatgatccaggccatcaccagcaagcaggaggagatgcagcagaagattgagcagctgcagcaggagaagaggcgggagagcaggaaggtgaaggccaagaagacccagaaggaggagcacagcagccaggccggccctgcccaggcccagggcagccccttccgcagcatcaacatccctgagcctgtgctgcccagcgaggacttcaccaacctgctgcccagccaggcctatgagaaggcccaggagagccgctctgtgcacgtgggggacagcaatgtgaagggcatgatgggccctggggtgaaccccaccaccccagaggccgaggagaacctgaagagctgcctgtctgctgacatccagagcaagggccacctgcccagcggcatgtggaggcagcccaaggatggcaaggagtggggcgaggagtatgtgaccaaggaccacccagacaagctgaaggaggccggccagggccgccacagcagcctggagaatgtgctgtgtgagaccagcctggccgccaagaggcagacagtggccctggagctgctggagagcgagaggaaatatgtgatcaacatcagcctcatcctgaagatcaaggccaccttccagggcagtgatggcaagaggaacagcaaggagaggagcctcttccctggcagcctgcgctacctggtgcagcagcacctggacctgctgcacgccctgcaggagcgggtgctgaagtggccccggcagggcgtgctgggggacctcttcctgaagctgaccaatgatgagaacaacttcctggactactacgtggcctacctgcgggacctgcctgagtgcatcagcctggtgcacgtggtggtgctgaaggagggagatgaggagatcaagagtgacatctacaccctcttcttccacatcgtgcagagaattcctgagtacctgatccacctgcagaatgtgctgaagttcacagagcaggagcacccagactactacctgctgctggtgtgtgtgcagaggctgcgggtcttcatcagccactacaccctgctcttccagtgcaatgaagacctgctgatccagaagaggaagaagctgaagaagagctccatggccaagctgtacaagggcctggccagccagtgtgccaatgccggccaggatgccagccccacagctggccctgaggccgtgcgggacaccggcatccacagcgaggagctgctgcagccctaccccagcgcccccagcagcggccctgccatcacccacctgatgcctcctgtgaagaagagccagcagcagcagagcctgatggagagcatgcagcccgggaagcccagcgactgggagctggagggcaggaagcatgagaggcctgagagcctgctggcccccacccagttctgtgccgctgagcaggatgtgaaggccctggccggccccctgcaggccatccctgagatggactttgagagcagccctgctgagcccctgggcaatgtggagaggagcctgcgggccccagctgagctgctgcctgatgcccggggctttgtgcctgctgcctatgaggagtttgaatatggaggagagatctttgccctgcctgccccctatgatgaggagcccttccaggccccagccctgtttgagaactgcagccctgccagcagcgagagcagcctggacatctgcttcctgcggcctgtgtcctttgccatggaggccgagaggcctgagcaccccctgcagcccctgcccaagagcgccaccagccctgctggcagcagcagcgcctacaagctggaggccgccgcccaggcccacggcaaggccaagcccctgagccgcagcctgaaggagttcccccgggcccccccagcagatggagtggccccccggctgtacagcaccaggagcagcagcggcggccgggcccccatcaaggccgagagagctgcccaggcccacggccctgctgctgctgctgtggccgcccggggggccagcaggaccttcttcccccagcagaggagccagagcgagaagcagacctacctggaggtgcggcgggagatgcacctggaggacaccacccgcttctgccccaaggaggagcgggagagcgagcagaccagcttcagtgaccagaacccccggcaggaccagaagggcggcttccgcagcagcttcaggaagctgttcaagaagaagagcagcggcagcgagtaccgggagaagaccaatgaaaaccccagcatggaccccagccccaccaagcaggacttcttcaggaaccggctggccctggccaatgacctggaccagggcacagctgtgtag

SEQ ID NO: 41870 - DNA, 2535 bp, Artificial Sequence
  Description of Artificial Sequence: Synthetic coding sequence
atggagaagaccaagaccaagcagggagaaaatgagcacatgcctgtgaacaaccccagcacccagatctaccagctgcaggccctggccagcgagctgaagacaggcttcacagaggccatgcaggagctgagccgcatccagcacggggagtatgccctggaggagaaggtgaagagctgccgctgcagcatggaggagaaggtgacagagatgaagaacagcctgaactacttcaaggaggagctgagcaatgccatgtccatgatccaggccatcaccagcaagcaggaggagatgcagcagaagattgagcagctgcagcaggagaagaggcgggagagcaggaaggtgaaggccaagaagacccagaaggaggagcacagcagccaggccggccctgcccaggcccagggcagccccttccgcagcatcaacatccctgagcctgtgctgcccagcgaggacttcaccaacctgctgcccagccaggcctatgagaaggcccaggagagccgctctgtgcacgtgggggacagcaatgtgaagggcatgatgggccctggggtgaaccccaccaccccagaggccgaggagaacctgaagagctgcctgtctgctgacatccagagcaagggccacctgcccagcggcatgtggaggcagcccaaggatggcaaggagtggggcgaggagtatgtgaccaaggaccacccagacaagctgaaggaggccggccagggccgccacagcagcctggagaatgtgctgtgtgagaccagcctggccgccaagaggcagacagtggccctggagctgctggagagcgagaggaaatatgtgatcaacatcagcctcatcctgaagatcaaggccaccttccagggcagtgatggcaagaggaacagcaaggagaggagcctcttccctggcagcctgcgctacctggtgcagcagcacctggacctgctgcacgccctgcaggagcgggtgctgaagtggccccggcagggcgtgctgggggacctcttcctgaagctgaccaatgatgagaacaacttcctggactactacgtggcctacctgcgggacctgcctgagtgcatcagcctggtgcacgtggtggtgctgaaggagggagatgaggagatcaagagtgacatctacaccctcttcttccacatcgtgcagagaattcctgagtacctgatccacctgcagaatgtgctgaagttcacagagcaggagcacccagactactacctgctgctggtgtgtgtgcagaggctgcgggtcttcatcagccactacaccctgctcttccagtgcaatgaagacctgctgatccagaagaggaagaagctgaagaagagctccatggccaagctgtacaagggcctggccagccagtgtgccaatgccggccaggatgccagccccacagctggccctgaggccgtgcgggacaccggcatccacagcgaggagctgctgcagccctaccccagcgcccccagcagcggccctgccatcacccacctgatgcctcctgtgaagaagagccagcagcagcagagcctgatggagagcatgcagcccgggaagcccagcgactgggagctggagggcaggaagcatgagaggcctgagagcctgctggcccccacccagttctgtgccgctgagcaggatgtgaaggccctggccggccccctgcaggccatccctgagatggactttgagagcagccctgctgagcccctgggcaatgtggagaggagcctgcgggccccagctgagctgctgcctgatgcccggggctttgtgcctgctgcctatgaggagtttgaatatggaggagagatctttgccctgcctgccccctatgatgaggagcccttccaggccccagccctgtttgagaactgcagccctgccagcagcgagagcagcctggacatctgcttcctgcggcctgtgtcctttgccatggaggccgagaggcctgagcaccccctgcagcccctgcccaagagcgccaccagccctgctggcagcagcagcgcctacaagctggaggccgccgcccaggcccacggcaaggccaagcccctgagccgcagcctgaaggagttcccccgggcccccccagcagatggagtggccccccggctgtacagcaccaggagcagcagcggcggccgggcccccatcaaggccgagagagctgcccaggcccacggccctgctgctgctgctgtggccgcccggggggccagcaggaccttcttcccccagcagaggagccagagcgagaagcagacctacctggaggtgcggcgggagatgcacctggaggacaccacccgcttctgccccaaggaggagcgggagagcgagcagaccagcttcagtgaccagaacccccggcaggaccagaagggcggcttccgcagcagcttcaggaagctgttcaagaagaagaatggaaatgccactggagaggacttctgtggcccctggggctggtggtag

SEQ ID NO: 41871 - DNA, 2613 bp, Artificial Sequence; identical to SEQ ID NO: 41869
  Description of Artificial Sequence: Synthetic coding sequence

SEQ ID NO: 41872 - DNA, 1455 bp, Artificial Sequence
  Description of Artificial Sequence: Synthetic coding sequence
atggaggccgaggaggcccagcacggggccagcccccccatcagcgccatcgaggagttcagcatcatccctgaggcccccatgaggagcagccaggtgtctgccctgggcctggaggcccaggaggatgaggaccccagctacaagtggagggaggagcaccggctgagcgccacccagcagagcgagctgagagatgtgtgtgactatgccatcgagaccatgcccagcttccccaaggagggcagcgcagatgtggagcccaaccaggagagcctggtggccgaggcctgtgacaccccagagcactgggaggccgtgccccagagcctggccggccggcaggcccggaccctggcccctcctgagctgtgggcctgccccatccagagcgagcacctggacatggcccccttcagcagtgacctgggcagcgaggaggaggaggtggagttctggccaggcctgaccagcctgaccctgggcagcggccaggccgaggaggaggaggagaccagcagtgacaacagcggccagacccgctactacagcccctgtgaggagcaccctgctgagaccaaccagaatgaaggagctgagagcggcaccatccggcagggcgaggagctgcccagcgaggagctgcaggagagccagggcctgctgcacccccaggaggtgcaggtgctggaggagcagggccagcaggaggccggcttccggggggagggcaccctgcgggaggatgtgtgtgctgatggcctgctgggggaggagcagatgattgagcaggtgaatgatgagaagggggagcagaagcagaagcaggagcaggtgcaggatgtgatgctgggccggcagggcgagaggatgggcctgaccggggagcctgagggcctgaatgatggagagtgggagcaggaggacatggagaggaaggcccagggccagggcggccctgagcagggcgaggagaggaagcgggagctgcaggtgcctgaagaaaatagagctgacagccaggatgagaagagccagaccttcctgggcaagtctgaggaggtgacaggcaagcaggaggaccacggcatcaaggagaagggcgtgcctgtgtctggccaggaggccaaggagcctgagagctgggatggcggccgcctgggcgctgtgggccgggcccggagccgggaggaggagaatgagcaccacggccccagcatgcctgccctgattgcccctgaggacagcccccactgtgacctcttccctggggccagctacctggtgacccagatccctggcacccagacagagagcagagctgaggagctgagccctgctgccctgagccccctgctggagcccatccgctgcagccaccagcccatcagcctgctgggcagcttcctgacagaggagagcccagacaaggagaagctgctgtctgtgctgtag

SEQ ID NO: 41873 - DNA, 1455 bp, Artificial Sequence; identical to SEQ ID NO: 41872
  Description of Artificial Sequence: Synthetic coding sequence

SEQ ID NO: 41874 - DNA, 672 bp, Artificial Sequence
  Description of Artificial Sequence: Synthetic coding sequence
atgctgggcgtgaccaccgtgcgcagcaggatgaggcgggccctggtgtttggcatggtggtgcccagcgtgctggtgccctggctgctgctgggcgcctcctggctgatcccccagaccagcttcctgagcaatgtgtgtggcctgagcatcggcctggcctacggcctgacctactgctacagcattgacctgtctgagcgggtggccctgaagctggaccagaccttccccttcagcctgatgaggcgcatcagcgtcttcaagtatgtgtctggcagcagcgctgagcggcgggccgcccagagcaggaagctgaaccctgtgcccggcagctaccccacccagagctgccacccccacctgagccccagccaccctgtgtcccagacccagcacgccagcggccagaagctggcctcctggcccagctgcaccccaggccacatgcccaccctgcccccctaccagcctgccagcggcctgtgctacgtgcagaaccacttcggccccaaccccaccagcagctctgtgtacccagccagcgctggcaccagcctgggcatccagccccccacccctgtgaacagccctggcaccgtgtacagcggggccctgggcaccccaggagctgctggcagcaaggagagcagccgggtgcccatgccctag

SEQ ID NO: 41875 - DNA, 2013 bp, Artificial Sequence
  Description of Artificial Sequence: Synthetic coding sequence
atgatcctggaggagaggccagatggagctggggccggggaggagagcccccggctgcagggctgtgacagcctgacccagatccagtgtggccagctgcagagccggcgggcccagatccaccagcagattgacaaggagctgcagatgaggactggagcagaaaatctctaccgggccaccagcaacaacagagtgcgggagaccgtggccctggagctgtcctatgtgaacagcaacctgcagctgctgaaggaggagctggaggagctgagcggcggcgtggaccccggccgccacggcagcgaggccgtgacagtgcccatgatccccctgggcctgaaggagaccaaggagctggactggagcacccccctgaaggagctgatctctgtgcactttggagaagatggagccagctatgaagctgagatccgggagctggaggccctgcggcaggccatgaggacccccagcagaaatgaaagtggcctggagctgctgacagcctactacaaccagctgtgcttcctggatgcccgcttcctgaccccagcccggagcctgggcctcttcttccactggtatgacagcctgactggagtgcctgcccagcagagggccctggcctttgagaagggctctgtgctcttcaacatcggggccctgcacacccagattggagcccggcaggacaggagctgcacagagggcgcccggcgggccatggaggccttccagagagctgctggggccttcagcctgctgcgggagaacttcagccacgcccccagcccagacatgtctgctgccagcctgtgtgccctggagcagctgatgatggcccaggcccaggagtgtgtgtttgagggcctgagccccccagcctccatggccccccaggactgcctggcccagctgcggctggcccaggaggccgcccaggtggccgctgagtaccgcctggtgcacaggaccatggcccagccccctgtgcatgactatgtgcctgtgtcctggacagccctggtgcacgtgaaggccgagtacttccgcagcctggcccactaccacgtggccatggccctgtgtgatggcagccctgccacagaaggagagctgcccacccatgagcaggtgttcctgcagccccccaccagcagcaagccccggggccctgtgctgccccaggagctggaggagcggcggcagctgggcaaggcccacctgaagagggccatcctgggccaggaggaggccctgcggctgcacgccctgtgccgggtgctgcgggaggtggacctgctgcgggccgtcatcagccagaccctgcagaggagcctggccaagtatgcagagctggacagagaagatgacttctgtgaggccgctgaggccccagacatccagcccaagacccaccagaagccagaggccaggatgccccggctgagccagggcaagggccctgacatcttccaccggctgggccccctgagcgtcttcagcgccaagaaccgctggaggctggtgggccctgtgcacctgaccagaggagagggcggcttcggcctgaccctgcggggggacagccctgtgctgattgctgctgtgattcctggcagccaggccgctgctgctggcctgaaggagggggactacatcgtgtctgtgaatggccagccctgccgctggtggaggcatgctgaggtggtgacagagctgaaggccgccggggaggccggggccagcctgcaggtggtgtccctgctgcccagcagccggctgcccagcctgggggaccggcggcctgtgctgctgggcccccggggcctgctgcggagccagcgggagcacggctgcaagaccccagccagcacctgggccagcccccggcccctgctgaactggagcaggaaggcccagcagggcaagacaggaggctgcccccagccctgtgcccctgtgaagccagccccacccagcagcctgaagcaccctggctggccctag

SEQ ID NO: 41876 - DNA, 546 bp, Artificial Sequence
  Description of Artificial Sequence: Synthetic coding sequence
atgtacaacatcaagcagagcacagacaccaaggaggccgccgccatcgaggcccggaggaaccgggagaaggagcggcagaaccgcttcttcaacgtgaggaacagagtgatgggcgtggatgtgcaggccctgaacaaccaggtgggggacaggaagaggcgggaggccgctgagaggagcaaggaggccgcctacggcaccagccaggtgcagtatgatgtggtggtgcagatgctggagaaggaggaggccgacaggacccggcagctggccaagaaggtgcaggagttccgggagcagaagcagcagctgaagaatggccgggagttcagcctgtgggaccccggccaggtgtggaagggcctgcccacctacctgagctacagcaacacctacccaggccctgccagcctgcagtacttctctggagaggacctggaccgggacacccggctgaggatgcagcagggccagttccgctacaacctggagcggcagcagcaggagcagcagcaggccaaggtggatgagaactacacctag

SEQ ID NO: 41877 - DNA, 1140 bp, Artificial Sequence
  Description of Artificial Sequence: Synthetic coding sequence
atgtacaacatcaagcagagcacagacaccaaggaggccgccgccatcgaggcccggaggaaccgggagaaggagcggcagaaccgcttcttcaacgtgaggaacagagtgatgggcgtggatgtgcaggccctgaacaaccaggtgggggacaggaagaggcgggaggccgctgagaggagcaaggaggccgcctacggcaccagccaggtgcagtatgatgtggtggtgcagatgctggagaaggaggaggccgacaggacccggcagctggccaagaaggtgcaggagttccgggagcagaagcagcagctgaagaatggccgggagttcagcctgtgggaccccggccaggtgtggaagggcctgcccacctacctgagctacagcaacacctacccaggccctgccagcctgcagtacttctctggagaggacctggaccgggacacccggctgaggatgcagcagggccagttccgctacaacctggagcggcagcagcaggagcagcagcaggccaaggtggatgagaactacacagatgccctgagcaaccagctgcggctggccatggatgcccaggccacccacctggcccggctggaggagagctgccgggccgccatgatgtgtgccatggccaatgccaacaaggcccaggccgctgtgcaggccggccggcagagatgtgagcggcagcgggagcagaaggccaacctggccgagatccagcaccagagcaccagtgacctgctgacagagaacccccaggtggcccagcaccccatggccccctacagagtgctgccctactgctggaagggcatgaccccagagcagcaggccgccatcaggaaggagcaggaggtgcagaggagcaagaagcaggcccaccggcaggccgagaagaccctggacacagagtggaagagccagaccatgagcagcgcccaggccgtgctggagctggaggagcaggagcgggagctgtgtgctgtgttccagaggggcctgggcagcttcaaccagcagctggccaatgagcagaaggcccagcaggactacctgaacagcgtcatctacaccaaccagcccacagcccagtaccaccagcagttcaacaccagcagcaggtag

SEQ ID NO: 41878 - DNA, 717 bp, Artificial Sequence
  Description of Artificial Sequence: Synthetic coding sequence
atgtacaacatcaagcagagcacagacaccaaggaggccgccgccatcgaggcccggaggaaccgggagaaggagcggcagaaccgcttcttcaacgtgaggaacagagtgatgggcgtggatgtgcaggccctgaacaaccaggtgggggacaggaagaggcgggaggccgctgagaggagcaaggaggccgcctatgatgccctgagcaaccagctgcggctggccatggatgcccaggccacccacctggcccggctggaggagagctgcagagctgccatgatgtgtgccatggccaatgccaacaaggcccaggccgctgtgcaggccggccggcagagatgtgagcggcagcgggagcagaaggccaacctggccgagatccagcaccagagcaccagtgacctgctgacagagaacccccaggtggcccagcaccccatggccccctacagagtgctgccctactgctggaagggcatgaccccagagcagcaggccgccatcaggaaggagcaggaggtgcagaggagcaagaagcaggcccaccggcaggccgagaagaccctggacacagagtggaagagccagaccatgagcagcgcccaggccgtgctggagctggaggagcaggagcgggagctgtgtgctgtgttccagaggggcctgggcagcttcaaccagcagctggccaatgagcagaaggcccagtag

SEQ ID NO: 41879 - DNA, 579 bp, Artificial Sequence
  Description of Artificial Sequence: Synthetic coding sequence
atgtacaacatcaagcagagcacagacaccaaggaggccgccgccatcgaggcccggaggaaccgggagaaggagcggcagaaccgcttcttcaacgtgaggaacagagtgatgggcgtggatgtgcaggccctgaacaaccaggtgggggacaggaagaggcgggaggccgctgagaggagcaaggaggccgcctacggcaccagccaggtgcagtatgatgtggtggtgcagatgctggagaaggaggaggccgacaggacccggcagctggccaagaaggtgcaggagttccgggagcagaagcagcagctgaagaatggccgggagttcagcctgtgggaccccggccaggtgtggaagggcctgcccacctacctgagctacagcaacacctacccaggccctgccagcctgcagtacttctctggagaggacctggaccgggacacccggctgaggatgcagcagggccagttccgctacaacctggagcggcagcagcaggagcagcagcaggccaaggtggatgagaactacacaggcaagcagcccggccccccagacagcgagacctag

SEQ ID NO: 41880 - DNA, 930 bp, Artificial Sequence
  Description of Artificial Sequence: Synthetic coding sequence
atgaggcagaatgacaagatcatgtgcatcctggagaacaggaagaagagggacaggaagaacctgtgccgggccatcaatgacttccagcagagcttccagaagccagagacccggcgggagtttgacctgagtgaccccctggccctgaagaaggacctgcctgcccggcagagcgacaatgatgtgaggaacaccatcagcggcatgcagaagttcatgggagaggacctgaacttccacgagaggaagaagttccaggaggagcagaaccgggagtggagcctgcagcagcagcgggagtggaagaatgcccgggcagagcagaagtgtgccgaggccctgtacacagagacccggctgcagtttgatgaaacagccaagcacctgcagaagctggagagcaccaccaggaaggctgtgtgtgcctctgtgaaggacttcaacaagagccaggccatcgagagcgtggagaggaagaagcaggagaagaagcaggagcaggaggacaacctggccgagatcaccaacctgctgcggggggacctgctgtctgagaacccccagcaggccgccagcagctttggcccccaccgggtggtgcctgaccgctggaagggcatgacccaggagcagctggagcagatccggctggtgcagaagcagcagatccaggagaagctgcggctgcaggaggagaagaggcagagggacctggactgggacagaagacgcatccagggcgcccgggccaccctgctgtttgagcggcagcagtggaggcggcagagggacctgcggcgggccctggacagcagcaacctgagcctggccaaggagcagcacctgcagaagaagtacatgaatgaggtgtacaccaaccagcccactggagactacttcacccagttcaacacaggcagcaggtag

SEQ ID NO: 41881 - DNA, 1134 bp, Artificial Sequence
  Description of Artificial Sequence: Synthetic coding sequence
atggctgtggccctgccccgggacctgcggcaggatgccaacctggccaagagaagacatgctgagctgtgccggcagaagagggtcttcaatgccaggaaccgcatcattggaggagacacagaggcctgggatgtgcaggtgcatgaccagaagatcaaggaggccacagagaaggcccggcatgagaccctggccgctgagatgaggcagaatgacaagatcatgtgcatcctggagaacaggaagaagagggacaggaagaacctgtgccgggccatcaatgacttccagcagagcttccagaagccagagacccggcgggagtttgacctgagtgaccccctggccctgaagaaggacctgcctgcccggcagagcgacaatgatgtgaggaacaccatcagcggcatgcagaagttcatgggagaggacctgaacttccacgagaggaagaagttccaggaggagcagaaccgggagtggagcctgcagcagcagcgggagtggaagaatgcccgggcagagcagaagtgtgccgaggccctgtacacagagacccggctgcagtttgatgaaacagccaagcacctgcagaagctggagagcaccaccaggaaggctgtgtgtgcctctgtgaaggacttcaacaagagccaggccatcgagagcgtggagaggaagaagcaggagaagaagcaggagcaggaggacaacctggccgagatcaccaacctgctgcggggggacctgctgtctgagaacccccagcaggccgccagcagctttggcccccaccgggtggtgcctgaccgctggaagggcatgacccaggagcagctggagcagatccggctggtgcagaagcagcagatccaggagaagctgcggctgcaggaggagaagaggcagagggacctggactgggacagaagacgcatccagggcgcccgggccaccctgctgtttgagcggcagcagtggaggcggcagagggacctgcggcgggccctggacagcagcaacctgagcctggccaaggagcagcacctgcagaagaagtacatgaatgaggtgtacaccaaccagcccactggagactacttcacccagttcaacacaggcagcaggtag

SEQ ID NO: 41882 - DNA, 432 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcacagatgaggagatgcagtatgacatggccaagagcggccaggagaagcagaccatcgagatcctgatgaaccccatcctgctggtgaagaacaccagcctgtccatgagcaaggatgacatgagcagcaccctgctgaccttccgcagcctgcactacaatgaccccaagggcaacagcagtggaaatgacaaggagtgctgcaatgacatgacagtgtggaggaaggtgtctgaggccaacggcagctgcaagtggagcaacaacttcatccgcagcagcacagaggtgatgagaagagtgcaccgggcccccagctgcaagtttgtgcagaacccctag

SEQ ID NO: 41883 - DNA, 555 bp, Artificial Sequence
  Description of Artificial Sequence: Synthetic coding sequence
atggtgcgctacagcctggaccctgagaaccccaccaagagctgcaagagccggggcagcaacctgcgggtgcacttcaagaacacccgggagacagcccaggccatcaagggcatgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagatcagccagaagaagctgaagaagcagaagctgatggcccgggagtag

SEQ ID NO: 41884 - DNA, 441 bp, Artificial Sequence
  Description of Artificial Sequence: Synthetic coding sequence
atgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagatcagccagaagaagctgaagaagcagaagctgatggcccgggagtag

SEQ ID NO: 41885 - DNA, 525 bp, Artificial Sequence
  Description of Artificial Sequence: Synthetic coding sequence
atggtgcgctacagcctggaccctgagaaccccaccaagagctgcaagagccggggcagcaacctgcgggtgcacttcaagaacacccgggagacagcccaggccatcaagggcatgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagatcagccagaagaagtag

SEQ ID NO: 41886 - DNA, 585 bp, Artificial Sequence
  Description of Artificial Sequence: Synthetic coding sequence
atgcctgtggcccgctcctgggtgtgcaggaagacctacgtgaccccaagaagaccatttgagaagagccggctggaccaggagctgaagctgattggagaatatggcctgaggaacaagcgggaggtgtggagggtgaagttcaccctggccaagatcaggaaggccgcccgggagctgctgaccctggatgagaaggacccccggcggctgtttgagggcaatgccctgctgcggcggctggtgcgcatcggcgtgctggatgagggcaagatgaagctggactacatcctgggcctgaagattgaggacttcctggagcggcggctgcagacccaggtgttcaagctgggcctggccaagagcatccaccacgcccgggtgctgatccggcagaggcacatccgggtgaggaagcaggtggtgaacatccccagcttcatcgtgcggctggacagccagaagcacatcgacttcagcctgcggagcccctatggaggcggccggcccggccgggtgaagaggaagaatgccaagaagggccagggcggggccggggctggagatgatgaggaggaggactag

SEQ ID NO: 41887 - DNA, 888 bp, Artificial Sequence
  Description of Artificial Sequence: Synthetic coding sequence
atgtctggggccctggatgtgctgcagatgaaggaggaggatgtgctgaagttcctggccgccggcacccacctgggcggcaccaacctggacttccagatggagcactacatctacaagaggaagagtgatggcatctacatcatcaacctgaagaggacctgggagaagctgctgctggccgcccgggccatcgtggccattgaaaatccagcagatgtgtctgtcatcagcagcaggaacacaggccagagagctgtgctgaagtttgctgctgccaccggggccacccccatcgccggccgcttcaccccaggcaccttcaccaaccagatccaggccgccttctgggagccccggctgctggtggtgacagaccccagggctgaccaccagcccctgacagaggccagctatgtgaacctgcccaccatcgccctgtgcaacacagacagccccctgcgctacgtggacatcgccatcccctgcaacaacaagggggcccacagcgtgggcctgatgtggtggatgctggcccgggaggtgctgaggatgaggggcaccatcagccgggagcacccctgggaggtgatgccagacctgtacttctacagagatcctgaggagattgagaaggaggagcaggccgctgctgagaaggctgtgaccaaggaggagttccagggcgagtggacagcccccagccctgagttcaccgccacccagcctgaggtggccgactggagcgagggcgtgcaggtgcccagcgtgcccatccagcagttccccacagaggactggagcgcccagcctgccacagaggactggagcgctgcccccacagcccaggccacagagtgggtgggcgccaccacagactggagctag

SEQ ID NO: 41888 - DNA, 843 bp, Artificial Sequence
  Description of Artificial Sequence: Synthetic coding sequence
atggtggccaggagaagaaaatgtgccgcccgggaccctgaggaccgcatccccagccccctgggctacgccgccatccccatcaagttcagcgagaagcagcaggccagccactacctgtatgtgcgggcccatggagtgcggcagggcaccaagagcacctggccccagaagaggaccctgtttgtgctgaatgtgcccccctactgcacagaggagagcctgagccggctgctgagcacctgtggcctggtgcagagcgtggagctgcaggagaagccagacctggccgagagccccaaggagagccgcagcaagttcttccaccccaagcctgtgcccggcttccaggtggcctacgtggtgttccagaagcccagcggcgtgtctgctgccctggccctgaagggccccctgctggtgtccacagagagccaccctgtgaagagcggcatccacaagtggatcagtgactatgctgacagcgtgcctgaccctgaggccctgcgggtggaggtggacaccttcatggaggcctatgaccagaagattgctgaggaggaggccaaggccaaggaggaggagggcgtgcctgatgaggagggctgggtgaaggtgacccggcggggcagaagacctgtgctgcccaggacagaggccgccagcctgcgggtgctggagcgggagaggaggaagaggagcaggaaggagctgctgaacttctacgcctggcagcaccgggagagcaagatggagcacctggcccagctgaggaagaagtttgaggaggacaagcagagaattgagctgctgcgggcccagaggaagttccggccctactag

SEQ ID NO: 41889 - DNA, 735 bp, Artificial Sequence
  Description of Artificial Sequence: Synthetic coding sequence
atggccgcccccagtgatggcttcaagccccgggagaggtctggaggagagcaggcccaggactgggatgccctgccccccaagaggccccggctgggcgccggcaacaagattggaggaagaagactcatcgtggtgctggagggcgccagcctggagaccgtgaaggtgggcaagacctatgagctgctgaactgtgacaagcacaagagcatcctgctgaagaatggccgggaccccggggaggcccggccagacatcacccaccagagcctgctgatgctgatggacagccccctgaacagagctggcctgctgcaggtgtacatccacacccagaagaatgtgctgattgaggtgaacccccagacccgcatccccaggacctttgaccgcttctgtggcctgatggtgcagctgctgcacaagctgtctgtgcgggctgctgatggcccccagaagctgctgaaggtgatcaagaaccctgtgtctgaccacttccctgtgggctgcatgaaggtgggcaccagcttcagcatccctgtggtgtctgatgtgcgggagctggtgcccagcagtgaccccatcgtgtttgtggtgggcgcctttgcccacggcaaggtgtctgtggagtacacagagaagatggtgtccatcagcaactaccccctgtctgctgccctgacctgtgccaagctgaccacagcctttgaggaggtgtggggcgtcatctag

SEQ ID NO: 41890 - DNA, 474 bp, Artificial Sequence
  Description of Artificial Sequence: Synthetic coding sequence
atgaacctggatggcagcgcccaggaccctgagaagcgggagtacagctctgtgtgtgtgggcagagaagatgacatcaagaagtctgagaggatgacagctgtggtgcatgaccgggaggtggtgatcttctaccacaagggggagtaccacgccatggacatccgctgctaccacagcggcggccccctgcacctgggggacatcgaggactttgatggccggccctgcatcgtgtgcccctggcacaagtacaagatcaccctggccactggagagggcctgtaccagagcatcaaccccaaggaccccagcgccaagcccaagtggtgcagcaagggcatcaagcagaggatccacacagtgacagtggacaatggaaacatctacgtgaccctgagcaatgagcccttcaagtgtgacagcgacttctacgccactggagacttcaaggtgatcaagagcagcagctag

SEQ ID NO: 41891 - DNA, 633 bp, Artificial Sequence
  Description of Artificial Sequence: Synthetic coding sequence
atgctgaagtgcttcaggaactgcctgcggcccagcagcctgagcaccctgcccctgcagtatggcatcctcttccccaagctgctggcctgcctggtgcacctgcacttcggccacttcagcagcgctgtgatctctgtgaccagcttctacctgtccatgaacctggatggcagcgcccaggaccctgagaagcgggagtacagctctgtgtgtgtgggccgggaggatgacatcaagaagtctgagaggatgacagctgtggtgcatgaccgggaggtggtgatcttctaccacaagggggagtaccacgccatggacatccgctgctaccacagcggcggccccctgcacctgggggacattgaagattttgatggccggccctgcatcgtgtgcccctggcacaagtacaagatcaccctggccaccggggagggcctgtaccagagcatcaaccccaaggaccccagcgccaagcccaagtggtgcagcaagggcatcaagcagaggatccacacagtgacagtggacaatggaaacatctacgtgaccctgagcaatgagcccttcaagtgtgacagcgacttctacgccaccggggacttcaaggtgatcaagagcagcagctag

SEQ ID NO: 41892 - DNA, 633 bp, Artificial Sequence; identical to SEQ ID NO: 41891
  Description of Artificial Sequence: Synthetic coding sequence

SEQ ID NO: 41893 - DNA, 357 bp, Artificial Sequence
  Description of Artificial Sequence: Synthetic coding sequence
atgaacctggatggcagcgcccaggaccctgagaagcgggagtacagctctgtgtgtgtgggcagagaagatgacatcaagaagtctgagaggatgacagctgtggtgcatgaccgggaggtggtgatcttctaccacaagggggagtaccacgccatggacatccgctgctaccacagcggcggccccctgcacctgggggacatcgaggactttgatggccggccctgcatcgtgtgcccctggcacaagtacaagatcaccctggccactggagagggcctgtaccagagcatcaaccccaaggaccccagcgccaagcccaagtggtgcagcaagggcatcaagcagaggtag

SEQ ID NO: 41894 - DNA, 1032 bp, Artificial Sequence
  Description of Artificial Sequence: Synthetic coding sequence
atggccgagcagctgagccctgggaaggctgtggaccaggtgtgcaccttcctgttcaagaagccaggcaggaaaggagctgctggccgcaggaagaggcctgcctgtgaccctgagcccggggagagcggcagcagcagtgatgagggctgcaccgtggtgcggcctgagaagaagagggtgacccacaaccccatgatccagaagacccgggacagcggcaagcagaaggccgcctacggggacctgagcagcgaggaggaggaggagaatgaacctgagagcctgggcgtggtgtacaagagcaccaggtctgccaagcctgtgggccctgaggacatgggcgccacagctgtgtatgagctggacacagagaaggagagagatgcccaggccatctttgagaggagccagaagatccaggaggagctgcggggcaaggaggatgacaagatctaccggggcatcaacaactaccagaagtacatgaagcccaaggacacctccatgggaaatgccagcagcggcatggtgaggaagggccccatccgggcccctgagcacctgcgggccaccgtgcgctgggactaccagcctgacatctgcaaggactacaaggagaccggcttctgtggctttggagacagctgcaagttcctgcatgacagaagtgactacaagcacggctggcagatcgagcgggagctggatgagggccgctatggagtgtatgaagatgaaaattatgaggtgggcagtgatgatgaggagatccccttcaagtgcttcatctgccggcagagcttccagaaccctgtggtgaccaagtgccgccactacttctgtgagagctgtgccctgcagcacttccgcaccaccccccgctgctacgtgtgtgaccagcagaccaacggggtcttcaacccagccaaggagctgattgccaagctggagaagcaccgggccactggagagggcggggccagtgacctgcctgaagatcctgatgaagatgccatccccatcacctag

SEQ ID NO: 41895 - DNA, 969 bp, Artificial Sequence
  Description of Artificial Sequence: Synthetic coding sequence
atggccgccccacccagccctggccgcacagctgaccaggccgaccaggtgtgcaccttcctgttcaagaagccaggcaggaaaggagctgctggcctgaggaagaggcctgcctgtgaccctgagcacggggagagcagcagcagtggagatgaaggagacacagtggcccagcccccccgggtggccccccggccccggggcctgcacagctggcagaaggccgcccatggagaccggcggggggaggaggccgcccctgagagcctggatgtggtgtaccgcagcaccaggtctgccaagcctgtgggccctgaggacatgggcgccacagctgactttgagcaggacacagagaaggagcaccacacccccaccatcctgaagtgcagccagagggtgcaggaggccctgcggggccgggagcatgaccacatctaccggggcatccacagctacctgcgctacctgaagcccaaggacacctccatgggcaacagcagcagcggcatggccaggaagggccccatccgggcccctggccacctgcgggccaccgtgcgctgggactaccagcctgacatctgcaaggactacaaggagaccggcttctgtggctttggagacagctgcaagttcctgcatgacagaagtgactacaagctgggctgggagattgaaagagagctggaggagggccgctactgcatctgtgaagatgaaaatcatgaggtgggcagcgaggaggaggagatccccttccgctgcttcatctgccggcaggccttccagaaccctgtggtgaccaagtgccgccactacttctgtgagagctgtgccctggagcacttccgggccaccccccgctgctacatctgtgaccagcccactggaggcatcttcaacccagccaaggagctgatggccaagctgcagaagctgcaggccgctgagggcaagaagaggtag

SEQ ID NO: 41896 - DNA, 516 bp, Artificial Sequence
  Description of Artificial Sequence: Synthetic coding sequence
atgagcagcaagaggaccaagaccaagaccaagaagaggccccagagggccaccagcaatgtgtttgccatgtttgaccagagccagatccaggagttcaaggaggccttcaacatgattgaccagaacagagatggcttcatcgacaaggaggacctgcatgacatgctggccagcctgggcaagaaccccacagatgagtacctggatgccatgatgaatgaggcccctggccccatcaacttcaccatgttcctgaccatgtttggagagaagctgaatggaacagatcctgaagatgtgatcagaaatgcctttgcctgctttgatgaggaggccaccggcaccatccaggaggactacctgcgggagctgctgaccaccatgggagaccgcttcacagatgaggaggtggatgagctgtaccgggaggcccccatcgacaagaagggcaacttcaactacatcgagttcacccgcatcctgaagcacggggccaaggacaaggatgactag

SEQ ID NO: 41897 - DNA, 936 bp, Artificial Sequence
  Description of Artificial Sequence: Synthetic coding sequence
atggccgaggccagcccccaccctggccgctacttctgccactgctgcagcgtggagatcgtgccccggctgcctgactacatctgcccccgctgtgagagcggcttcatcgaggagctgcctgaggagaccaggagcacagaaaatggaagtgcccccagcacagcccccacagaccagagcaggcctcccctggagcacgtggaccagcacctgttcaccctgccccagggctacggccagtttgccttcggcatctttgatgacagctttgagatccccaccttccccccaggggcccaggctgatgatggccgggaccctgagagcagaagagagcgggaccaccccagccgccaccgctacggggcccggcagccccgggcccggctgaccacccggcgggccaccggcagacatgagggcgtgcccaccctggagggcatcatccagcagctggtgaatggcatcatcaccccagccaccatccccagcctgggcccctggggcgtgctgcacagcaaccccatggactatgcctggggcgccaacggcctggatgccatcatcacccagctgctgaaccagtttgagaacacaggccccccacctgctgacaaggagaagatccaggccctgcccaccgtgcctgtgacagaggagcacgtgggcagcggcctggagtgccctgtgtgcaaggatgattatgccctgggggagcgggtgcggcagctgccctgcaaccacctgttccatgatggctgcatcgtgccctggctggagcagcacgacagctgccctgtgtgcaggaagagcctgaccggccagaacacagccaccaaccccccaggcctgactggagtgtccttcagcagcagcagcagcagcagcagcagcagcagccccagcaatgaaaatgccaccagcaacagctag

SEQ ID NO: 41898 - DNA, 984 bp, Artificial Sequence
  Description of Artificial Sequence: Synthetic coding sequence
atggccgaggccagcccccaccctggccgctacttctgccactgctgcagcgtggagatcgtgccccggctgcctgactacatctgcccccgctgtgagagcggcttcatcgaggagctgcctgaggagaccaggagcacagaaaatggaagtgcccccagcacagcccccacagaccagagcaggcctcccctggagcacgtggaccagcacctgttcaccctgccccagggctacggccagtttgccttcggcatctttgatgacagctttgagatccccaccttccccccaggggcccaggctgatgatggccgggaccctgagagcagaagagagcgggaccaccccagccgccaccgctacggggcccggcagccccgggcccggctgaccacccggcgggccaccggcagacatgagggcgtgcccaccctggagggcatcatccagcagctggtgaatggcatcatcaccccagccaccatccccagcctgggcccctggggcgtgctgcacagcaaccccatggactatgcctggggcgccaacggcctggatgccatcatcacccagctgctgaaccagtttgagaacacaggccccccacctgctgacaaggagaagatccaggccctgcccaccgtgcctgtgacagaggagcacgtgggcagcggcctggagtgccctgtgtgcaaggatgattatgccctgggggagcgggtgcggcagctgccctgcaaccacctgttccatgatggctgcatcgtgccctggctggagcagcacgacagctgccctgtgtgcaggaagagcctgaccggccagaacacagccaccaaccccccaggcctgactggagtgtccttcagcagcagcagcagcagcagcagcagcagcagccccagcaatgaaaatgccaccacctggagccccctgggccggccccagcccccccggcccctgagcaacctgaccctgtag

SEQ ID NO: 41899 - DNA, 456 bp, Artificial Sequence
  Description of Artificial Sequence: Synthetic coding sequence
atggccgaggacctgtctgctgccaccagctacacagaagatgacttctactgccctgtgtgccaggaggtgctgaagacccctgtgaggaccacagcctgccagcacgtgaacagaagtgagaccagcaccagtgacaacacagagacctaccaggagaacaccagcagcagcggccaccccaccttcaagtgccccctgtgccaggagagcaacttcacccggcagaggctgctggaccactgcaacagcaaccacctgttccagatcgtgcctgtgacctgccccatctgtgtgtccctgccctggggagaccccagccagatcaccaggaactttgtgagccacctgaaccagaggcaccagtttgattatggagaatttgtgaacctgcagctggatgaggagacccagtaccagacagctgtggaggagagcttccaggtgaacatctag

SEQ ID NO: 41900 - DNA, 738 bp, Artificial Sequence
  Description of Artificial Sequence: Synthetic coding sequence
atggccgaggacctgtctgctgccaccagctacacagaagatgacttctactgccctgtgtgccaggaggtgctgaagacccctgtgaggaccacagcctgccagcacgtgttctgcaggaagtgcttcctgacagccatgagggagagcggggcccactgccccctgtgcagaggaaatgtgacccggcgggagcgggcctgcccagagcgggccctggacctggagaacatcatgaggaagttcagcggcagctgccgctgctgtgccaagcagatcaagttctacaggatgaggcaccactacaagagctgcaagaagtaccaggatgaatatggagtgagcagcatcatccccaacttccagatcagccaggacagcgtgggcaacagcaacagaagtgagaccagcaccagtgacaacacagagacctaccaggagaacaccagcagcagcggccaccccaccttcaagtgccccctgtgccaggagagcaacttcacccggcagaggctgctggaccactgcaacagcaaccacctgttccagatcgtgcctgtgacctgccccatctgtgtgtccctgccctggggagaccccagccagatcaccaggaactttgtgagccacctgaaccagaggcaccagtttgattatggagaatttgtgaacctgcagctggatgaggagacccagtaccagacagctgtggaggagagcttccaggtgaacatctag

SEQ ID NO: 41901 - DNA, 693 bp, Artificial Sequence
  Description of Artificial Sequence: Synthetic coding sequence
atgggccagcagatcagtgaccagacccagctggtgatcaacaagctgcctgagaaggtggccaagcacgtgaccctggtgcgggagagcggcagcctgacctatgaggagttcctgggccgggtggccgagctgaatgatgtgacagccaaggtggccagcggccaggagaagcacctgctgtttgaggtgcagcccggcagtgacagcagcgccttctggaaggtggtggtgcgggtggtgtgcaccaagatcaacaagagcagcggcatcgtggaggccagccgcatcatgaacctgtaccagttcatccagctgtacaaggacatcaccagccaggccgccggcgtgctggcccagagcagcaccagcgaggagccagatgagaacagcagctctgtgaccagctgccaggccagcctgtggatgggccgggtgaagcagctgacagatgaggaggagtgctgcatctgcatggatggccgggctgacctgatcctgccctgtgcccacagcttctgccagaagtgcatcgacaagtggagcgacagacacaggaactgccccatctgccgcctgcagatgaccggggccaatgaatcctgggtggtgtctgatgcccccacagaagatgacatggccaactacatcctgaacatggctgatgaggccggccagccccaccggccctag

SEQ ID NO: 41902 - DNA, 543 bp, Artificial Sequence
  Description of Artificial Sequence: Synthetic coding sequence
atgggccagcagatcagtgaccagacccagctggtgatcaacaagctgcctgagaaggtggccaagcacgtgaccctggtgcgggagagcggcagcctgacctatgaggagttcctgggccgggtggccgagctgaatgatgtgacagccaaggtggccagcggccaggagaagcacctgctgtttgaggtgcagcccggcagtgacagcagcgccttctggaaggtggtggtgcgggtggtgtgcaccaagatcaacaagagcagcggcatcgtggaggccagccgcatcatgaacctgtaccagttcatccagctgtacaaggacatcaccagccaggccgccggcgtgctggcccagagcagcaccagcgaggagccagatgagaacagcagctctgtgaccagctgccaggccagcctgtggatgggccgggtgaagcagctgacagatgaggaggagtgctgcatctgcatggatggccgggctgacctgatcctgccctgtgcccacagcttctgccagaagtgcatcgacaagtag

SEQ ID NO: 41903 - DNA, 2040 bp, Artificial Sequence
  Description of Artificial Sequence: Synthetic coding sequence
atgggcgccctgaccagccggcagcacgccggcgtggaggaggtggacatccccagcaacagcgtgtaccgctacccacccaagagcggcagctactttgccagccacttcatcatgggcggggagaagtttgacagcacccaccctgagggctacctgtttggagagaacagcgacctgaacttcctgggcaacagacctgtggtgttcccctatgctgcccccccaccccaggagcctgtgaagaccctgcggagcctggtgaacatcaggaaggacaccctgcggctggtgaagtgtgccgaggaggtgaagagccctggagaggaggccagcaaggccaaggtgcactacaacgtggagttcacctttgacacagatgcccgggtggccatcaccatctactaccaggccacagaggagttccagaatggcatcgccagctacatccccaaggacaacagcctgcagagcgagaccgtgcagtacaagaggggcgtgtgccagcagttctgcctgcccagccacacagtggaccccagcgagtgggccgaggaggagctgggctttgacctggaccgggaggtgtaccccctggtggtgcatgctgtggtggatgaaggagatgagtacttcggccactgccacgtgctgctgggcacctttgagaagcacacagatggcaccttctgtgtgaagcccctgaagcagaagcaggtggtggatggagtgtcctacctgctgcaggagatctacggcatcgagaacaagtacaacacccaggacagcaaggtggctgaagatgaggtgtctgacaacagcgcagaatgtgtggtgtgcctgagtgatgtgcgggacaccctcatcctgccctgccgccacctgtgcctgtgcaacacctgtgccgacaccctgcgctaccaggccaacaactgccccatctgccgcctgcccttccgggccctgctgcagatccgggccatgaggaagaagctgggccccctgagccccaccagcttcaaccccatcatcagcagccagaccagtgacagcgaggagcaccccagcagcgagaacatccccccaggctatgaggtggtgtccctgctggaggccctgaatggccccctgacccccagccctgctgtgccccccctgcacgtgctgggagatggccacctgagcggcatgctgcccagctatggcagtgatggccacctgccccctgtgaggaccatcagccccctggaccggctgagtgacagcagcagccagggcctgaagctgaagaagagcctgagcaagagcaccagccagaacagctctgtgctgcacgaggaggaggatgagcacagctgcagcgagagcgagacccagctgagccagaggccttctgtgcagcacctgggggaggagtgtggggtgaccccagagagcgagaacctgaccctgagcagcagcggggccatcgaccagagcagctgcaccggcacccccctgagcagcaccatcagcagccctgagggccctgccagcagcagcctggcccagagcgtgatgtccatggccagcagccagatcagcacagacacagtgtcctccatgagcggcagctacatcgcccctggaacagaggaggagggggaggccctgagcagcccccagcctgccagccgggcccccagcgaggagggggagggcctgcctgctgagagcccagacagcaactttgctggcctgcctgctggggagcaggatgctgagggcaatgatgtgattgaggaggaggatggcagccccacccaggagggccagaggacctgtgccttcctgggcatggagtgtgacaacaacaatgactttgatattgcctctgtgaaggccctggacaacaagctgtgcagcgaggtgtgcctgcccggggcctggcaggctgatgacaatgctgtgtccagaaatgcccagaggcggcggctgagcagcagcagcctggaggacagcgagacccggccctgtgtgtggggccccctggccgtgtag

SEQ ID NO: 41904 - DNA, 1143 bp, Artificial Sequence
  Description of Artificial Sequence: Synthetic coding sequence
atgggcggggagaagtttgacagcacccaccctgagggctacctgtttggagagaacagcgacctgaacttcctgggcaacagacctgtggtgttcccctatgctgcccccccaccccaggagcctgtgaagaccctgcggagcctggtgaacatcaggaaggacaccctgcggctggtgaagtgtgccgaggaggtgaagagccctggagaggaggccagcaaggccaaggtgcactacaacgtggagttcacctttgacacagatgcccgggtggccatcaccatctactaccaggccacagaggagttccagaatggcatcgccagctacatccccaaggacaacagcctgcagagcgagaccgtgcagtacaagaggggcgtgtgccagcagttctgcctgcccagccacacagtggaccccagcgagtgggccgaggaggagctgggctttgacctggaccgggaggtgtaccccctggtggtgcatgctgtggtggatgaaggagatgagtacttcggccactgccacgtgctgctgggcacctttgagaagcacacagatggcaccttctgtgtgaagcccctgaagcagaagcaggtggtggatggagtgtcctacctgctgcaggagatctacggcatcgagaacaagtacaacacccaggacagcaaggtggctgaagatgaggtgtctgacaacagcgcagaatgtgtggtgtgcctgagtgatgtgcgggacaccctcatcctgccctgccgccacctgtgcctgtgcaacacctgtgccgacaccctgcgctaccaggccaacaactgccccatctgccgcctgcccttccgggccctgctgcagatccgggccatgaggaagaagctgggccccctgagccccaccagcttcaaccccatcatcagcagccagaccagtgacagcgaggagcaccccagcagcgagaacatccccccaggctatgaggtggtgtccctgctggaggccctgaatggccccctgaccccacccagcctgctgaagatccagaagatctcctgggcctggctgcaggcccctgtggtgcctgccacctgggaggccgaggccggggagtggccagagcccggccgccgcagcctgcagtag

SEQ ID NO: 41905 - DNA, 1974 bp, Artificial Sequence
  Description of Artificial Sequence: Synthetic coding sequence
atgggcgccctgaccagccggcagcacgccggcgtggaggaggtggacatccccagcaacagcgtgtaccgctacccacccaagagcggcagctactttgccagccacttcatcatgggcggggagaagtttgacagcacccaccctgagggctacctgtttggagagaacagcgacctgaacttcctgggcaacagacctgtggtgttcccctatgctgcccccccaccccaggagcctgtgaagaccctgcggagcctggtgaacatcaggaaggacaccctgcggctggtgaagtgtgccgaggaggtgaagagccctggagaggaggccagcaaggccaaggtgcactacaacgtggagttcacctttgacacagatgcccgggtggccatcaccatctactaccaggccacagaggagttccagaatggcatcgccagctacatccccaaggacaacagcctgcagagcgagaccgtgcagtacaagaggggcgtgtgccagcagttctgcctgcccagccacacagtggaccccagcgagtgggccgaggaggagctgggctttgacctggaccgggaggtgtaccccctggtggtgcatgctgtggtggatgaaggagatgagtacttcggccactgccacgtgctgctgggcacctttgagaagcacacagatggcaccttctgtgtgaagcccctgaagcagaagcaggtggtggatggagtgtcctacctgctgcaggagatctacggcatcgagaacaagtacaacacccaggacagcaaggtggctgaagatgaggtgtctgacaacagcgcagaatgtgtggtgtgcctgagtgatgtgcgggacaccctcatcctgccctgccgccacctgtgcctgtgcaacacctgtgccgacaccctgcgctaccaggccaacaactgccccatctgccgcctgcccttccgggccctgctgcagatccgggccatgaggaagaagctgggccccctgagccccaccagcttcaaccccatcatcagcagccagaccagtgacagcgaggagcaccccagcagcgagaacatccccccaggctatgaggtggtgtccctgctggaggccctgaatggccccctgacccccagccctgctgtgccccccctgcacgtgctgggagatggccacctgagcggcatgctgcccagctatggcagtgatggccacctgccccctgtgaggaccatcagccccctggaccggctgagtgacagcagcagccagggcctgaagctgaagaagagcctgagcaagagcaccagccagaacagctctgtgctgcacgaggaggaggatgagcacagctgcagcgagagcgagacccagctgagccagaggccttctgtgcagcacctgggggaggagtgtggggtgaccccagagagcgagaacctgaccctgagcagcagcggggccatcgaccagagcagctgcaccggcacccccctgagcagcaccatcagcagccctgagggccctgccagcagcagcctggcccagagcgtgatgtccatggccagcagccagatcagcacagacacagtgtcctccatgagcggcagctacatcgcccctggaacagaggaggagggggaggccctgagcagcccccagcctgccagccgggcccccagcgaggagggggagggcaatgatgtgattgaggaggaggatggcagccccacccaggagggccagaggacctgtgccttcctgggcatggagtgtgacaacaacaatgactttgatattgcctctgtgaaggccctggacaacaagctgtgcagcgaggtgtgcctgcccggggcctggcaggctgatgacaatgctgtgtccagaaatgcccagaggcggcggctgagcagcagcagcctggaggacagcgagacccggccctgtgtgtggggccccctggccgtgtag

SEQ ID NO: 41906 - DNA, 1041 bp, Artificial Sequence
  Description of Artificial Sequence: Synthetic coding sequence
atggtgctggtgcacgtgggctacctggtgctgcctgtgtttggatctgtgaggaacagaggagcccccttccagaggagccagcacccccacgccaccagctgccgccacttccacctgggccccccccagccccagcagctggccccagacttccccctggcccaccctgtgcagagccagcccggcctgagcgcccacatggccccagcccaccagcacagcggggccctgcaccagagcctgacccccctgcccaccctgcagttccaggatgtgacaggccccagcttcctgccccaggccctgcaccagcagtacctgctgcagcagcagctgctggaggcccagcaccggcggctggtgagccacccccggcgcagccaggagcgggtgtctgtgcacccccaccggctgcaccccagctttgattttggccagctgcagaccccccagccccgctacctggccgagggcacagactgggacctgtctgtggatgctggcctgagccctgcccagttccaggtgcggcccatcccccagcactaccagcactacctggccacccccaggatgcaccacttccccaggaacagcagcagcacccagatggtggtgcatgagatccggaactacccctacccccagctgcacttcctggccctgcagggcctgaaccccagccgccacaccagcgctgtgcgggagagctatgaggagctgctgcagctggaggaccggctgggcaatgtgaccagaggagctgtgcagaacaccatcgagcgcttcaccttcccccacaagtacaagaagagaagaccccaggacggcaagggcaagaaggatgaaggagaggagagtgacacagatgagaagtgcaccatctgcctgtccatgctggaggatggagaagatgtgcggcggctgccctgcatgcacctgttccaccagctgtgtgtggaccagtggctggccatgagcaagaagtgccccatctgccgggtggacatcgagacccagctgggcgctgacagctag

SEQ ID NO: 41907 - DNA, 465 bp, Artificial Sequence
  Description of Artificial Sequence: Synthetic coding sequence
atgcaccacttccccaggaacagcagcagcacccagatggtggtgcatgagatccggaactacccctacccccagctgcacttcctggccctgcagggcctgaaccccagccgccacaccagcgctgtgcgggagagctatgaggagctgctgcagctggaggaccggctgggcaatgtgaccagaggagctgtgcagaacaccatcgagcgcttcaccttcccccacaagtacaagaagagaagaccccaggacggcaagggcaagaaggatgaaggagaggagagtgacacagatgagaagtgcaccatctgcctgtccatgctggaggatggagaagatgtgcggcggctgccctgcatgcacctgttccaccagctgtgtgtggaccagtggctggccatgagcaagaagtgccccatctgccgggtggacatcgagacccagctgggcgctgacagctag

SEQ ID NO: 41908 - DNA, 87 bp, Artificial Sequence
  Description of Artificial Sequence: Synthetic coding sequence
atggtgctggtgcacgtgggctacctggtgctgcctgtgtttggatctgtgaggaacagaggcatctctgtgtggatgctggcctag

SEQ ID NO: 41909 - DNA, 714 bp, Artificial Sequence
  Description of Artificial Sequence: Synthetic coding sequence
atggccatgttccgcagcctggtggccagcgcccagcagaggcagcccccagctggccctgctggaggagacagcggcctggaggcccagtacacctgccccatctgcctggaggtgtaccacaggcctgtggccatcggcagctgtggccacaccttctgtggggagtgcctgcagccctgcctgcaggtgcccagccccctgtgccccctgtgccgcctgccctttgaccccaagaaggtggacaaggccacccacgtggagaagcagctgagcagctacaaggccccctgccggggctgcaacaagaaggtgaccctggccaagatgagggtgcacatcagcagctgcctgaaggtgcaggagcagatggccaactgccccaagtttgtgcctgtggtgcccaccagccagcccatccccagcaacatccccaacagaagcacctttgcctgcccctactgtggggccaggaacctggaccagcaggagctggtgaagcactgtgtggagagccacagaagtgaccccaacagagtggtgtgccccatctgcagcgccatgccctggggagaccccagctacaagagcgccaacttcctgcagcacctgctgcaccgccacaagttctcctatgacacctttgtggactacagcattgatgaggaggccgccttccaggccgccctggccctgagcctgtctgagaactag

SEQ ID NO: 41910 - DNA, 471 bp, Artificial Sequence
  Description of Artificial Sequence: Synthetic coding sequence
atggccatgttccgcagcctggtggccagcgcccagcagaggcagcccccagctggccctgctggaggagacagcggcctggaggcccagtacacctgccccatctgcctggaggtgcaggagcagatggccaactgccccaagtttgtgcctgtggtgcccaccagccagcccatccccagcaacatccccaacagaagcacctttgcctgcccctactgtggggccaggaacctggaccagcaggagctggtgaagcactgtgtggagagccacagaagtgaccccaacagagtggtgtgccccatctgcagcgccatgccctggggagaccccagctacaagagcgccaacttcctgcagcacctgctgcaccgccacaagttctcctatgacacctttgtggactacagcattgatgaggaggccgccttccaggccgccctggccctgagcctgtctgaaaattag

SEQ ID NO: 41911 - DNA, 387 bp, Artificial Sequence
  Description of Artificial Sequence: Synthetic coding sequence
atgagggtgcacatcagcagctgcctgaaggtgcaggagcagatggccaactgccccaagtttgtgcctgtggtgcccaccagccagcccatccccagcaacatccccaacagaagcacctttgcctgcccctactgtggggccaggaacctggaccagcaggagctggtgaagcactgtgtggagagccacagaagtgaccccaacagagtggtgtgccccatctgcagcgccatgccctggggagaccccagctacaagagcgccaacttcctgcagcacctgctgcaccgccacaagttctcctatgacacctttgtggactacagcattgatgaggaggccgccttccaggccgccctggccctgagcctgtctgaaaattag

SEQ ID NO: 41912 - DNA, 471 bp, Artificial Sequence; identical to SEQ ID NO: 41910
  Description of Artificial Sequence: Synthetic coding sequence

SEQ ID NO: 41913 - DNA, 2127 bp, Artificial Sequence
  Description of Artificial Sequence: Synthetic coding sequence
atggctgctgctggccccagcacccgggccagcagcgctgctgctgctgctgccctgagcagaagaggccggcggggccgctgtgatgaaacagctgctgccaagacaggagcccctggccctgccagcggccccagcctgctggtgctgagcccccccctgctgcagccccccctgccccccaggcctgaggagagcggctgtgccggctgcctggagcccccaggagaggccgccgccctgccctgtggccacagcctgtgccggggctgtgcccagagagctgctgatgctgctggccctggctgcccccgctgccgggcccggggccctggctgggcccggcggcgggccagagatgatggccaggccgacagcgaggtgctgggagaatgtgcccggcgcagccagcctgagcgctgccggcccaggagagatggaggagctgctgctgctggccccaggcctgagcaggagccccgggccgccccagctgagccagacttcatcttccgggcccccatcaagctgagcaagccaggagagctgcgggaggagtatgagagcctgaggaagctgcgggaggagaagctgcaggaggagaagcccagcgaggaccagatccacaagctgctgcctgaggacacagagaccgggaagaggaagatggatgagcagaagaagagagatgagcccctggtgctgaagaccaacctggagcgctgcccagcccggctgagtgacagtgaaaatgaggagcccagccggggccagatgacccagacccacaggtctgcctttgtgtccaagaacaacagctacagcctggccttcctggccggcaagctgaacagcaaggtggagaggagccagagctgcagcgacacagcccaggagcgggccaagagccgggtgcgggctgtgcccggcaacaaggccaaggtgaccaccatgaccccagccagcaaccccatcatcggcgtgctgctgagcacccagaacaacagatgtgtgtctgccccagacctgaccatcgagaagaggctgcccttcagcagcctgagcagcctggccagcctgcacaagccagagaggtctgtgtccccagagagcaatgacagcatcagcgaggagctgaaccacttcaagcccatcgtgtgcagcccctgcaccccacccaagaggctgcctgatggccgggtgctgagccccctcatcatcaagagcacccccaggaacctgaacagaagcctgcagaagcagaccagctatgaggccagcccccgcatcctgaagaagtgggagcagatcttccaggagcggcagatcaagaagaccctgagcaaggccaccctgaccagcctggcccctgagatgggagaggagctgctgggcagcgagggcatccacagcagcaaggagaagcccctggtggccgtgaacacccggctgagcggcggccaggtgctgtctgagtacacaggccccaccagcgctgacctggaccacttccccagcgtgtcccagaccaaggccgagcaggacagcgacaacaagagcagcacagagatccccctggagacctgctgcagcagcgagctgaagggcggcggcagcggcaccagcctggagcgggagcagtttgagggcctgggcagcaccccagatgccaagctggacaagacctgcatcagccgggccatgaagatcaccaccgtgaacagcgtgctgccccagaacagcgtgctgggcggcgtgctgaagaccaagcagcagctgaagaccctgaaccactttgacctgaccaatggagtgctggtggagagcctgtctgaggagcccctgcccagcctgcggcggggcaggaagaggcactgcaagaccaagcacctggagcagaatggcagcctgaagaagctgcggcagaccagcggggaggtgggcctggcccccacagatcctgtgctgcgggagatggagcagaagctgcagcaggaggaggaggaccggcagctggccctgcagctgcagaggatgtttgacaatgaaagaagaacagtgtccagaagaaaaggatctgtggaccagtacctgctgcggagcagcaacatggccggggccaagtag

SEQ ID NO: 41914 - DNA, 240 bp, Artificial Sequence
  Description of Artificial Sequence: Synthetic coding sequence
tgactggagcagaatggcagcctgaagaagctgcggcagaccagcggggaggtgggcctggcccccacagatcctgtgctgcgggagatggagcagaagctgcagcaggaggaggaggaccggcagctggccctgcagctgcagaggatgtttgacaatgaaagaagaacagtgtccaggaggaagggctctgtggaccagtacctgctgcggagcagcaacatggccggggccaagtag

SEQ ID NO: 41915 - DNA, 579 bp, Artificial Sequence
  Description of Artificial Sequence: Synthetic coding sequence
atggccgagcagcagggccgggagctggaggccgagtgccctgtgtgctggaaccccttcaacaacaccttccacacccccaagatgctggactgctgccacagcttctgtgtggagtgcctggcccacctgagcctggtgaccccagcccggcggcggctgctgtgccccctgtgccggcagcccaccgtgctggccagcggccagcctgtgacagacctgcccacagacacagccatgctggccctgctgcggctggagccccaccacgtgatcctggagggccaccagctgtgcctgaaggaccagcccaagagccgctacttcctgcggcagccccaggtgtacaccctggacctgggcccccagcccggcggccagacaggccccccaccagacacagccagcgccaccgtgtccacccccatcctgatccccagccaccacagcctgcgggagtgcttcaggaacccccagttccgcatctttgcctacctgatggccgtcatcctgtctgtgaccctgctgctgatcttcagcatcttctggaccaagcagttcctgtggggcgtgggctag

SEQ ID NO: 41916 - DNA, 579 bp, Artificial Sequence; identical to SEQ ID NO: 41915
  Description of Artificial Sequence: Synthetic coding sequence

SEQ ID NO: 41917 - DNA, 579 bp, Artificial Sequence; identical to SEQ ID NO: 41915
  Description of Artificial Sequence: Synthetic coding sequence

SEQ ID NO: 41918 - DNA, 579 bp, Artificial Sequence; identical to SEQ ID NO: 41915
  Description of Artificial Sequence: Synthetic coding sequence

SEQ ID NO: 41919 - DNA, 1905 bp, Artificial Sequence
  Description of Artificial Sequence: Synthetic coding sequence
atgtctggggccatcttcggccccctggagggccccagcagcctggatgcccccagcatccaccccctggtgtgccccctgtgccacgtgcagtatgaaagaccctgcctgctggactgcttccatgacttctgtgccggctgcctgcggggccgggccacagatggccgcctgacctgccccctgtgccagcaccagacagtgctgaagggccccagcggcctgccccctgtggaccggctgctgcagttcctggtggacagcagtggagatggagtggaggccgtgcgctgtgccaactgtgacctggagtgcagcgagcaggatgtggagaccacctacttctgcaacacctgtggccagcccctgtgtgcccgctgcagagatgagacccaccgggccaggatgtttgcccggcatgacatcgtggccctgggccagaggagcagagatgtgccccagaagtgcaccctgcacgccgagccctacctgctcttcagcacagacaagaagctgctgctgtgcatccgctgcttccgggacatgcagaaggagagccgggcccactgtgtggacctggagagcgcctacgtgcagggctgtgagcggctggagcaggccgtgctggccgtgaaggccctgcagacagccacccgggaggccatcgccctgctgcaggccatggtggaggaggtgcgccacagcgctgctgaggaggaggatgccatccacgccctgtttggctccatgcaggaccggctggccgagaggaaggccctgctgctgcaggccgtgcagagccagtatgaggagaaggacaaggccttcaaggagcagctgagccacctggccaccctgctgcccaccctgcaggtgcacctggtgatctgcagcagcttcctgagcctggccaacaaggccgagttcctggacctgggctatgagctgatggagcggctgcagggcatcgtgacccggccccaccacctgcggcccatccagagcagcaagatcgccagtgaccacagagctgagtttgcccgctgcctggagcccctgctgctgctgggccccaggagagtggccgccgccgccagcggggccaacaccctggccggcggcctgggccccaaggccctgaccggcccccactgccccagccctgtgggcaagatgagcggcagccctgtgcagaagcccaccctgcacaggagcatcagcaccaaggtgctgctggccgagggggagaacaccccatttgctgagcactgccgccactatgaggacagctaccgccacctgcaggccgagatgcagagcctgaaggaccaggtgcaggagctgcaccgggacctgaccaagcaccacagcctcatcaaggccgagatcatgggagatgtgctgcacaagagcctgcagctggatgtgcagatcgccagcgagcacgccagcctggagggcatgagggtggtgttccaggagatctgggaggaggcctaccagagggtggccaatgagcaggagatctatgaggcccagctgcatgacctgctgcagctgcggcaggagaatgcctacctgaccaccatcaccaagcagatcaccccctacgtgcgcagcatcgccaaggtgaaggagcggctggagccccgcttccaggcccctgtggatgagcagagcgagagcctgcagaacacccatgatgacagcagaaataatgctgccagcgccaggaacaaccctggctctgtgcctgagaagcgggagaagaccagcgagcccaagggcaacagctgggcccccaacggcctgtctgaggagcccctgctgaagaacatggaccaccacaggagcaagcagaagaatggaggagatgtgcccacctggagggagcaccccacctag

SEQ ID NO: 41920 - DNA, 435 bp, Artificial Sequence
  Description of Artificial Sequence: Synthetic coding sequence
atggtggaggaggtgcgccacagcgctgctgaggaggaggatgccatccacgccctgtttggctccatgcaggaccggctggccgagaggaaggccctgctgctgcaggccgtgcagagccagtatgaggagaaggacaaggccttcaaggagcagctgagccacctggccaccctgctgcccaccctgcaggtgcacctggtgatctgcagcagcttcctgagcctggccaacaaggccgagttcctggacctgggctacgccggccggggcctgcggccccagggcgcagatggagcccccctgcccctgcccagcaggaaggatgtgggcgtgacccggcccaaggcccatgctgcccctgtgcaccagcaccagggcgctgctgggggcggccgggagcacgccctgcggcgggccctgccccccctgtag

SEQ ID NO: 41921 - DNA, 786 bp, Artificial Sequence
  Description of Artificial Sequence: Synthetic coding sequence
atgcccagcgaccccggccctgaggccggcagcggctggccaggcctgctgatgagctgcctgaagggcccccacgtgatcctgaagatggaggccatgaagatcgtgcaccctgagaagtttcctgagctgcctgctgccccctgcttccccccagccccccggcccacccccaccctggcccccaagagggcctggcccagcgacacagagatcatcgtgaaccaggcctgtggcggggacatgcctgccctggagggcgccccccacaccccacccctgccccggcggcccaggaagggcagcagcgagctgggcttcccccgggtggccccagaagatgaggtgattgtgaaccagtatgtgatccggcccggccccagcgccagcgctgccagcagcgctgctgctggggagcccctggagtgccccacctgtggccacagctacaacgtgacccagaggcggccccgggtgctgagctgcctgcacagcgtgtgtgagcagtgcctgcagatcctgtatgagagctgccccaagtacaagttcatcagctgccccacctgccggcgggagaccgtgctcttcacagattatggcctggccgccctggccgtgaacaccagcatcctgagccggctgcccccagaggccctgacagcccccagcggcggccagtggggcgctgagcctgagggcagctgctaccagaccttccggcagtactgtggggccgcctgcacctgccacgtgaggaaccccctgagcgcctgcagcatcatgtag

SEQ ID NO: 41922 - DNA, 786 bp, Artificial Sequence; identical to SEQ ID NO: 41921
  Description of Artificial Sequence: Synthetic coding sequence

SEQ ID NO: 41923 - DNA, 2112 bp, Artificial Sequence
  Description of Artificial Sequence: Synthetic coding sequence
atggccgccagcgaggtggccggcgtggtggccaatgcccccagccccccagagagcagcagcctgtgtgccagcaagagtgatgagggcctgcctgatggcctgagcaccaaggacagcgcccagaagcagaagaacagccccctgctgtctgtgagcagccagaccatcaccaaggagaacaacagaaatgtgcacctggagcacagcgagcagaaccctggcagcagcgctggggacaccagcgctgcccaccaggtggtgctgggagaaaatctcatcgccacagccctgtgcctgagcggcagcggcagccagagcgacctgaaggatgtggccagcacagctggggaggagggggacaccagcctgcgggagagcctgcaccctgtgaccaggagcctgaaggccggctgccacaccaagcagctggccagcaggaactgcagcgaggagaagagcccccagaccagcatcctgaaggagggcaacagagacaccagcctggacttccggcctgtggtgtccccagccaatggagtggagggcgtgcgggtggaccaggatgatgaccaggacagcagcagcctgaagctgagccagaacattgctgtgcagacagacttcaagacagctgacagcgaggtgaacacagaccaggacatcgagaagaacctggacaagatgatgacagagaggaccctgctgaaggagcgctaccaggaggtgctggacaagcagaggcaggtggagaaccagctgcaggtgcagctgaagcagctgcagcagaggcgggaggaggagatgaagaaccaccaggagatcctgaaggccatccaggatgtgaccatcaagcgggaggagaccaagaagaagattgagaaggagaagaaggagttcctgcagaaggagcaggacctgaaggccgagattgagaagctgtgtgagaagggcagaagagaggtgtgggagatggagctggaccggctgaagaaccaggatggagagatcaacagaaacatcatggaggagacagagcgggcctggaaggccgagatcctgagcctggagagcaggaaggagctgctggtgctgaagctggaggaggccgagaaggaggccgagctgcacctgacctacctgaagagcaccccacccaccctggagaccgtgcgcagcaagcaggagtgggagacccggctgaatggagtgcgcatcatgaagaagaatgtgcgggaccagttcaacagccacatccagctggtgagaaatggagccaagctgagcagcctgccccagatccccacccccaccctgcccccaccacccagcgagacagacttcatgctgcaggtgttccagcccagccccagcctggcccccaggatgcccttcagcatcggccaggtgaccatgcccatggtgatgcccagcgctgaccccaggagcctgtccttccccatcctgaacccagccctgagccagcccagccagcccagcagccccctgcccggcagccatggaagaaacagccctggcctgggcagcctggtgagcccccacggcccccacatgcccccagctgccagcatccccccacctcctggcctgggcggcgtgaaggccagcgctgagaccccccggccccagcctgtggacaagctggagaagatcctggagaagctgctgacccgcttcccccagtgcaacaaggcccagatgaccaacatcctgcagcagatcaagacagcccggaccaccatggccggcctgaccatggaggagctgatccagctggtggccgcccggctggccgagcacgagcgggtggccgccagcacccagcccctgggccgcatccgggccctcttccctgcccccctggcccagatcagcacccccatgttcctgcccagcgcccaggtgtcctacccaggccgcagcagccacgccccagccacctgcaagctgtgcctgatgtgccagaagctggtgcagcccagcgagctgcaccccatggcctgcacccacgtgctgcacaaggagtgcatcaagttctgggcccagaccaacaccaatgacacctgccccttctgccccaccctgaagtag

SEQ ID NO: 41924 - DNA, 2112 bp, Artificial Sequence; identical to SEQ ID NO: 41923
  Description of Artificial Sequence: Synthetic coding sequence

SEQ ID NO: 41925 - DNA, 441 bp, Artificial Sequence
  Description of Artificial Sequence: Synthetic coding sequence
atggccgccagcgaggtggccggcgtggtggccaatgcccccagccccccagagagcagcagcctgtgtgccagcaagagtgatgagggcctgcctgatggcctgagcaccaaggacagcgcccagaagcagaagaacagccccctgctgtctgtgagcagccagaccatcaccaaggagaacaacagaaatgtgcacctggagcacagcgagcagaaccctggcagcagcgctggggacaccagcgctgcccaccaggtggtgctgggagaaaatctcatcgccacagccctgtgcctgagcggcagcggcagccagagcgacctgaaggatgtggccagcacagctggggaggagggggacaccagcctgcgggagagcctgcaccctgtgaccaggagcctgaaggccggctgccacaccaagcagctggccagctag

SEQ ID NO: 41926 - DNA, 2181 bp, Artificial Sequence
  Description of Artificial Sequence: Synthetic coding sequence
atggcccagacagtgcagaatgtgaccctgagcctgaccctgcccatcacctgccacatctgcctgggcaaggtgcggcagcccgtcatctgcatcaacaaccacgtgttctgcagcatctgcatcgacctgtggctgaagaacaacagccagtgcccagcctgccgggtgcccatcaccccagagaacccctgcaaggagatcattggaggcaccagcgagagcgagcccatgctgagccacacagtgaggaagcacctgaggaagacccggctggagctgctgcacaaggagtatgaagatgaaattgactgcctgcagaaggaggtggaggagctgaagagcaagaacctgagcctggagagccagatcaagaccatcctggaccccctgaccctggtgcagggcaaccagaatgaagacaagcacctggtgacagacaaccccagcaagatcaaccctgagaccgtggccgagtggaagaagaagctgaggacagccaatgagatctatgagaaggtgaaggatgatgtggacaagctgaaggaggccaacaagaagctgaagctggagaatggaggcctggtgcgggagaacctgcggctgaaggccgaggtggacaacagaagcccccagaagtttggccgctttgctgtggccgccctgcagagcaaggtggagcagtatgagcgggagaccaaccggctgaagaaggccctggagaggagtgacaagtacatcgaggagctggagagccaggtggcccagctgaagaacagcagcgaggagaaggaggccatgaacagcatctgccagacagccctgtctgcagatggcaagggcagcaaaggaagtgaagaagatgtggtgtccaagaaccagggcgacagcgccaggaagcagcccggcagcagcaccagcagcagcagccacctggccaagcccagcagcagccggctgtgtgacaccagcagcgcccggcaggagagcaccagcaaggctgacctgaactgcagcaagaacaaggacctgtaccaggagcaggtggaggtgatgctggatgtgacagacacctccatggacacctacctggagcgggagtggggcaacaagcccagcgactgtgtgccctacaaggatgaggagctgtatgacctgcctgccccctgcacccccctgagcctgagctgcctgcagctgagcaccccagagaaccgggagagctctgtggtgcaggccggcggcagcaagaagcacagcaaccacctgaggaagctggtgtttgatgacttctgtgacagcagcaatgtgagcaacaaggacagcagtgaagatgacatcagccgctcagaaaatgagaagaagtctgagtgcttcagcagccccaagacaggcttctgggactgctgcagcaccagctatgcccagaacctggactttgagagcagcgagggcaacaccatcgccaacagcgtgggggagatcagcagcaagctgtctgagaagagcggcctgtgcctgagcaagaggctgaacagcatccgcagctttgagatgaacagaaccaggaccagcagcgaggcctccatggatgctgcctacctggacaagatcagcgagctggacagcatgatgtctgagagtgacaacagcaagagcccctgcaacaacggcttcaagagcctggacctggatggcctgagcaagagcagccagggcagcgagttcctggaggagccagacaagctggaggagaagacagagctgaacctgagcaagggcagcctgaccaatgaccagctggagaatggaagtgagtggaagcccaccagcttcttcctgctgagccccagcgaccaggagatgaatgaagacttcagcctgcacagcagcagctgccctgtgaccaatgagatcaagccacccagctgcctcttccagacagagttcagccagggcatcctgctgagcagcagccaccggctgtttgaggaccagcgcttcggcagcagcctcttcaagatgagcagcgagatgcacagcctgcacaaccacctgcagagcccctggagcaccagctttgtgcctgagaagaggaacaagaatgtgaaccagagcaccaagaggaagatccagagcagcctgagcagcgccagccccagcaaggccaccaagagctag

SEQ ID NO: 41927 - DNA, 663 bp, Artificial Sequence
  Description of Artificial Sequence: Synthetic coding sequence
atgtctgagggggagagcaaggacagcagcggctctgaatgtcctgtgtgctatgagaagttccgggacctggagggcgccagcaggaccctgagctgtggccacgtgttctgccacgactgcctggtgaagtacctgctgagcaccagggtggatggccaggtgcagaggaccctggtgtgccccatctgccgctacgtgaccttcctgagcaagaagagcagccgctggcccagcatgctggacaagagcagccagaccctggccgtgcctgtgggcctgcccagcgtgccccccctggacagcctgggccacaccaaccccctggccgccagcagccctgcctggaggcctcctcctggccaggcccggcccccaggcagccctggccagagcgcccagctgcccctggacctgctgcccagcctgccccgggagagccagatcttcgtcatcagcagacatggcatgcccctgggggagcaggacagcgtgctgccccggcgcagcctggccgagctgtctgaggccagcctggcccccaggtctgcccgggccttctgctgccgcagccgggccctgctgctgatcaccctgattgctgtggtggccgtggtggccgccatcctgccctgggtgctgctggtgaggaagcaggcctag

SEQ ID NO: 41928 - DNA, 663 bp, Artificial Sequence; identical to SEQ ID NO: 41927
  Description of Artificial Sequence: Synthetic coding sequence

SEQ ID NO: 41929 - DNA, 471 bp, Artificial Sequence
  Description of Artificial Sequence: Synthetic coding sequence
atgcaggatgctgctgctgggggccccccaggcctgggcggcggcggccccccagaggagaggacagactgcatcatctgctgcagcgcctatgacctgagcggccacctgccccggcggctgtactgcggccacaccttctgccaggcctgtgtgcggcggctggacaccccagcccctgagcagcgctggatcccctgcccccagtgccggcagagcacccccaccccccggggcggcgtggccatgctggacctggacctggccgccttcctggccgtgaaggccgagcgggagcccgcccggctggagcccctgcccctgaccagcctgaagggcagcgccatcacccggcagcctgctggcctgtgcccagccctgggcccccagccccacttcccccagccccgctactgctgctggggctgcggcagcctgtgctgcccccccctgggcagccctgaggtgtag

SEQ ID NO: 41930 - DNA, 954 bp, Artificial Sequence
  Description of Artificial Sequence: Synthetic coding sequence
atgggctatgatgtgacccgcttccagggagatgtggatgaggacctgatctgccccatctgcagcggcgtgctggaggagcctgtgcaggccccccactgtgagcacgccttctgcaatgcctgcatcacccagtggttcagccagcagcagacctgccctgtggacagatctgtggtgacagtggcccacctgcggcctgtgccccgcatcatgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctggaggagaccatcgagtacaatgagatcctggagtgggtgaacagcctgcagcctgcccgggtgacccgctggggcggcatgatcagcaccccagatgctgtgctgcaggccgtcatcaagaggagcctggtggagagcggctgcccagccagcatcgtgaatgagctgattgaaaatgcccacgagaggtcctggccccagggcctggccaccctggagacccggcagatgaacagacgctactatgaaaattatgtggccaagagaattcctgggaagcaggccgtggtggtgatggcctgtgagaaccagcacatgggagatgacatggtgcaggagcccggcctggtgatgatctttgcccacggcgtggaggagatctag

SEQ ID NO: 41931 - DNA, 741 bp, Artificial Sequence
  Description of Artificial Sequence: Synthetic coding sequence
atgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctggaggagaccatcgagtacaatgagatcctggagtgggtgaacagcctgcagcctgcccgggtgacccgctggggcggcatgatcagcaccccagatgctgtgctgcaggccgtcatcaagaggagcctggtggagagcggctgcccagccagcatcgtgaatgagctgattgaaaatgcccacgagaggtcctggccccagggcctggccaccctggagacccggcagatgaacagacgctactatgagaactacgtggccaagagaattcctgggaagcaggccgtggtggtgatggcctgtgagaaccagcacatgggagatgacatggtgcaggagcccggcctggtgatgatctttgcccatggagtggaggagatctag

SEQ ID NO: 41932 - DNA, 915 bp, Artificial Sequence
  Description of Artificial Sequence: Synthetic coding sequence
atgggctatgatgtgacccgcttccagggagatgtggatgaggacctgatctgccccatctgcagcggcgtgctggaggagcctgtgcaggccccccactgtgagcacgccttctgcaatgcctgcatcacccagtggttcagccagcagcagacctgccctgtgccccgcatcatgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctggaggagaccatcgagtacaatgagatcctggagtgggtgaacagcctgcagcctgcccgggtgacccgctggggcggcatgatcagcaccccagatgctgtgctgcaggccgtcatcaagaggagcctggtggagagcggctgcccagccagcatcgtgaatgagctgattgaaaatgcccacgagaggtcctggccccagggcctggccaccctggagacccggcagatgaacagacgctactatgagaactacgtggccaagagaattcctgggaagcaggccgtggtggtgatggcctgtgagaaccagcacatgggagatgacatggtgcaggagcccggcctggtgatgatctttgcccatggagtggaggagatctag

SEQ ID NO: 41933 - DNA, 573 bp, Artificial Sequence
  Description of Artificial Sequence: Synthetic coding sequence
atgggctatgatgtgacccgcttccagggagatgtggatgaggacctgatctgccccatctgcagcggcgtgctggaggagcctgtgcaggccccccactgtgagcacgccttctgcaatgcctgcatcacccagtggttcagccagcagcagacctgccctgtggacagatctgtggtgacagtggcccacctgcggcctgtgccccgcatcatgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctgtag

SEQ ID NO: 41934 - DNA, 441 bp, Artificial Sequence
  Description of Artificial Sequence: Synthetic coding sequence
atgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctggaggagaccatcgagtacaatgagatcctggagtgggtgaacagcctgcagcctgcccgggtgacccgctggggcggcatgtag

SEQ ID NO: 41935 - DNA, 606 bp, Artificial Sequence
  Description of Artificial Sequence: Synthetic coding sequence
atgggctatgatgtgacccgcttccagggagatgtggatgaggacctgatctgccccatctgcagcggcgtgctggaggagcctgtgcaggccccccactgtgagcacgccttctgcaatgcctgcatcacccagtggttcagccagcagcagacctgccctgtggacagatctgtggtgacagtggcccacctgcggcctgtgccccgcatcatgaggaacatgctgagcaagctgcagatcgcctgtgacaatgctgtgtttggctgcagcgctgtggtgcggctggacaacctgatgagccacctgagtgactgtgagcacaaccccaagaggcctgtgacctgtgagcagggctgcggcctggagatgcccaaggatgagctgcccaaccacaactgcatcaagcacctgcggtctgtggtgcagcagcagcagaccagaattgctgagctggagaagaccagcgctgagcacaagcaccagctggccgagcagaagagggacatccagctgctgaaggcctacatgagggccatccgctctgtgaaccccaacctgcagaacctggaggagaccatcgagtacaatgagatcctggagtag

SEQ ID NO: 41936 - DNA, 954 bp, Artificial Sequence; identical to SEQ ID NO: 41930
  Description of Artificial Sequence: Synthetic coding sequence

SEQ ID NO: 41937 - DNA, 1299 bp, Artificial Sequence
  Description of Artificial Sequence: Synthetic coding sequence
atgaggccctgggccctggccgtgacccgctggccacccagcgcccctgtgggccagaggcgcttctctgctggccctggcagcaccccaggccagctgtggggcagccctggcctggagggccccctggccagccccccagccagagatgagcggctgcccagccagcagccccccagccggcccccccacctgcctgtggaggagcggcgggccagcgccccagctgggggcagccccaggatgctgcacccagccacccagcagagccccttcatggtggacctgcacgagcaggtgcaccagggccctgtgcccctgagctacacagtgaccaccgtgaccacccagggcttccccctgcccaccggccagcacatccctggctgcagcgcccagcagctgcctgcctgcagcgtgatgttttctggccagcactaccccctgtgctgcctgcccccacccctcatccaggcctgcaccatgcagcagctgcctgtgccctaccaggcctacccccacctgatcagcagtgaccactacatcctgcaccccccacctccagcccccccaccccagcccacccacatggcccccctgggccagtttgtgtccctgcagacccagcaccccaggatgcccctgcagaggctggacaatgatgtggacctgcggggggaccagcccagcctgggcagcttcacctacagcaccagcgcccctggccctgccctgagccccagcgtgcccctgcactacctgccccatgaccccctgcaccaggagctgagctttggagtgccctacagccacatgatgccccggcggctgagcacccagcgctaccgcctgcagcagcccctgcccccacctcctcctcctcctcctcctccaccctactaccccagcttcctgccctacttcctgtccatgctgcccatgagccccacagccatgggccccaccatcagcctggacctggatgtggatgatgtggagatggagaactatgaggccctgctgaacctggccgagcggctgggagatgccaagccccggggcctgaccaaggctgacatcgagcagctgcccagctaccgcttcaacccagacagccaccagagcgagcagaccctgtgtgtggtgtgcttcagtgactttgaggcccggcagctgctgcgggtgctgccctgcaaccacgagttccacaccaagtgtgtggacaagtggctgaaggccaacagaacctgccccatctgcagagcagatgccagcgaggtgccccgggaggccgagtag

SEQ ID NO: 41938 - DNA, 1056 bp, Artificial Sequence
  Description of Artificial Sequence: Synthetic coding sequence
atgctgcacccagccacccagcagagccccttcatggtggacctgcacgagcaggtgcaccagggccctgtgcccctgagctacacagtgaccaccgtgaccacccagggcttccccctgcccaccggccagcacatccctggctgcagcgcccagcagctgcctgcctgcagcgtgatgttcagcggccagcactaccccctgtgctgcctgcccccacccctcatccaggcctgcaccatgcagcagctgcctgtgccctaccaggcctacccccacctgatcagcagtgaccactacatcctgcaccccccacctccagcccccccaccccagcccacccacatggcccccctgggccagtttgtgtccctgcagacccagcaccccaggatgcccctgcagaggctggacaatgatgtggacctgcggggggaccagcccagcctgggcagcttcacctacagcaccagcgcccctggccctgccctgagccccagcgtgcccctgcactacctgccccatgaccccctgcaccaggagctgagctttggagtgccctacagccacatgatgccccggcggctgagcacccagcgctaccgcctgcagcagcccctgcccccacctcctcctcctcctcctcctccaccctactaccccagcttcctgccctacttcctgtccatgctgcccatgagccccacagccatgggccccaccatcagcctggacctggatgtggatgatgtggagatggagaactatgaggccctgctgaacctggccgagcggctgggagatgccaagccccggggcctgaccaaggctgacatcgagcagctgcccagctaccgcttcaacccagacagccaccagagcgagcagaccctgtgtgtggtgtgcttcagtgactttgaggcccggcagctgctgcgggtgctgccctgcaaccacgagttccacaccaagtgtgtggacaagtggctgaaggccaacagaacctgccccatctgcagagcagatgccagcgaggtgccccgggaggccgagtag

SEQ ID NO: 41939 - DNA, 1707 bp, Artificial Sequence
  Description of Artificial Sequence: Synthetic coding sequence
atggactaccgccgcctgctgatgagccgggtggtgcccggccagtttgatgatgctgacagcagtgacagtgaaaatagagacctgaagacagtgaaggagaaggatgacatcctgtttgaggacctgcaggacaacgtgaatgaaaatggagagggggagattgaagatgaggaggaggagggctatgatgatgatgatgatgactgggactgggatgaaggagtgggcaagctggccaagggctacgtgtggaatggaggcagcaacccccaggccaaccggcagaccagtgacagcagcagcgccaagatgagcaccccagctgacaaggtgctgaggaagtttgagaacaagatcaacctggacaagctgaatgtgacagacagcgtcatcaacaaggtgacagagaagagccggcagaaggaggccgacatgtaccgcatcaaggacaaggctgaccgggccaccgtggagcaggtgctggaccccaggaccaggatgatcctcttcaagatgctgacccggggcatcatcacagagatcaatggctgcatcagcacaggcaaggaggccaacgtgtaccacgccagcacagccaatggagagagccgggccatcaagatctacaagaccagcatcctggtgttcaaggaccgggacaagtatgtgtctggagagttccgcttccgccacggctactgcaagggcaaccccaggaagatggtgaagacctgggccgagaaggagatgaggaacctgatccggctgaacacagctgagatcccctgcccagagcccatcatgctgcggagccacgtgctggtgatgtccttcatcggcaaggatgacatgcctgcccccctgctgaagaatgtgcagctgtctgagagcaaggcccgggagctgtacctgcaggtgatccagtacatgaggaggatgtaccaggatgcccggctggtgcatgctgacctgtctgagttcaacatgctgtaccatggaggcggcgtgtacatcattgatgtgtcccagagcgtggagcatgaccacccccacgccctggagttcctgaggaaggactgtgccaacgtgaatgacttcttcatgaggcacagcgtggccgtgatgacagtgcgggagctgtttgaatttgtgacagaccccagcatcacccatgagaacatggatgcctacctgagcaaggccatggagatcgccagccagaggaccaaggaggagaggagcagccaggaccacgtggatgaggaggtgttcaagagggcctacatccccaggaccctgaatgaggtgaagaactatgaaagagacatggacatcatcatgaagctgaaggaggaggacatggccatgaatgcccagcaggacaacatcctgtaccagacagtgacaggcctgaagaaggacctgtctggagtgcagaaggtgcctgccctgctggagaaccaggtggaggagaggacctgcagcgacagtgaagatattggcagcagtgaatgtagtgacacagattctgaggagcagggcgaccacgcccggcccaagaagcacaccacagatcctgacatcgacaagaaggagaggaagaagatggtgaaggaggcccagcgggagaagaggaagaacaagatccccaagcacgtgaagaagaggaaggagaagacagccaagaccaagaagggcaagtag

SEQ ID NO: 41940 - DNA, 1659 bp, Artificial Sequence
  Description of Artificial Sequence: Synthetic coding sequence
atgggcaaggtgaatgtggccaagctgcgctacatgagcagagatgacttccgggtgctgacagctgtggagatgggcatgaagaaccacgagatcgtgcccggcagcctcatcgccagcatcgccagcctgaagcacggcggctgcaacaaggtgctgcgggagctggtgaagcacaagctgattgcctgggagaggaccaagacagtgcagggctaccgcctgaccaatgccggctatgactacctggccctgaagaccctgagcagccggcaggtggtggagagcgtgggcaaccagatgggcgtgggcaaggagagtgacatctacatcgtggccaatgaggagggccagcagtttgccctgaagctgcaccggctgggccgcaccagcttcaggaacctgaagaacaagagggactaccacaagcaccgccacaacgtgtcctggctgtacctgagccggctgagcgccatgaaggagtttgcctacatgaaggccctgtatgaaaggaagtttcctgtgcccaagcccatcgactacaacagacatgctgtggtgatggagctgatcaatggctaccccctgtgccagatccaccacgtggaggaccctgcctctgtgtatgatgaggccatggagctgattgtgaagctggccaaccacggcctcatccacggggacttcaatgagttcaacctgatcctggatgaaagtgaccacatcaccatgattgacttcccccagatggtgtccaccagccaccccaatgctgagtggtactttgacagagatgtgaagtgcatcaaggacttcttcatgaagcgcttctcctatgaaagtgagctgttccccaccttcaaggacatcagaagagaggacaccctggatgtggaggtgtctgccagcggctacaccaaggagatgcaggctgatgatgagctgctgcaccccctgggcccagatgacaagaacatcgagaccaaggagggcagcgagttctccttcagtgatggagaggtggccgagaaggccgaggtgtatggctctgaaaatgaaagtgagaggaactgcctggaggagagcgagggctgctactgccgcagcagcggggaccctgagcagatcaaggaggacagcctgtctgaggagagcgcagatgcccggagctttgagatgacagagttcaaccaggccctggaggagatcaagggccaggtggtggagaacaacagcgtgacagagttcagcgaggagaagaacagaacagagaactacaaccggcaggacggccagagggtgcagggcggcgtgcctgctggcagtgatgaatatgaagatgagtgcccccacctgattgccctgagcagcctgaaccgggagttccggcccttcagagatgaagaaaatgtgggcgccatgaaccagtaccgcaccaggaccctgagcatcaccagcagcggcagcgctgtgtcctgcagcaccatccccccagagctggtgaagcagaaggtgaagaggcagctgaccaagcagcagaagtctgctgtgagaagaaggctgcagaagggggaggccaacatcttcaccaagcagaggcgggagaacatgcagaacatcaagagcagcctggaggccgccagcttctggggcgagtag

SEQ ID NO: 41941 - DNA, 1425 bp, Artificial Sequence
  Description of Artificial Sequence: Synthetic coding sequence
atgggcaaggtgaatgtggccaagctgcgctacatgagcagagatgacttccgggtgctgacagctgtggagatgggcatgaagaaccacgagatcgtgcccggcagcctcatcgccagcatcgccagcctgaagcacggcggctgcaacaaggtgctgcgggagctggtgaagcacaagctgattgcctgggagaggaccaagacagtgcagggctaccgcctgaccaatgccggctatgactacctggccctgaagaccctgagcagccggcaggtggtggagagcgtgggcaaccagatgggcgtgggcaaggagagtgacatctacatcgtggccaatgaggagggccagcagtttgccctgaagctgcaccggctgggccgcaccagcttcaggaacctgaagaacaagagggactaccacaagcaccgccacaacgtgtcctggctgtacctgagccggctgagcgccatgaaggagtttgcctacatgaaggccctgtatgaaaggaagtttcctgtgcccaagcccatcgactacaacagacatgctgtggtgatggagctgatcaatggctaccccctgtgccagatccaccacgtggaggaccctgcctctgtgtatgatgaggccatggagctgattgtgaagctggccaaccacggcctcatccacggggacttcaatgagttcaacctgatcctggatgaaagtgaccacatcaccatgattgacttcccccagatggtgtccaccagccaccccaatgctgagtggtactttgacagagatgtgaagtgcatcaaggacttcttcatgaagcgcttctcctatgaaagtgagctgttccccaccttcaaggacatcagaagagaggacaccctggatgtggaggtgtctgccagcggctacaccaaggagatgcaggctgatgatgagctgctgcaccccctgggcccagatgacaagaacatcgagaccaaggagggcagcgagttctccttcagtgatggagaggtggccgagaaggccgaggtgtatggctctgaaaatgaaagtgagaggaactgcctggaggagagcgagggctgctactgccgcagcagcggggaccctgagcagatcaaggaggacagcctgtctgaggagagcgcagatgcccggagctttgagatgacagagttcaaccaggccctggaggagatcaagggccaggtggtggagaacaacagcgtgacagagttcagcgaggagaagaacagaacagagaactacaaccggcaggacggccagagggtgcagggcggcgtgcctgctggcagtgatgaatatgaagatgagtgcccccacctgattgccctgagcagcctgaaccgggagttccggcccttccgctaccgcctgctgagcatcgccttctag

SEQ ID NO: 41942 - DNA, 1560 bp, Artificial Sequence
  Description of Artificial Sequence: Synthetic coding sequence
atggacctggtgggcgtggccagccctgagcctggaacagctgctgcctggggccccagcaaatgtccctgggccatcccccagaacaccatcagctgcagcctggctgatgtgatgtctgagcagctggccaaggagctgcagctggaggaggaggccgctgtgtttcctgaggtggccgtggccgagggccccttcatcaccggggagaacatcgacaccagcagtgacctgatgctggcccagatgctgcagatggagtatgaccgggagtatgatgcccagctgcggcgggaggagaagaagttcaacggggacagcaaggtgtccatcagctttgagaactacaggaaggtgcacccctatgaagattctgacagcagtgaagatgaggtggactggcaggacaccagagatgacccctacagacctgccaagcctgtgcccacccccaagaagggcttcatcggcaagggcaaggacatcaccaccaagcatgatgaggtggtgtgtggcaggaagaacacagccaggatggagaactttgcccctgagttccaggtgggagatggcatcggcatggacctgaagctgagcaaccacgtgttcaatgccctgaagcagcacgcctacagcgaggagaggagaagtgcccggctgcacgagaagaaggagcacagcacagctgagaaggctgtggaccccaagacccggctgctgatgtacaagatggtgaacagcggcatgctggagaccatcaccggctgcatcagcacaggcaaggagagcgtggtgttccacgcctatggaggctccatggaggatgagaaggaggacagcaaggtgatccccacagaatgtgccatcaaggtgttcaagaccaccctgaatgagttcaagaacagagacaagtacatcaaggatgacttccgcttcaaggaccgcttcagcaagctgaaccccaggaagatcatccgcatgtgggccgagaaggagatgcacaacctggccaggatgcagagagctggcatcccctgccccaccgtggtgctgctgaagaagcacatcctggtgatgtccttcatcggccatgaccaggtgcctgcccccaagctgaaggaggtgaagctgaacagcgaggagatgaaggaggcctactaccagaccctgcacctgatgaggcagctgtaccatgaatgtaccctggtgcatgctgacctgtctgagtacaacatgctgtggcacgccggcaaggtgtggctgattgatgtgtcccagagcgtggagcccacccacccccacggcctggagttcctgttccgggactgcagaaatgtgtcccagttcttccagaagggcggcgtgaaggaggccctgtctgagcgggagctgttcaatgctgtgtctggcctgaacatcacagctgacaatgaagctgacttcctggccgagattgaggccctggagaagatgaatgaagatcatgtgcagaagaatggaaggaaggccgccagcttcctgaaggatgatggagacccccccctgctgtatgatgaatag

SEQ ID NO: 41943 - DNA, 1248 bp, Artificial Sequence
  Description of Artificial Sequence: Synthetic coding sequence
atgaatgtgaccagcatcgccctgcgggcagagacctggctgctggccgcctggcacgtgaaggtgccccccatgtggctggaggcctgcatcaactggatccaggaggagaacaacaacgtgaacctgagccaggcccagatgaacaagcaggtgtttgagcagtggctgctgacagacctgcgggacctggagcaccccctgctgcctgatggcatcctggagatccccaagggggagctgaatggcttctacgccctgcagatcaacagcctggtggatgtgtcccagcctgcctacagccagatccagaagctgcggggcaagaacaccaccaatgacctggtgacagctgaggcccaggtgacccccaagccctgggaggccaagcccagcaggatgctgatgctgcagctgacagatggcatcgtgcagatccagggcatggagtaccagcccatccccatcctgcacagcgacctgcccccaggcaccaagatcctgatctacggcaacatctccttccggctgggcgtgctgctgctgaagccagaaaatgtgaaggtgctgggcggggaggtggatgccctgctggaggagtatgcccaggagaaggtgctggcccggctgattggagagccagacctggtggtgtctgtcatccccaacaacagcaatgaaaacatcccccgggtgacagatgtgctggaccctgccctgggccccagtgatgaggagctgctggccagcctggatgaaaatgatgagctgacagccaacaatgacaccagcagcgagcgctgcttcaccaccggcagcagcagcaacaccatccccacccggcagagcagctttgagcctgagtttgtgatcagcccccggcccaaggaggagcccagcaacctgagcatccacgtgatggatggagagctggatgacttcagcctggaggaggccctgctgctggaggagaccgtgcagaaggagcagatggagaccaaggagctgcagcccctgaccttcaacagaaatgctgacaggagcattgagcgcttcagccacaaccccaacaccaccaacaacttcagcctgacctgcaagaatggaaacaacaactggagcgagaagaatgtgtctgagcagatgaccaatgaagacaagagctttggctgccccagcgtgcgggaccagaacagaagcatcttctctgtgcactgcaatgtgcccctggcccatgacttcacctag

SEQ ID NO: 41944 - DNA, 1020 bp, Artificial Sequence
  Description of Artificial Sequence: Synthetic coding sequence
atgagcagcgagatgctgcctgccttcatcgagaccagcaatgtggacaagaagcagggcatcaatgaagaccaggaggagagccagaagccccggctgggggagggctgtgagcccatcagcaagaggcagatgaagaagctgatcaagcagaagcagtgggaggagcagcgggagctgaggaagcagaagaggaaggagaagaggaagaggaagaagctggagcggcagtgccagatggagcccaacagtgatggccatgacaggaagagggtgagaagagatgtggtgcacagcaccctgcggctcatcatcgactgcagctttgaccacctgatggtgctgaaggacatcaagaagctgcacaagcagatccagcgctgctacgcagaaaatagaagagccctgcaccctgtgcagttctacctgaccagccacggcggccagctgaagaagaacatggatgaaaatgacaagggctgggtgaactggaaggacatccacatcaagccagagcactacagcgagctgatcaagaaggaggacctgatctacctgaccagtgacagccccaacatcctgaaggagctggatgagagcaaggcctacgtgattggaggcctggtggaccacaaccaccacaagggcctgacctacaagcaggccagtgactatggcatcaaccacgcccagctgcccctgggcaactttgtgaagatgaacagcaggaaggtgctggccgtgaaccacgtgtttgagatcatcctggagtacctggagacccgggactggcaggaggccttcttcaccatcctgccccagaggaaaggagctgtgcccacagacaaggcctgtgagagcgccagccatgacaaccagagcgtgaggatggaggagggcggcagtgacagcgacagcagcgaggaggagtacagcagaaatgagctggacagcccccatgaggagaagcaggacaaggagaaccacacagagagcacagtgaacagcctgccccactag

SEQ ID NO: 41945 - DNA, 1020 bp, Artificial Sequence; identical to SEQ ID NO: 41944
  Description of Artificial Sequence: Synthetic coding sequence

SEQ ID NO: 41946 - DNA, 1020 bp, Artificial Sequence; identical to SEQ ID NO: 41944
  Description of Artificial Sequence: Synthetic coding sequence

SEQ ID NO: 41947 - DNA, 621 bp, Artificial Sequence
  Description of Artificial Sequence: Synthetic coding sequence
atgagcagcgagatgctgcctgccttcatcgagaccagcaatgtggacaagaagcagggcatcaatgaagaccaggaggagagccagaagccccggctgggggagggctgtgagcccatcagcaagaggcagatgaagaagctgatcaagcagaagcagtgggaggagcagcgggagctgaggaagcagaagaggaaggagaagaggaagaggaagaagctggagcggcagtgccagatggagcccaacagtgatggccatgacaggaagagggtgagaagagatgtggtgcacagcaccctgcggctcatcatcgactgcagctttgaccacctgatggtgctgaaggacatcaagaagctgcacaagcagatccagcgctgctacgcagaaaatagaagagccctgcaccctgtgcagttctacctgaccagccacggcggccagctgaagaagaacatggatgaaaatgacaagggctgggtgaactggaaggacatccacatcaagccagagcactacagcgagctgatcaagaaggaggacctgatctacctgaccagtgacagccccaacatcctgaaggagctggatgagagcaaggcctacgtgattggatag

SEQ ID NO: 41948 - DNA, 603 bp, Artificial Sequence
  Description of Artificial Sequence: Synthetic coding sequence
atgagcagcgagatgctgcctgccttcatcgagaccagcaatgtggacaagaagcagggcatcaatgaagaccaggaggagagccagaagccccggctgggggagggctgtgagcccatcagcaagaggcagatgaagaagctgatcaagcagaagcagtgggaggagcagcgggagctgaggaagcagaagaggaaggagaagaggaagaggaagaagctggagcggcagtgccagatggagcccaacagtgatggccatgacaggaagagggtgagaagagatgtggtgcacagcaccctgcggctcatcatcgactgcagctttgaccacctgatggtgctgaaggacatcaagaagctgcacaagcagatccagcgctgctacgcagaaaatagaagagccctgcaccctgtgcagttctacctgaccagccacggcggccagctgaagaagaacatggatgaaaatgacaagggctgggtgaactggaaggacatccacatcaagccagagcactacagcgagctgatcaagaaggaggacctgatctacctgaccagtgacagccccaacatcctgaaggagctggatgagagctag

SEQ ID NO: 41949 - DNA, 951 bp, Artificial Sequence
  Description of Artificial Sequence: Synthetic coding sequence
atggactggaagctggagggcagcacccagaaggtggagagccctgtgctgcagggccaggagggcatcctggaggagactggagaagatggcctgcctgagggcttccagctgctgcagattgatgctgagggggagtgccaggagggggagatcctggccaccggcagcacagcctggtgcagcaagaatgtgcagaggaagcagaggcactgggagaagatcgtggccgccaagaagagcaagaggaagcaggagaaggagaggaggaaggccaacagagctgagaaccctggcatctgcccccagcacagcaagcgcttcctgcgggccctgaccaaggacaagctgctggaggccaagcacagcggcccccggctgtgcatcgacctgtccatgacccactacatgagcaagaaggagctgagccggctggccggccagatccggcggctgtatggcagcaacaagaaggctgaccggcccttctggatctgcctgaccggcttcaccacagacagccccctgtatgaagaatgtgtgaggatgaatgatggcttcagcagctacctgctggacatcacagaggaggactgcttcagcctcttccccctggagaccctggtgtacctgaccccagattctgaacatgccctggaggatgtggacctgaacaaggtgtacatcctgggcggcctggtggatgagagcatccagaagaaggtgaccttccagaaggcccgggagtacagcgtgaagacagcccggctgcccatccaggagtacatggtgaggaaccagaatggcaagaactaccacagcgagatcctggccatcaaccaggtgtttgacatcctgagcacctacctggagacccacaactggccagaggccctgaagaagggcgtgtcctctgggaagggctacatcctgaggaacagcgtggagtag

SEQ ID NO: 41950 - DNA, 690 bp, Artificial Sequence
  Description of Artificial Sequence: Synthetic coding sequence
atggactggaagctggagggcagcacccagaaggtggagagccctgtgctgcagggccaggagggcatcctggaggagactggagaagatggcctgcctgagggcttccagctgctgcagattgatgctgagggggagtgccaggagggggagatcctggccaccggcagcacagcctggtgcagcgagctgagccggctggccggccagatccggcggctgtatggcagcaacaagaaggctgaccggcccttctggatctgcctgaccggcttcaccacagacagccccctgtatgaagaatgtgtgaggatgaatgatggcttcagcagctacctgctggacatcacagaggaggactgcttcagcctcttccccctggagaccctggtgtacctgaccccagattctgaacatgccctggaggatgtggacctgaacaaggtgtacatcctgggcggcctggtggatgagagcatccagaagaaggtgaccttccagaaggcccgggagtacagcgtgaagacagcccggctgcccatccaggagtacatggtgaggaaccagaatggcaagaactaccacagcgagatcctggccatcaaccaggagacccacaactggccagaggccctgaagaagggcgtgagcagcggcaagggctacatcctgagaaattctgtggagtag

SEQ ID NO: 41951 - DNA, 771 bp, Artificial Sequence
  Description of Artificial Sequence: Synthetic coding sequence
atggactggaagctggagggcagcacccagaaggtggagagccctgtgctgcagggccaggagggcatcctggaggagactggagaagatggcctgcctgagggcttccagctgctgcagattgatgctgagggggagtgccaggagggggagatcctggccaccggcagcacagcctggtgcagcaagaatgtgcagaggaagcagaggcactgggagaagatcgtggccgccaagaagagcaagaggaagcaggagaaggagaggaggaaggccaacagagctgagaaccctggcatctgcccccagcacagcaagcgcttcctgcgggccctgaccaaggacaagctgctggaggccaagcacagcggcccccggctgtgcatcgacctgtccatgacccactacatgagcaagaagctggacatcacagaggaggactgcttcagcctcttccccctggagaccctggtgtacctgaccccagacagcgagcacgccctggaggatgtggacctgaacaaggtgtacatcctgggcggcctggtggatgagagcatccagaagaaggtgaccttccagaaggcccgggagtacagcgtgaagacagcccggctgcccatccaggagtacatggtgaggaaccagaatggcaagaactaccacagcgagatcctggccatcaaccaggagacccacaactggccagaggccctgaagaagggcgtgtcctctgggaagggctacatcctgaggaacagcgtggagtag

SEQ ID NO: 41952 - DNA, 474 bp, Artificial Sequence
  Description of Artificial Sequence: Synthetic coding sequence
atgagcagcgaggagggcaagctgtttgtgggcggcctgaacttcaacacagatgagcaggccctggaggaccacttcagcagctttggccccatcagcgaggtggtggtggtgaaggaccgggagacccagaggagccggggcttcggcttcatcaccttcaccaaccctgagcacgcctctgtggccatgagggccatgaatggagagagcctggatggccggcagatccgggtggaccacgccggcaagagcgcccggggcacccggggcggcggctttggagcccacggccggggccgcagctacagccggggcggcggggaccagggctacggcagcggccgctactatgacagcaggcctgggggctacggctacggctacggccgcagccgggactacaacggcaggaaccagggcggctatgaccgctacagcggcggcaactacagagacaactatgacaactag

SEQ ID NO: 41953 - DNA, 846 bp, Artificial Sequence
  Description of Artificial Sequence: Synthetic coding sequence
atgtttcctgcccaggaggaggccgacagaacagtgtttgtgggcaacctggaggcccgggtgcgggaggagatcctgtatgagctgttcctgcaggccggccccctgaccaaggtgaccatctgcaaggaccgggagggcaagcccaagagctttggatttgtgtgcttcaagcaccctgagagcgtgtcctatgccatcgccctgctgaatggcatccggctgtatggccggcccatcaacgtgcagtaccgcttcggcagcagccgcagcagcgagcccgccaaccagagctttgagagctgtgtgaagatcaacagccacaactacagaaatgaggagatgctggtgggccgcagcagcttccccatgcagtacttccccatcaacaacaccagcctgccccaggagtacttcctgttccagaagatgcagtggcacgtgtacaaccctgtgctgcagctgccctactatgagatgacagcccccctgcccaacagcgcctctgtgagcagcagcctgaaccacgtgcctgacctggaggccggccccagcagctacaagtggacccaccagcagcccagcgacagcgacctgtaccagatgacagcccccctgcccaacagcgcctctgtgagcagcagcctgaaccacgtgcctgacctggaggccggccccagcagctacaagtggacccaccagcagcccagcgacagcgacctgtaccagatgaacaagaggaagaggcagaagcagaccagtgacagcgacagcagcacagacaacaacagaggaaatgaatgttcccagaagttcaggaagagcaagaagaagaagcgctactag

SEQ ID NO: 41954 - DNA, 3006 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagaccatcgagatgaagaggacagacagagtgggccggggccggcccggcagcggcaccagcggcgtggacagcctgagcaacttcatcgagagcgtgaaggaggaggccagcaacagcggctacggcagcagcatcaaccaggatgctggcttccacaccaatggaactggacatggcaacctgcggcccaggaagacccggcccctgaaggccgagaacccctacctgttcctgcggggcctgccctacctggtgaatgaagatgatgtgcgggtcttcttcagcggcctgtgtgtggatggagtcatcttcctgaagcaccatgatggcaggaacaatggagatgccatcgtgaagtttgccagctgtgtggatgccagcggcggcctgaagtgccacaggagcttcatgggcagccgcttcatcgaggtgatgcagggcagcgagcagcagtggattgaatttggaggaaatgctgtgaaggagggagatgtgctgcggcgctctgaggagcacagccccccccggggcatcaatgacagacacttcaggaagaggagccacagcaagagccccaggaggaccaggagccgcagccccctgggcttctacgtgcacctgaagaacctgagcctgagcattgatgagcgggacctgaggaacttcttccggggcacagacctgacagatgagcagatccgcttcctgtacaaggatgaaaatagaaccaggtatgcctttgtgatgttcaagaccctgaaggactacaacacagccctgagcctgcacaagacagtgctgcagtacagacctgtgcacatcgaccccatcagcaggaagcagatgctgaagttcatcgcccgctatgagaagaagaggagcggcagcctggagcgggacaggcctggccacgtgtcccagaagtacagccaggagggcaacagcggccagaagctgtgcatctacatccggaacttcccctttgatgtgaccaaggtggaggtgcagaagttctttgctgacttcctgctggctgaagatgacatctacctgctgtatgatgacaagggcgtgggcctgggggaggccctggtgaagttcaagtctgaggagcaggccatgaaggccgagcggctgaacagaagacgcttcctgggcacagaggtgctgctgcggctcatcagcgaggcccagatccaggagtttggagtgaacttctctgtgatgagcagcgagaagatgcaggcccggagccagagccgggagcggggggaccacagccacctgtttgacagcaaggacccccccatctacagcgtgggcgcctttgagaacttccgccaccagctggaggacctgcggcagctggacaacttcaagcacccccagagggacttccggcagcctgacagacaccccccagaggacttccgccacagcagcgaggacttccgcttccccccagaggacttccgccacagccctgaggacttccggcggccccgggaggaggacttccggcggcccagcgaggaggacttccggcggccctgggaggaggacttccggcggcccccagaagatgacttccgccacccccgggaggaggactggaggcggcccctggaggaggactggaggcggcccctggaggaggacttccgccgcagccccacagaggacttccggcagctgcctgaggaggacttccggcagcccccagaggaggacctgcgctggctgcctgaggaggacttccggcggcccccagaggaggactggaggcggcccccagaggaggacttccggcggcccctgcagggcgagtggaggcggcccccagaagatgacttccggcggcccccagaggaggacttccgccacagccctgaggaggacttccggcagagcccccaggagcacttccggcggcccccccaggagcacttccggcggcccccacctgagcacttccggcggcccccacctgagcacttccggcggcccccacctgagcacttccggcggcccccacctgagcacttccggcggcccccacctgagcacttccggcggcccccacctgagcacttccggcggcccccccaggagcacttccggcggcccccccaggagcacttccgccgcagccgggaggaggacttccgccaccccccagatgaggacttccggggccccccagatgaggacttccgccaccccccagatgaggacttccgcagcccccaggaggaggacttccgctgccccagtgatgaggacttccggcagctgcctgaggaggacctgcgggaggcccctgaggaggacccccggctgcctgacaacttccggcccccaggagaggacttccgcagccccccagatgacttccgcagccaccggccctttgtgaactttggccggcctgagggcggcaagtttgattttgggaagcacaacatgggcagcttccctgagggccgcttcatgccagaccccaagatcaactgtggcagcggccgggtgacccccatcaagatcatgaacctgcccttcaaggccaacgtgaatgagatcctggacttcttccacggctaccgcatcatcccagacagcgtgtccatccagtacaatgagcagggcctgcccaccggggaggccatcgtggccatgatcaactacaatgaggccatggccgccatcaaggacctgaatgacaggcctgtgggccccaggaaggtgaagctgaccctgctgtag

SEQ ID NO: 41955 - DNA, 2646 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagaccatcgagatgaagaggacagacagagtgggccggggccggcccggcagcggcaccagcggcgtggacagcctgagcaacttcatcgagagcgtgaaggaggaggccagcaacagcggctacggcagcagcatcaaccaggatgctggcttccacaccaatggaactggacatggcaacctgcggcccaggaagacccggcccctgaaggccgagaacccctacctgttcctgcggggcctgccctacctggtgaatgaagatgatgtgcgggtcttcttcagcggcctgtgtgtggatggagtcatcttcctgaagcaccatgatggcaggaacaatggagatgccatcgtgaagtttgccagctgtgtggatgccagcggcggcctgaagtgccacaggagcttcatgggcagccgcttcatcgaggtgatgcagggcagcgagcagcagtggattgaatttggaggaaatgctgtgaaggagggagatgtgctgcggcgctctgaggagcacagccccccccggggcatcaatgacagacacttcaggaagaggagccacagcaagagccccaggaggaccaggagccgcagccccctgggcttctacgtgcacctgaagaacctgagcctgagcattgatgagcgggacctgaggaacttcttccggggcacagacctgacagatgagcagatccgcttcctgtacaaggatgaaaatagaaccaggtatgcctttgtgatgttcaagaccctgaaggactacaacacagccctgagcctgcacaagacagtgctgcagtacagacctgtgcacatcgaccccatcagcaggaagcagatgctgaagttcatcgcccgctatgagaagaagaggagcggcagcctggagcgggacaggcctggccacgtgtcccagaagtacagccaggagggcaacagcggccagaagctgtgcatctacatccggaacttcccctttgatgtgaccaaggtggaggtgcagaagttctttgctgacttcctgctggctgaagatgacatctacctgctgtatgatgacaagggcgtgggcctgggggaggccctggtgaagttcaagtctgaggagcaggccatgaaggccgagcggctgaacagaagacgcttcctgggcacagaggtgctgctgcggctcatcagcgaggcccagatccaggagtttggagtgaacttctctgtgatgagcagcgagaagatgcaggcccggagccagagccgggagcggggggaccacagccacctgtttgacagcaaggacccccccatctacagcgtgggcgcctttgagaacttccgccaccagctggaggacctgcggcagctggacaacttcaagcacccccagagggacttccggcagcctgacagacaccccccagaggacttccgccacagcagcgaggacttccgcttccccccagaggacttccgccacagccctgaggacttccggcggccccgggaggaggacttccggcggcccagcgaggaggacttccggcggccctgggaggaggacttccggcggcccccagaagatgacttccgccacccccgggaggaggactggaggcggcccccacctgagcacttccggcggcccccacctgagcacttccggcggcccccacctgagcacttccggcggcccccacctgagcacttccggcggcccccacctgagcacttccggcggcccccccaggagcacttccggcggcccccccaggagcacttccgccgcagccgggaggaggacttccgccaccccccagatgaggacttccggggccccccagatgaggacttccgccaccccccagatgaggacttccgcagcccccaggaggaggacttccgctgccccagtgatgaggacttccggcagctgcctgaggaggacctgcgggaggcccctgaggaggacccccggctgcctgacaacttccggcccccaggagaggacttccgcagccccccagatgacttccgcagccaccggccctttgtgaactttggccggcctgagggcggcaagtttgattttgggaagcacaacatgggcagcttccctgagggccgcttcatgccagaccccaagatcaactgtggcagcggccgggtgacccccatcaagatcatgaacctgcccttcaaggccaacgtgaatgagatcctggacttcttccacggctaccgcatcatcccagacagcgtgtccatccagtacaatgagcagggcctgcccaccggggaggccatcgtggccatgatcaactacaatgaggccatggccgccatcaaggacctgaatgacaggcctgtgggccccaggaaggtgaagctgaccctgctgtag

SEQ ID NO: 41956 - DNA, 432 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagaccatcgagatgaagaggacagacagagtgggccggggccggcccggcagcggcaccagcggcgtggacagcctgagcaacttcatcgagagcgtgaaggaggaggccagcaacagcggctacggcagcagcatcaaccaggatgctggcttccacaccaatggaactggacatggcaacctgaggtag

SEQ ID NO: 41957 - DNA, 450 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagaccatcgagatgaagaggacagacagagtgggccggggccggcccggcagcggcaccagcggcgtggacagcctgagcaacttcatcgagagcgtgaaggaggaggccagcaacagcggctacggcagcagcatcaaccaggatgctggcttccacaccaatggaactggacatggcaacctgcggcccaggaagacccggccctag

SEQ ID NO: 41958 - DNA, 369 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagaccatcgagatgaagaggacagacagagtgggccggggccggcccggcagcggcaccagcggcgtggacagcctgagcaacttcatcgagagcgtgaaggaggaggccagcaacagcggctactag

SEQ ID NO: 41959 - DNA, 249 bp, Artificial Sequence
  Description of Artificial Sequence: Synthetic coding sequence
atggctgtggtgatccggctgctgggcctgcccttcatcgccggccctgtggacatccgccacttcttcaccggcctgaccatcccagatggcggcgtgcacatcatcggcggggagatcggggaggccttcatcatctttgccacagatgaagatgcccggcgggccatcagccgcagcggcggcttcatcaaggacagctctgtggagctgttcctgagcagcaaggccgagatgcagaagacctag

SEQ ID NO: 41960 - DNA, 573 bp, Artificial Sequence
  Description of Artificial Sequence: Synthetic coding sequence
atggaggccgagaccaagaccctgcccctggagaatgccagcatcctgtctgagggcagcctgcaggagggccaccggctgtggattggcaacctggaccccaagatcacagagtaccacctgctgaagctgctgcagaagtttgggaaggtgaagcagtttgacttcctgttccacaagagcggggccctggagggccagccccggggctactgctttgtgaactttgagaccaagcaggaggccgagcaggccatccagtgcctgaatggcaagctggccctgagcaagaagctggtggtgcgctgggcccacgcccaggtgaagagatatgaccacaacaagaatgacaagatcctgcccatcagcctggagcccagcagcagcacagagcccacccagagcaacctgtctgtgacagccaagatcaaggccatcgaggccaagctgaagatgatggctgaaaatccagatgctgagtacccagctgcccctgtgtacagctacttcaagcccccagacaagaagaggaccaccccctacagcaggacagcctggaagagcagaagatag

SEQ ID NO: 41961 - DNA, 2943 bp, Artificial Sequence
  Description of Artificial Sequence: Synthetic coding sequence
atggtgtccaagatgatcatcgagaactttgaggccctgaagtcctggctgagcaagaccctggagcccatctgtgatgctgaccccagcgccctggccaagtatgtgctggccctggtgaagaaggacaagtctgagaaggagctgaaggccctgtgcatcgaccagctggatgtgttcctgcagaaggagacccagatctttgtggagaagctgtttgatgctgtgaacaccaagagctacctgcccccacctgagcagcccagcagcggcagcctgaaggtggagttcttcccccaccaggagaaggacatcaagaaggaggagatcaccaaggaggaggagcgggagaagaagttcagccggcggctgaaccacagccccccccagagcagcagccgctacagagaaaatagaagcagagatgagaggaagaaggatgacaggagcaggaagagggactatgacagaaatcctccaagaagagacagctacagagaccgctacaacagaagaagaggccgcagccgcagctacagccgcagccgcagccgctcctggagcaaggagcggctgcgggagcgggaccgggacaggagcaggaccaggagccgcagcaggaccaggagccgggagcgggacctggtgaagcccaagtatgacctggacagaacagaccccctggagaacaactacacccctgtgtcctctgtgcccagcatcagcagcggccactaccctgtgcccaccctgagcagcaccatcaccgtcatcgcccccacccaccacggcaacaacaccacagagagctggagcgagttccacgaggaccaggtggaccacaacagctatgtgcggccccccatgcccaagaagcgctgccgggactatgatgagaagggcttctgcatgagaggagacatgtgcccctttgaccacggcagtgaccctgtggtggtggaggatgtgaacctgcccggcatgctgcccttccctgcccagccccctgtggtggagggccccccacctcctggcctgcccccacctccacccatcctgaccccacctcctgtgaacctgcggccccctgtgcccccacctggccccctgccccccagcctgccccctgtgacaggccccccaccacccctgccccccctgcagcccagcggcatggatgccccacccaacagcgccaccagctctgtgcccaccgtggtgaccaccggcatccaccaccagcccccaccagccccacccagcctcttcaccgctgacacctatgacacagatggctacaaccctgaggcccccagcatcaccaacaccagccggcccatgtaccgccaccgggtgcacgcccagaggcccaacctgattggcctgaccagcggggacatggacctgcccccccgggagaagccacccaacaagagctccatgagaattgtggtggacagcgagagcaggaagaggaccatcggcagcggggagcccggggtgcccaccaagaagacctggtttgacaagcccaacttcaacagaaccaacagccctggcttccagaagaaggtgcagtttggaaatgaaaacaccaagctggagctgaggaaggtgcccccagagctgaacaacatcagcaagctgaatgagcacttcagccgcttcggcaccctggtgaacctgcaggtggcctacaatggagaccctgagggcgccctgatccagtttgccacctatgaggaggccaagaaggccatcagcagcacagaggccgtgctgaacaaccgcttcatcaaggtgtactggcaccgggagggcagcacccagcagctgcagaccaccagccccaagcccctggtgcagcagcccatcctgcctgtggtgaagcagagcgtgaaggagcggctgggccctgtgcccagcagcaccatcgagcctgctgaggcccagagcgccagcagtgacctgccccaggtgctgagcaccagcacaggcctgaccaagacagtgtacaacccagctgccctgaaggccgcccagaagaccctgctggtgtccaccagcgctgtggacaacaatgaggcccagaagaagaagcaggaggccctgaagctgcagcaggatgtgaggaagaggaagcaggagatcctggagaagcacatcgagacccagaagatgctgatcagcaagctggagaagaacaagaccatgaagtctgaggacaaggccgagatcatgaagaccctggaggtgctgaccaagaacatcaccaagctgaaggatgaggtgaaggccgccagccctggccgctgcctgcccaagagcatcaagaccaagacccagatgcagaaggagctgctggacacagagctggacctgtacaagaagatgcaggccggggaggaggtgacagagctgcggaggaagtacacagagctgcagctggaggccgccaagaggggcatcctgagcagcggccggggccggggcatccacagccggggcagaggagctgtgcacggccggggccggggccggggccggggccggggcgtgcccggccatgctgtggtggaccaccggccccgggccctggagatcagcgccttcacagaaagtgaccgggaggacctgctgccccactttgcccagtacggggagattgaggactgccagattgatgacagcagcctgcatgctgtgatcaccttcaagaccagggctgaggccgaggccgctgctgtgcatggagcccgcttcaagggccaggacctgaagctggcctggaacaagcctgtgaccaacatctctgctgtggagacagaggaggtggagccagatgaggaggagttccaggaggagagcctggtggatgacagcctgctgcaggatgatgatgaggaggaggaggacaatgaaagccgctcctggaggaggtag

SEQ ID NO: 41962 - DNA, 3024 bp, Artificial Sequence
  Description of Artificial Sequence: Synthetic coding sequence
atggtgtccaagatgatcatcgagaactttgaggccctgaagtcctggctgagcaagaccctggagcccatctgtgatgctgaccccagcgccctggccaagtatgtgctggccctggtgaagaaggacaagtctgagaaggagctgaaggccctgtgcatcgaccagctggatgtgttcctgcagaaggagacccagatctttgtggagaagctgtttgatgctgtgaacaccaagagctacctgcccccacctgagcagcccagcagcggcagcctgaaggtggagttcttcccccaccaggagaaggacatcaagaaggaggagatcaccaaggaggaggagcgggagaagaagttcagccggcggctgaaccacagccccccccagagcagcagccgctacagagaaaatagaagcagagatgagaggaagaaggatgacaggagcaggaagagggactatgacagaaatcctccaagaagagacagctacagagaccgctacaacagaagaagaggccgcagccgcagctacagccgcagccgcagccgctcctggagcaaggagcggctgcgggagcgggaccgggacaggagcaggaccaggagccgcagcaggaccaggagccgggagcgggacctggtgaagcccaagtatgacctggacagaacagaccccctggagaacaactacacccctgtgtcctctgtgcccagcatcagcagcggccactaccctgtgcccaccctgagcagcaccatcaccgtcatcgcccccacccaccacggcaacaacaccacagagagctggagcgagttccacgaggaccaggtggaccacaacagctatgtgcggccccccatgcccaagaagcgctgccgggactatgatgagaagggcttctgcatgagaggagacatgtgcccctttgaccacggcagtgaccctgtggtggtggaggatgtgaacctgcccggcatgctgcccttccctgcccagccccctgtggtggagggccccccacctcctggcctgcccccacctccacccatcctgaccccacctcctgtgaacctgcggccccctgtgcccccacctggccccctgccccccagcctgccccctgtgacaggccccccaccacccctgccccccctgcagcccagcggcatggatgccccacccaacagcgccaccagctctgtgcccaccgtggtgaccaccggcatccaccaccagcccccaccagccccacccagcctcttcaccgctgacacctatgacacagatggctacaaccctgaggcccccagcatcaccaacaccagccggcccatgtaccgccaccgggtgcacgcccagaggcccaacctgattggcctgaccagcggggacatggacctgcccccccgggagaagccacccaacaagagctccatgagaattgtggtggacagcgagagcaggaagaggaccatcggcagcggggagcccggggtgcccaccaagaagacctggtttgacaagcccaacttcaacagaaccaacagccctggcttccagaagaaggtgcagtttggaaatgaaaacaccaagctggagctgaggaaggtgcccccagagctgaacaacatcagcaagctgaatgagcacttcagccgcttcggcaccctggtgaacctgcaggtggcctacaatggagaccctgagggcgccctgatccagtttgccacctatgaggaggccaagaaggccatcagcagcacagaggccgtgctgaacaaccgcttcatcaaggtgtactggcaccgggagggcagcacccagcagctgcagaccaccagccccaaggtgatgcagcccctggtgcagcagcccatcctgcctgtggtgaagcagagcgtgaaggagcggctgggccctgtgcccagcagcaccatcgagcctgctgaggcccagagcgccagcagtgacctgccccagaatgtgaccaagctgtctgtgaaggaccggctgggctttgtgtccaagcccagcgtgtctgccacagagaaggtgctgagcaccagcacaggcctgaccaagacagtgtacaacccagctgccctgaaggccgcccagaagaccctgctggtgtccaccagcgctgtggacaacaatgaggcccagaagaagaagcaggaggccctgaagctgcagcaggatgtgaggaagaggaagcaggagatcctggagaagcacatcgagacccagaagatgctgatcagcaagctggagaagaacaagaccatgaagtctgaggacaaggccgagatcatgaagaccctggaggtgctgaccaagaacatcaccaagctgaaggatgaggtgaaggccgccagccctggccgctgcctgcccaagagcatcaagaccaagacccagatgcagaaggagctgctggacacagagctggacctgtacaagaagatgcaggccggggaggaggtgacagagctgcggaggaagtacacagagctgcagctggaggccgccaagaggggcatcctgagcagcggccggggccggggcatccacagccggggccgcggggctgtgcacggccggggccggggccggggccggggccggggcgtgcccggccatgctgtggtggaccaccggccccgggccctggagatcagcgccttcacagaaagtgaccgggaggacctgctgccccactttgcccagtatggagaaattgaggactgccagattgatgacagcagcctgcacgccgtcatcaccttcaagaccagggctgaggccgaggccgctgctgtgcacggggcccgcttcaagggccaggacctgaagctggcctggaacaagcctgtgaccaacatctctgctgtggagacagaggaggtggagccagatgaggaggagttccaggaggagagcctggtggatgacagcctgctgcaggatgatgatgaggaggaggaggacaatgaaagccgctcctggaggaggtag

SEQ ID NO: 41963 - DNA, 2952 bp, Artificial Sequence
  Description of Artificial Sequence: Synthetic coding sequence
atggtgtccaagatgatcatcgagaactttgaggccctgaagtcctggctgagcaagaccctggagcccatctgtgatgctgaccccagcgccctggccaagtatgtgctggccctggtgaagaaggacaagtctgagaaggagctgaaggccctgtgcatcgaccagctggatgtgttcctgcagaaggagacccagatctttgtggagaagctgtttgatgctgtgaacaccaagagctacctgcccccacctgagcagcccagcagcggcagcctgaaggtggagttcttcccccaccaggagaaggacatcaagaaggaggagatcaccaaggaggaggagcgggagaagaagttcagccggcggctgaaccacagccccccccagagcagcagccgctacagagaaaatagaagcagagatgagaggaagaaggatgacaggagcaggaagagggactatgacagaaatcctccaagaagagacagctacagagaccgctacaacagaagaagaggccgcagccgcagctacagccgcagccgcagccgctcctggagcaaggagcggctgcgggagcgggaccgggacaggagcaggaccaggagccgcagcaggaccaggagccgggagcgggacctggtgaagcccaagtatgacctggacagaacagaccccctggagaacaactacacccctgtgtcctctgtgcccagcatcagcagcggccactaccctgtgcccaccctgagcagcaccatcaccgtcatcgcccccacccaccacggcaacaacaccacagagagctggagcgagttccacgaggaccaggtggaccacaacagctatgtgcggccccccatgcccaagaagcgctgccgggactatgatgagaagggcttctgcatgagaggagacatgtgcccctttgaccacggcagtgaccctgtggtggtggaggatgtgaacctgcccggcatgctgcccttccctgcccagccccctgtggtggagggccccccacctcctggcctgcccccacctccacccatcctgaccccacctcctgtgaacctgcggccccctgtgcccccacctggccccctgccccccagcctgccccctgtgacaggccccccaccacccctgccccccctgcagcccagcggcatggatgccccacccaacagcgccaccagctctgtgcccaccgtggtgaccaccggcatccaccaccagcccccaccagccccacccagcctcttcaccgctgacacctatgacacagatggctacaaccctgaggcccccagcatcaccaacaccagccggcccatgtaccgccaccgggtgcacgcccagaggcccaacctgattggcctgaccagcggggacatggacctgcccccccgggagaagccacccaacaagagctccatgagaattgtggtggacagcgagagcaggaagaggaccatcggcagcggggagcccggggtgcccaccaagaagacctggtttgacaagcccaacttcaacagaaccaacagccctggcttccagaagaaggtgcagtttggaaatgaaaacaccaagctggagctgaggaaggtgcccccagagctgaacaacatcagcaagctgaatgagcacttcagccgcttcggcaccctggtgaacctgcaggtggcctacaatggagaccctgagggcgccctgatccagtttgccacctatgaggaggccaagaaggccatcagcagcacagaggccgtgctgaacaaccgcttcatcaaggtgtactggcaccgggagggcagcacccagcagctgcagaccaccagccccaaggtgatgcagcccctggtgcagcagcccatcctgcctgtggtgaagcagagcgtgaaggagcggctgggccctgtgcccagcagcaccatcgagcctgctgaggcccagagcgccagcagtgacctgccccaggtgctgagcaccagcacaggcctgaccaagacagtgtacaacccagctgccctgaaggccgcccagaagaccctgctggtgtccaccagcgctgtggacaacaatgaggcccagaagaagaagcaggaggccctgaagctgcagcaggatgtgaggaagaggaagcaggagatcctggagaagcacatcgagacccagaagatgctgatcagcaagctggagaagaacaagaccatgaagtctgaggacaaggccgagatcatgaagaccctggaggtgctgaccaagaacatcaccaagctgaaggatgaggtgaaggccgccagccctggccgctgcctgcccaagagcatcaagaccaagacccagatgcagaaggagctgctggacacagagctggacctgtacaagaagatgcaggccggggaggaggtgacagagctgcggaggaagtacacagagctgcagctggaggccgccaagaggggcatcctgagcagcggccggggccggggcatccacagccggggccgcggggctgtgcacggccggggccggggccggggccggggccggggcgtgcccggccatgctgtggtggaccaccggccccgggccctggagatcagcgccttcacagaaagtgaccgggaggacctgctgccccactttgcccagtatggagaaattgaggactgccagattgatgacagcagcctgcacgccgtcatcaccttcaagaccagggctgaggccgaggccgctgctgtgcacggggcccgcttcaagggccaggacctgaagctggcctggaacaagcctgtgaccaacatctctgctgtggagacagaggaggtggagccagatgaggaggagttccaggaggagagcctggtggatgacagcctgctgcaggatgatgatgaggaggaggaggacaatgaaagccgctcctggaggaggtag

SEQ ID NO: 41964 - DNA, 807 bp, Artificial Sequence
  Description of Artificial Sequence: Synthetic coding sequence
atggctgctgccctgggcgccagcggcggggccggggctggagatgatgactttgaccagtttgacaagccaggagctgagaggtcctggaggcggcgggctgctgatgaggactgggacagcgagctggaggatgacctgctgggggaggacctgctgagcggcaagaagaaccagagcgacctgagtgatgaggagctgaatgatgacctgctgcagagcgacaatgaagatgaggagaacttcagcagccagggcgtgaccatcagcctgaatgccaccagcggcatggtgaccagctttgagctgagtgacaacaccaatgaccagagcggggagcaggagagtgaatatgagcaggagcagggagaagatgagctggtgtaccacaagagtgatggcagcgagctgtacacccaggagtacccagaggagggccagtatgagggccatgaagctgagctgacagaggaccagatcgagtatgtggaggagcctgaggaggagcagctgtacacagatgaggtgctggacatcgagatcaatgagcccctggatgagttcaccggcggcatggagaccctggagctgcagaaggacatcaaggaggagagtgatgaggaggaggaggatgatgaggagagcggccgcctgcgcttcaagacagagaggaaggagggcaccatcatccggctgagtgatgtgacccgggagaggaggaacatccctgagaccctgggcaacttctttgcctgcctgcccagcagcttcaccctcatcagcaccagcagcatcgtgctgctgtag

SEQ ID NO: 41965 - DNA, 321 bp, Artificial Sequence
  Description of Artificial Sequence: Synthetic coding sequence
atgcacggccggggccggggcgtggccggccccatgggccggggccgcctgatgcccaacaagcagaacctgcgggtggtggagtgcaagccccagccctgtgtggtgtctgtggagggcctgagcagcagcaccacagatgcccagctgaagagcctgctgatgtctgtgggccccatccagagcctgcagatgctgccccagcagaggaaggccatcgccaagttcaaggagcccgcccacgccctggccttccagcagaagttccaccgccacatgattgacctgagccacatcaacgtggccctgattgtggagtag

SEQ ID NO: 41966 - DNA, 3513 bp, Artificial Sequence
  Description of Artificial Sequence: Synthetic coding sequence
atggctgctgccctgggcgccagcggcggggccggggctggagatgatgactttgaccagtttgacaagccaggagctgagaggtcctggaggcggcgggctgctgatgaggactgggacagcgagctggaggatgacctgctgggggaggacctgctgagcggcaagaagaaccagagcgacctgagtgatgaggagctgaatgatgacctgctgcagagcgacaatgaagatgaggagaacttcagcagccagggcgtgaccatcagcctgaatgccaccagcggcatggtgaccagctttgagctgagtgacaacaccaatgaccagagcggggagcaggagagtgaatatgagcaggagcagggagaagatgagctggtgtaccacaagagtgatggcagcgagctgtacacccaggagtacccagaggagggccagtatgagggccatgaagctgagctgacagaggaccagatcgagtatgtggaggagcctgaggaggagcagctgtacacagatgaggtgctggacatcgagatcaatgagcccctggatgagttcaccggcggcatggagaccctggagctgcagaaggacatcaaggaggagagtgatgaggaggaggaggatgatgaggagagcggccgcctgcgcttcaagacagagaggaaggagggcaccatcatccggctgagtgatgtgacccgggagaggaggaacatccctgagaccctggagctgtctgctgaggccaaggccgccctgctggagtttgaggagcgggagcggcagcacaagcagggccgctacagcagccggcggggcggccggcggggcggccccctgatgtgccggggcgtgggggaccagaggcgggagagcacagagcggggccgcatgaaggaccacaggcctgccctgctgcccacccagccccctgtggtgccccaggcccctcctcctcctcctcctccaccccagcagcagcccatccgcagcctcttccagccccagcccctgcagcccctgctgcctgtgcagcacccccaccaccccagccccccccagggcatgcacatgccaccccagctggagacccccaggatgatgatgaccccacctcctgtgaccccccagcagcccaagaacatccacatcaacccccacttcaagggcaccgtggtgacccctgtgcaggtgcccctgctgcctgtgcccagccagcccaggcctgctgtgggcccccagcgcttccctggccccccagagttcccccagcacaccccaggccctgtgcccaacagcttcagccagcccccccggctgcccctgcaggaccagtggagggcccctcctccaccccaggaccgggaccccttcttcctgggcgtgtctggagagccccgcttccccagccacctgttcctggagcagaggagccccccacctcctcctcctccacccaccctgctgaacagcagccaccctgtgcccacccagagccccctgcccttcacccagcccggccctgccttcaaccagcagggccagcagcccgtcttcccccgggagaggcctgtgcggcctgccctgcagcccccaggccctgtgggcatcctgcacttcagccagcccggcagcgccaccacccggcccttcatccccccccggcagcccttcctgcccggccctggccagcccttcctgcccacccacacccagcccaacctgcagggccccctgcacccccccctgcccccaccccaccagccccagccccagcagccccagcagcagcccccaccccagcaccagcccccccaccagcccccccaccagcccccaccccagcaccagcccccaccccagcaccccccccagcaccccccccagcaccagcaccaccaccaccaccaccacctgtctgtgcccccaccacccctgatgcccatgagccagccccagttccggccccacgtgcagacagcccagccccaggccagcagcagcaggatgcagtgcccccagaggcagggcctgcggcacaacaccaccagccagaatgtgtccaagaggcccatgcagcagatgcagcccacagcccccaggaacagcaacctgcgggagctgcccatcgcccccagccacgtgattgagatgagcagcagccgctgcagcgccaccccatctgcccaggtgaagcccatcgtgtctgccagcccccccagcagagctgtggccggcagccgcagcagccagggcaagacagaggtgaaggtgaagccagccagccctgtggcccagcccaaggaggaggccaagacagaaacagagttcccagatgaagatgaggagacccggctgtaccgcctgaagattgaggagcagaagaggctgcgggaggagatcctgaagcagaaggagctgcggcggcagcagcaggccggggccaggaagaaggagctgctggagcggctggcccagcagcagcagcagctgtatgcccctcctcctcctgctgagcaggaggagcaggccctgagccccagccccaccaacggcaaccccctgctgcccttccctggggcccaggtgcggcagaatgtgaagaaccggctgctggtgaagaaccaggatgtgtccatcagcaatgtgcagcccaagaccagcaactttgtgcccagcagcgccaacatgcagtaccagggccagcagatgaaggccctgaagcacctgcggcagaccaggacagtgccccagagccagacccagcccctgcacaaggtgctgcccatcaagccagcagatgtggaggagcctgctgtgccccagaccccccgggtggccagcatccagggccggccccaggacaccaagccaggagtgaagaggacagtgacccacaggaccaacagcggcggcggagatggcccccacatcagcagcaaggtgcgggtcatcaagctgagcggcggcggcggggagagtgatggcttcttccaccctgagggccagccccagaggctgccccagcccccagaggtgggcccccagcctgccaggaaggtgaccctgacccggggcggcctgcagcagcccccccacctgcctgctggcccccacgcccacagccctgtgcccccaggcatcaagagcatccagggcatccacccagccaagaaggccatcatgcacggccggggccggggcgtggccggccccatgggccggggccgcctgatgcccaacaagcagaacctgcgggtggtggagtgcaagccccagccctgtgtggtgtctgtggagggcctgagcagcagcaccacagatgcccagctgaagagcctgctgatgtctgtgggccccatccagagcctgcagatgctgccccagcagaggaaggccatcgccaagttcaaggagcccgcccacgccctggccttccagcagaagttccaccgccacatgattgacctgagccacatcaacgtggccctgattgtggagtag

SEQ ID NO: 41967 - DNA, 87 bp, Artificial Sequence
  Description of Artificial Sequence: Synthetic coding sequence
atgcacggccggggccggggcgtggccggccccatgggccggggccgcctgatgcccaacaagcagaacctgcgggtggtggagtag

SEQ ID NO: 41968 - DNA, 1278 bp, Artificial Sequence
  Description of Artificial Sequence: Synthetic coding sequence
atgagcaagaggaagaggaagaggtctgtgcaggagggggagaacccagatgatggagtgcggggcagccccccagaggactaccgcctgggccaggtggccagcagcctcttccggggggagcaccacagccggggcggcaccggccgcctggccagcctcttcagcagcctggagccccagatccagcctgtgtatgtgcctgtgcccaagcagaccatcaagaagaccaagagaaatgaggaggaggagagcaccagccagatcgagcggcccctgagccaggagcccgccaagaaggtgaaggccaagaagaagcacaccaatgctgagaagaagctggccgaccgggagagcgccctggccagcgctgacctggaggaggagatccaccagaagcagggccagaagaggaagaacagccagcccggggtgaaggtggccgacaggaagatcctggatgacacagaagatactgtggtgtcccagaggaagaagatccagatcaaccaggaggaggagcggctgaagaatgaaagaacagtgtttgtgggcaacctgcctgtgacctgcaacaagaagaagctgaagagcttcttcaaggagtatggccagatcgagagcgtgcgcttccgcagcctcatcccagctgagggcaccctgagcaagaagctggccgccatcaagaggaagatccacccagaccagaagaacatcaatgcctacgtggtgttcaaggaggagagcgctgccacccaggccctgaagagaaatggagcccagattgctgatggcttccgcatccgggtggacctggccagcgagaccagcagccgggacaagaggtctgtgtttgtgggcaacctgccctacaaggtggaggagagcgccatcgagaagcacttcctggactgtggcagcatcatggctgtgagaattgtgcgggacaagatgactggaattggaaaaggatttggctacgtgctgtttgaaaatacagattctgtgcacctggccctgaagctgaacaacagcgagctgatgggcaggaagctgcgggtgatgaggtctgtgaacaaggagaagttcaagcagcagaacagcaacccccggctgaagaatgtgtccaagcccaagcagggcctgaacttcaccagcaagacagctgagggccaccccaagagcctcttcatcggggagaaggctgtgctgctgaagaccaagaagaagggccagaagaagagcggccggcccaagaagcagaggaagcagaagtag

SEQ ID NO: 41969 - DNA, 936 bp, Artificial Sequence
  Description of Artificial Sequence: Synthetic coding sequence
atgaagagggtgaacagctgtgtgaagagtgatgaacatgtgctggaggagctggagacagaaggagagcggcagctgaagagcctgctgcagcaccagctggacacctctgtgtccattgaggagtgcatgagcaagaaggagagctttgcccctggcaccatgtacaagccctttgggaaggaggccgccggcaccatgaccctgagccagttccagaccctgcacgagaaggaccaggagacagccagcctgcgggagctgggcctgaatgaaacagagatcctgatctggaagagccacgtgtctggagagaagaagaccaagctgcgggccaccccagaggccatccagaaccggctgcaggacatcgaggagcgcatcagcgagcggcagaggatcctgtgcctgccccagagatttgccaagagcaagcagctgacccggcgggagatggagattgagaagagcctcttccagggcgctgacagacacagcttcctgaaggccctgtactaccaggcctaccacaagaagaccagcgctgacaagtacatgacctccatgaagaggaagatcaagctgggcaccaaggatgagccccagaagaagaacaagggggaccccatgaacaacctggagagcttctaccaggagatgatcatgaagaagaggctggaggagttccagctgatgaggggcctgaccagcttcccccgggaggacttccagaacctgtcctatgagggcaccacctctgtgctgggcgccaagtggcagaagaggactggaagaaccagcaccttcagcatcctgctggtgtccctgctgtctgagaccgtcttcaccagcagcgccatgtatggcatcccccacctgctgaccatgagcctgaagttcagcacccgcatcggcaagctgtccttcaccccctag

SEQ ID NO: 41970 - DNA, 1242 bp, Artificial Sequence
  Description of Artificial Sequence: Synthetic coding sequence
atgaagagggtgaacagctgtgtgaagagtgatgaacatgtgctggaggagctggagacagaaggagagcggcagctgaagagcctgctgcagcaccagctggacacctctgtgtccattgaggagtgcatgagcaagaaggagagctttgcccctggcaccatgtacaagccctttgggaaggaggccgccggcaccatgaccctgagccagttccagaccctgcacgagaaggaccaggagacagccagcctgcgggagctgggcctgaatgaaacagagatcctgatctggaagagccacgtgtctggagagaagaagaccaagctgcgggccaccccagaggccatccagaaccggctgcaggacatcgaggagcgcatcagcgagcggcagaggatcctgtgcctgccccagagatttgccaagagcaagcagctgacccggcgggagatggagattgagaagagcctcttccagggcgctgacagacacagcttcctgaaggccctgtactaccaggatgagccccagaagaagaacaagggggaccccatgaacaacctggagagcttctaccaggagatgatcatgaagaagaggctggaggagttccagctgatgagaggagagccctttgccagccacagcctggtgtctgccacctctgtgggggacagcggcacagctgagagccccagcctgctgcaggacaagggcaagcaggccgcccagggcaagggccccagcctgcacgtggccaacgtgattgacttcagccctgagcagtgctggacaggccccaagaagctgacccagcccattgaatttgtgcctgaagatgagatccagaggaaccggctgtctgaggaggagatcaggaagatccccatgttcagcagctacaaccctggagagcccaacaaggtgctgtacctgaagaacctgagcccccgggtgacagagcgggacctggtgtccctgtttgcccgcttccaggagaagaagggcccccccatccagttcaggatgatgacaggccgcatgaggggccaggccttcatcaccttccccaacaaggagatcgcctggcaggccctgcacctggtgaatggctacaagctgcacggcaagatcctggtgattgaatttgggaagaacaagaagcagaggagcaacctgcaggccaccagcctcatcagctgtgccaccggcagcaccacagagatcagcggcagctag

SEQ ID NO: 41971 - DNA, 618 bp, Artificial Sequence
  Description of Artificial Sequence: Synthetic coding sequence
atgaagagggtgaacagctgtgtgaagagtgatgaacatgtgctggaggagctggagacagaaggagagcggcagctgaagagcctgctgcagcaccagctggacacctctgtgtccattgaggagtgcatgagcaagaaggagagctttgcccctggcaccatgtacaagccctttgggaaggaggccgccggcaccatgaccctgagccagttccagaccctgcacgagaaggaccaggagacagccagcctgcgggagctgggcctgaatgaaacagagatcctgatctggaagagccacgtgtctggagagaagaagaccaagctgcgggccaccccagaggccatccagaaccggctgcaggacatcgaggagcgcatcagcgagcggcagaggatcctgtgcctgccccagagatttgccaagagcaagcagctgacccggcgggagatggagattgagaagagcctcttccagggcgctgacagacacagcttcctgaaggccctgtactaccaggcctaccacaagaagaccagcgctgacaagtacatgacctccatgaagaggaagatcaagctgggcaccaagggcatcatccccaaccccccatag

SEQ ID NO: 41972 - DNA, 1218 bp, Artificial Sequence
  Description of Artificial Sequence: Synthetic coding sequence
atgaagagggtgaacagctgtgtgaagagtgatgaacatgtgctggaggagctggagacagaaggagagcggcagctgaagagcctgctgcagcaccagctggacacctctgtgtccattgaggagtgcatgagcaagaaggagagctttgcccctggcaccatgtacaagccctttgggaaggaggccgccggcaccatgaccctgagccagttccagaccctgcacgagaaggaccaggagacagccagcctgcgggagctgggcctgaatgaaacagagatcctgatctggaagagccacgtgtctggagagaagaagaccaagctgcgggccaccccagaggccatccagaaccggctgcaggacatcgaggagcgcatcagcgagcggcagaggatcctgtgcctgccccagagatttgccaagagcaagcagctgacccggcgggagatggagattgagaagagcctcttccagggcgctgacagacacagcttcctgaaggccctgtactaccaggatgagccccagaagaagaacaagggggaccccatgaacaacctggagagcttctaccaggagatgatcatgaagaagaggctggaggagttccagctgatgagaggagagccctttgccagccacagcctggtgtctgccacctctgtgggggacagcggcacagctgagagccccagcctgctgcaggacaagggcaagcaggccgcccagggcaagggccccagcctgcacgtggccaacgtgattgacttcagccctgagcagtgctggacaggccccaagaagctgacccagcccattgaatttgtgcctgaagatgagatccagaggaaccggctgtctgaggaggagatcaggaagatccccatgttcagcagctacaaccctggagagcccaacaaggtgctgtacctgaagaacctgagcccccgggtgacagagcgggacctggtgtccctgtttgcccgcttccaggagaagaagggcccccccatccagttcaggatgatgacaggccgcatgaggggccaggccttcatcaccttccccaacaaggagatcgcctggcaggccctgcacctggtgaatggctacaagctgcacggcaagatcctggtgattgaatttgggaagaacaagaagcagaggagcaacctgcaggccaccagcctcatcagctgtgccaccggctag

SEQ ID NO: 41973 - DNA, 612 bp, Artificial Sequence
  Description of Artificial Sequence: Synthetic coding sequence
tgagtgaacagctgtgtgaagagtgatgaacatgtgctggaggagctggagacagaaggagagcggcagctgaagagcctgctgcagcaccagctggacacctctgtgtccattgaggagtgcatgagcaagaaggagagctttgcccctggcaccatgtacaagccctttgggaaggaggccgccggcaccatgaccctgagccagttccagaccctgcacgagaaggaccaggagacagccagcctgcgggagctgggcctgaatgaaacagagatcctgatctggaagagccacgtgtctggagagaagaagaccaagctgcgggccaccccagaggccatccagaaccggctgcaggacatcgaggagcgcatcagcgagcggcagaggatcctgtgcctgccccagagatttgccaagagcaagcagctgacccggcgggagatggagattgagaagagcctcttccagggcgctgacagacacagcttcctgaaggccctgtactaccaggcctaccacaagaagaccagcgctgacaagtacatgacctccatgaagaggaagatcaagctgggcaccaagggcatcatccctgaggagccctag

SEQ ID NO: 41974 - DNA, 3159 bp, Artificial Sequence
  Description of Artificial Sequence: Synthetic coding sequence
atgatgcaggccacagctgtggtggagacagccagcggcaagggctaccacagcaatggaggcaacctgcagaaggacaagcccagcaaccccaagaaggagaacctgctgctgagcagcaatggctgtgatgaggtgaagctgaccttcccagatgatgactggaacagcagcaccctggagcagagggccaacaacaaggagatcagcaacatcgacaagatggacctgctggagcccttcttctctgtgtcccaggacaccaacacagagagcacccagttccagagcagcgagctggaggacagcacagattatgccttcctgaacaagacctacagcatcccctacagcgagagcaagctgaagaaggagagcctgacccccctgagcagcgagctggaccctgaggtgcagaagaaggaggaggtgttcttcaacatcctggagcaccaggacaagacagtgggcctggagcgcatctacaacatcagtgatgccaactaccgggagagcgctgaggacacccagaagcatgacacagatgaggacagccagcaggagtaccacagcgctgaggagcaggagtacatcagcaaccacctgagctttgaccagaccaaggccctggacatcagcaaccctgaggtggtggagctgggcaacagcggctatgaggtgaagtgtgccagcaatgtggaggacaacagagtgaacagcggcagcggcagcatcatcagctttgacagcctggatgtgtatggccaggaggagagcctgcacgtgtccaagttccagaacagcgtgatgctgcgggagtaccatgacctgaagcatgagaagtacaaggagcaggagaccaacagcatgtaccacacagtgtttgatggctctgtgctgcggagcaacagccctggcaaccaggagagccagagcaagagcggcagcctgagcccccagaaggtgctgaagatgaagatctacacagagaacatgaagagccagatcaatgaaggcaaggacttctgtggcaacaagatcgtggagaacaagatcctgctgcacctggagaaccccagcaccctgccccaggacaaggccctggagaccctgctgcagccctgcaaggactgccagacctcctggacctctgtgtttgatgacagcatcatcagcgcctgtggctactatgagagcctgcagaacacagctgacagcgccctggacttcagcgccatgctgcccaagattgctgtgcgggacaaccaggccatcgaggacaacaccagcctgaaggtggcccacagcagcaccaccaagaagacctgcttccacaacattggagagatgtgcaccaagagcctgacagatgctgccagctgcaccgtgaccatcaaccagacagtggatgtgtccacagacttccgggcctgcttcaccaccagccgggccaccagcgcccggcccagcgtggtgtccaccagcagcaacacagagatcaccatgatgaacaagaagaggccagatgagtggcagaatgagaagcagaagtctgtggcctgcagcacagactggagctacagcgaggactgcatcgacacccagatggccatcaccaagggcagcggcaagagcctgtctgtggacagcctgaagcccaacggcaacttcctgaacaaggacttcctggagctgaggaaggcctgtggcatcacagacctgaagaagcaccctgagcgggagttccagctgttcaaggacacagagaaggacctgcccagcatgtgctgccagaagatcatgcagagggccatcaaggccgagctgcacctgctgaatgtgcactaccagatgtgccgccgccactgctgtgacatctacaagctggtgatggagaaccgggagggcctgaacatgaacctgagcagcaacagcgccaagaaggagctgggcagcgccctgctgagcctgctgggggacctgaaggtgcgctacgtgaccctgaaggagaagatccacaagggcatccccctggaggagctgccccccctgagcctggagagcaagctgctgagcaccttcagcacctttgccagccggctgatgaagaaggagacccacgtgttcagcgaggctgatgctgagcaggacaaccagagggcccatgatgtggatgtgagcagcaacctgaagaagaccctgagccagatgagcctgagcagtgacaacagccacgccacccagaacatcagccccaagaaggatgacttcaagaatggagacatcaatgctgacttcagccagctgaagctgggggacaaggactgccgccactaccaggagaccagcgaggactggagcgatgccaaggagagcctgactggagtggatgtgtctggcacccagggcaaccaggtggagcaggacacctggaacctggacctgaccggggagatgaagaatgtggagcccagccagagggacaagggctacctgatccacgtgggcggcctgtgccccagcgtgtctgaggccgacctgcggagccacttccagaagtaccaggtgtctgagatcagcatctatgacagcaccaactaccgctatgccagcctggccttcaccaagaacagtgatgccaagattgctgtgaaggagatgaatggcatcgagatcaatggcaagtctgtgaatgtgtggcctgtgaagatcctgggggagtacaccagccccctgagcagcaagaatggaaaccgcatcagcagcaacaacctggagaagagcaccaacaagcagatccacagcgagttcagcatcagccggctgcccaggacccggccccggcagctgggcagcgagcaggacagcgaggtgttccccagcgaccagggcgtgaagaagaactgcaagcagatcgagagcgccaagctgctgcctgacacccctgtgcagttcatcccccccaacaccctgaacctgcgctccttcaccaagatcatcaagaggctggccgagctgcaccctgaggtgtcccgggaccacatcatcaatgccctgcaggaggtgcgcatccgccacaagggcttcctgaatggcctgagcatcaccaccatcgtggagatgaccagcagcctgctgaagaacagcgccagcagctag

SEQ ID NO: 41975 - DNA, 3159 bp, Artificial Sequence; identical to SEQ ID NO: 41974
  Description of Artificial Sequence: Synthetic coding sequence

SEQ ID NO: 41976 - DNA, 1602 bp, Artificial Sequence
  Description of Artificial Sequence: Synthetic coding sequence
atgaatgaggagaacattgatggcaccaacggctgcagcaaggtgaggacaggcatccagaatgaagctgccctgctggccctgatggagaagacaggctacaacatggtgcaggagaatggccagaggaagtttggaggccccccacctggctgggagggccccccaccaccccggggctgtgaggtgtttgtgggcaagatcccccgggacatgtatgaagatgagctggtgcctgtgtttgagcgggccggcaagatctatgagttccggctgatgatggagttctctggagaaaatagaggctacgcctttgtgatgtacaccaccaaggaggaggcccagctggccatccgcatcctgaacaactatgagatccggcctgggaagttcatcggcgtgtgtgtgtccctggacaactgccgcctcttcatcggggccatccccaaggagaagaagaaggaggagatcctggatgagatgaagaaggtgacagaaggagtggtggatgtgattgtgtaccccagcgccacagacaagaccaagaacagaggatttgcctttgtggagtatgagagccacagagctgctgccatggcccggaggaagctgatccctggcaccttccagctgtggggccacaccatccaggtggactgggccgaccctgagaaggaggtggatgaggagaccatgcagagggtgaaggtgctgtatgtgaggaacctgatgatcagcaccacagaggagaccatcaaggccgagttcaacaagttcaagccaggagctgtggagcgggtgaagaagctgcgggactatgcctttgtgcacttcttcaaccgggaggatgctgtggccgccatgtctgtgatgaatggcaagtgcattgatggagccagcattgaggtgaccctggccaagcctgtgaacaaggagaacacctggaggcagcacctgaatggccagatcagccccaacagcgagaacctgattgtgtttgccaacaaggaggagagccaccccaagaccctgggcaagctgcccaccctgcctgcccggctgaatggccagcacagccccagccccccagaggtggagcgctgcacctaccccttctacccaggcaccaagctgacccccatctccatgtacagcctgaagagcaaccacttcaacagcgctgtgatgcacctggactactactgcaacaagaacaactgggcccctcctgagtactacctgtacagcaccaccagccaggacggcaaggtgctgctggtgtacaagatcgtcatcccagccatcgccaacggcagccagagctacttcatgccagacaagctgtgcaccaccctggaggatgccaaggagctggccgcccagttcaccctgctgcacctggactacaacttccacaggagcagcatcaacagcctgagccctgtgtctgccaccctgagcagcggcacccccagcgtgctgccctacaccagccggccctacagctacccaggctaccccctgagccccaccatcagcctggccaacggcagccacgtgggccagaggctgtgcatcagcaaccaggccagcttcttctag

SEQ ID NO: 41977 - DNA, 1104 bp, Artificial Sequence
  Description of Artificial Sequence: Synthetic coding sequence
atggccagcagcggcggggagctgggcagcctgtttgaccaccacgtgcagagagctgtgtgtgacacccgggccaagtaccgggagggcagaagacccagggctgtgaaggtgtacaccatcaacctggagagccagtacctgctgatccagggcgtgcctgctgtgggcgtgatgaaggagctggtggagagatttgccctgtatggagccatcgagcagtacaatgccctggatgagtacccagctgaggacttcacagaggtgtacctgatcaagttcatgaacctgcagagcgccaggacagccaagaggaagatggatgagcagagcttctttggaggcctgctgcacgtgtgctacgcccctgagtttgaaacagtggaggagaccaggaagaagctgcagatgaggaaggcctacgtggtgaagaccacagagaacaaggaccactacgtgaccaagaagaagctggtgacagagcacaaggacacagaggacttccggcaggacttccacagcgagatgagcggcttctgcaaggccgccctgaacaccagcgctggcaacagcaacccctacctgccctacagctgtgagctgcccctgtgctacttcagcagcaagtgcatgtgcagcagcggcggccctgtggaccgggccccagacagcagcaaggatggaagaaaccaccacaagaccatgggccactacaaccacaatgacagcctgaggaagacccagatcaacagcctgaagaacagcgtggcctgccctggggcccagaaggccatcaccagcagcgaggccgtggaccgcttcatgcccaggaccacccagctgcaggagaggaagagaagaagagaagatgacaggaagctgggcaccttcctgcagaccaaccccactggaaatgagatcatgattggccccctgctgcctgacatcagcaaggtggacatgcatgatgacagcctgaacaccacagccaacctgatccgccacaagctgaaggaggtgatcagctctgtgcccaagcccccagaggacaagccagaagatgtgcacaccagccaccccctgaagcagaggcggcgcatctag

SEQ ID NO: 41978 - DNA, 1083 bp, Artificial Sequence
  Description of Artificial Sequence: Synthetic coding sequence
atggccagcagcggcggggagctgggcagcctgtttgaccaccacgtgcagagagctgtgtgtgacacccgggccaagtaccgggagggcagaagacccagggctgtgaaggtgtacaccatcaacctggagagccagtacctgctgatccagggcgtgcctgctgtgggcgtgatgaaggagctggtggagagatttgccctgtatggagccatcgagcagtacaatgccctggatgagtacccagctgaggacttcacagaggtgtacctgatcaagttcatgaacctgcagagcgccaggacagccaagaggaagatggatgagcagagcttctttggaggcctgctgcacgtgtgctacgcccctgagtttgaaacagtggaggagaccaggaagaagctgcagatgaggaaggcctacgtggtgaagaccacagagaacaaggaccactacgtgaccaagaagaagctggtgacagagcacaaggacacagaggacttccggcaggacttccacagcgagatgagcggcttctgcaaggccgccctgaacaccagcgctggcaacagcaacccctacctgccctacagctgtgagctgcccctgtgctacttcagcagcaagtgcatgtgcagcagcggcggccctgtggaccgggccccagacagcagcaaggatggaagaaaccaccacaagaccatgggccactacaaccacaatgacagcctgaggaagacccagatcaacagcctgaagaacagcgtggcctgccctggggcccagaaggccatcaccagcagcgaggccgtggaccgcttcatgcccaggaccacccagctgcaggagaggaagagaagaagagaagatgacaggaagctgggcaccttcctgcagaccaaccccactggaaatgagatcatgattggccccctgctgcctgacatcagcaaggtggacatgcatgatgacagcctgaacaccacagccaacctgatccgccacaagctgaaggaggtgttccacctgtgccagagcctgcagaggaccagccagaagatgtacatccaggtgatccactag

SEQ ID NO: 41979 - DNA, 381 bp, Artificial Sequence
  Description of Artificial Sequence: Synthetic coding sequence
gggaagatggccagcagcggcggggagctgggcagcctgtttgaccaccacgtgcagagagctgtgtgtgacacccgggccaagtaccgggagggcagaagacccagggctgtgaaggtgtacaccatcaacctggagagccagtacctgctgatccagggcgtgcctgctgtgggcgtgatgaaggagctggtggagagatttgccctgtatggagccatcgagcagtacaatgccctggatgagtacccagctgaggacttcacagaggtgtacctgatcaagttcatgaacctgcagagcgccaggacagccaagaggaagatggatgagcagagcttcttctggatcgccagctgtgtgctgtgcagccgcatctag

SEQ ID NO: 41980 - DNA, 969 bp, Artificial Sequence
  Description of Artificial Sequence: Synthetic coding sequence
atgaaccccctgaccaaggtgaagctgatcaatgagctgaatgaaagagaggtgcagctgggcgtggccgacaaggtgtcctggcacagcgagtacaaggacagcgcctggatcttcctgggcggcctgccctatgagctgacagaaggagacatcatctgtgtgttcagccagtatggagagatcgtgaacatcaacctggtgcgggacaagaagacaggcaagagcaagggcttctgcttcctgtgctatgaggaccagaggagcaccatcctggccgtggacaacttcaacggcatcaagatcaagggccgcaccatccgggtggaccacgtgagcaactaccgggcccccaaggacagcgaggagattgatgatgtgacccggcagctgcaggagaagggctgtggggcccggacccccagccccagcctgtctgagagcagtgaagatgagaagcccaccaagaagcacaagaaggacaagaaggagaagaagaagaagaagaaggagaaggagaaggctgaccgggaggtgcaggccgagcagcccagcagcagcagccccaggaggaagacagtgaaggagaaggatgacaccggccccaagaagcacagcagcaagaacagcgagcgggcccagaagtctgagccccgggagggccagaagctgcccaagagcaggacagcctacagcggcggcgctgaggacctggagcgggagctgaagaaggagaagcccaagcatgagcacaagagcagcagccggcgggaggcccgggaggagaagacccgcatccgggaccggggccgcagcagtgatgcccacagctcctggtacaacggccgctctgagggccgcagctaccgcagccgcagccgcagccgggacaagagccaccgccacaagagggcccggcgcagccgggagcgggagagcagcaaccccagcgaccgctggaggcactag

SEQ ID NO: 41981 - DNA, 177 bp, Artificial Sequence
  Description of Artificial Sequence: Synthetic coding sequence
atgaaccccctgaccaaggtgaagctgatcaatgagctgaatgaaagagaggtgcagctgggcgtggccgacaaggtgtcctggcacagcgagtacaaggacagcgcctggatcttcctgggcggcctgccctatgagctgacagaaggagacatcatctgtgtgttcagccagtag

SEQ ID NO: 41982 - DNA, 828 bp, Artificial Sequence
  Description of Artificial Sequence: Synthetic coding sequence
atgaaccccctgaccaaggtgaagctgatcaatgagctgaatgaaagagaggtgcagctgggcgtggccgacaaggtgtcctggcacagcgagtacaaggacagcgcctggatcttcctgggcggcctgccctatgagctgacagaaggagacatcatctgtgtgttcagccagtatggagagatcgtgaacatcaacctggtgcgggacaagaagacaggcaagagcaagggcttctgcttcctgtgctatgaggaccagaggagcaccatcctggccgtggacaacttcaacggcatcaagatcaagggccgcaccatccgggtggaccacgtgagcaactaccgggcccccaaggacagcgaggagattgatgatgtgacccggcagctgcaggagaagggctgtggggcccggacccccagccccagcctgtctgagagcagtgaagatgagaagcccaccaagaagcacaagaaggacaagaaggagaagaagaagaagaagaaggagaaggagaaggctgaccgggaggtgcaggccgagcagcccagcagcagcagccccaggaggaagacagtgaaggagaaggatgacaccggccccaagaagcacagcagcaagaacagcgagcgggcccagaagtctgagccccgggagggccagaagctgcccaagagcaggacagcctacagcggcggcgctgaggacctggagcgggagctgaagaaggagaagcccaagcatgagcacaagagcagcagccggcgggaggcccgggaggagaagacccgcatccgggaccggggcctgcgctgcaccttctag

SEQ ID NO: 41983 - DNA, 3204 bp, Artificial Sequence
  Description of Artificial Sequence: Synthetic coding sequence
atgatggaggccgacaggcctgagaagctgttcatcggcggcctgaacctgaagacagatgagaaggccctgaaggccgagtttgggaagtatggccacatcatcaaggtgttcctgatgaaggacaggaagaccaacaagagccggggctttgcctttgtgacctttgagagccctgcagatgccaaggctgctgcccgggacatgaatggcaagtacctggatggcaaggccatcatggtggcccagaccatcaagccagccttcaagagcagccgctgggtgccccccaccccaggcagcggcagccgcagccgcttcagccacaggacccggggcggcggcagcagcccccagaggcctcccagccagggccgcccagatgatggccggggctacgccggctactttgacctgtggccctaccgggcccccatgcccaggaagaggggccccccacccaggcactgggccagccccccccacaagagggccacccccagcagcctggcccacagcgtgggctgcggcatgaggggcaaggcccccaccgtgtctggccaggacggctacagcggcctgcagccccggcgctgggccggccccccccacaagagagctgtgcccaggagcagcctggcccgcatcggcggcagcggcatgcctgggaaggccccagctgtgtggggccaggacggctacagcggcccccgggtgcgggagcccctgcccccctgccgggaccccggggactttgtgcctgccctgcgggactacagccgccgctactacggccacagctctgtgcctgactaccggcccctgcggggagatggcaaccagaatggctaccggggccgggaccacgagtacacagaccaccccagcaagggcagctaccgggagcccctgaagagctatggaggcccctgtggggccgcccctgtgtggggcaccccacccagctatggaggcggctgccgctatgaggagtaccagggcaacagcccagatgcctgcagcgagggccgcagcagcgaggccctgcctgtggtgctgcctgatgcctacagccgggaccacagccccaaggcctacagcggcggccgcagcagcagcagcaatggctacagcagaagtgacagatatggagaggagggctgctatgaggagtaccggggccgcagcccagatgcccacagcggcggcaggaacagcagcagcaacagctatggccagagccaccactatggaggagagggccgctatgaggagtaccggggccgcagccatgaggcccggagcggcggccgcagcacagatgcccacagccggggccgcagtgatgatgcctacagcggcggccatgacagcagctcctggagcgactgctgcggcggcggcggccgctatgaggagtaccagggccgcagcctggatgccaacagcggcggctgcagccctgaggcctacagcggcggccatgacaacagctcctggagcgacagatatggagtgggcggccactatgaggagaacagaggccacagcctggatgccaacagcggcggccgcagcccagacacccacagcggcggccacagcagcagcagcaacagctatggccagagccacagatatggaggagagggccgctatgagtaccggggccgcagccatgatgcccacagcggcggctgcagcgcagatgcctacagcggcggccatgacagcagcagccagagcaacagatatggaggcggcggctgctatgaggagtaccggggccgcagcctggatgccaacagcggcggccgcagccccaatgcctacagcggcggccatgacagcagctcctggagccacagatatggaggcggcggccgctatgaggagtaccggggccgcagcctggatgccaacagcggcggccgcagcccagatgcctacagcggcggccatgacagcagcggccagagcaactgctatggaggcggcggccgctatgaggagtaccggggccgcctgctggatgccaacagcggcggccgcagcccagatgcctacagcggcggccatgacagcagcagccagagcaacagatatggaggcggcggccgctatgaggagtaccggggccacagcctggatgccaacagcggcggccgcagcccagacacctacagccggggccatgacagcagcagccagagcgaccactatggaggcggcggccgcagcctggatgccaacagcagcggccgcctgcctgatgcctacagcggcggccatgacagcagcagccgcagccacagatatggaggcggcggccgctatgaggagtaccggggccgcagcctggatgccaacagcggcggccgcagccccaatgcctacagcggcggccacaacagcagcagcagaaatgacccctgccggggcggcggccgctatgaggagaacagaggccacagcctggatgccaacagcggcggccacagccccaatgcctacagcggcggccgggacagcagcagcaacagctatgacaggagccacagatatggaggcggcggccactatgaggagtaccggggccgcagccatgacacccacagccggggccgcagcccagatgcccacagcggggaccactacacagaggcctacagccggggccgggacagcttcagcaacagctatggccgcagtgaccactacggccggggcggctgctatgaggagtaccagggccgcagccccaatgcctacggcggcggccggggcctgaacagcagcaacaacagccacggccgcagccacagatatggaggcggcggccgctatgaggagtaccggggccccagcccagatgcccacagcggcggccgggacagcagcatcaagagctatggcctgagtgacagatatggaggcggcggccactatgaggagtaccagggcagcctgcctgatgcctacagcggggaccatgacaggagcagcaacagctatggccgcagtgaccgctacagccggggccgggacagagtgggccgcccagaccggggcctgcccctgcccatggagaccggcagcccccccctgcatgacagctacagccgcagcggctgccgggtgccccggggcggcggccggcagggcggccgctttgagcggggggagggccgcagccgctactag

SEQ ID NO: 41984 - DNA, 1491 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccaggagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctatggagaggccctgggccgggaccacagcgagcacctgagcggcagcagctacagagatgccctgcagagatatggcaccagccatggagcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagagaaatccacccagcctgggccgggtgctgcctgacccccgggaggcctacggcagcagcagctatgtggccagcatcgtggatggaggagagagccgctctgagaagggggacagcagccgctactag

SEQ ID NO: 41985 - DNA, 1491 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccaggagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctatggagaggccctgggccgggaccacagcgagcacctgagcggcagcagctacagagatgccctgcagagatatggcaccagccatggagcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagagaaatccacccagcctgggccgggtgctgcctgacccccgggaggcctgtggcagcagcagctatgtggccagcatcgtggatggaggagagagccgctctgagaagggggacagcagccgctactag

SEQ ID NO: 41986 - DNA, 1491 bp, Artificial Sequence; identical to SEQ ID NO: 41985
  Description of Artificial Sequence: Synthetic coding sequence

SEQ ID NO: 41987 - DNA, 1380 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccaggagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagctaccatgatggctacggggaggccctgggccgggaccacagcgagcacctgagcggcagcagctacagagatgccctgcagagatatggcaccagccacggggcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagaggaacccccccagcctgggccgggtgctgcctgacccccgggaggcctgtggcagcagcagctatgtggccagcatcgtggatggaggagagagccgctctgagaagggggacagcagccgctactag

SEQ ID NO: 41988 - DNA, 1380 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccaggagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagctaccatgatggctacggggaggccctgggccgggaccacagcgagcacctgagcggcagcagctacagagatgccctgcagagatatggaacagcccacggggcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagaggaacccccccagcctgggccgggtgctgcctgacccccgggaggcctgtggcagcagcagctatgtggccagcatcgtggatggaggagagagccgctctgagaagggggacagcagccgctactag

SEQ ID NO: 41989 - DNA, 1491 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccaggagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctatggagaggccctgggccgggaccacagcgagcacctgagcggcagcagctacagagatgccctgcagagatatggaacagcccatggagcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagagaaatccacccagcctgggccgggtgctgcctgacccccgggaggcctgtggcagcagcagctatgtggccagcatcgtggatggaggagagagccgctctgagaagggggacagcagccgctactag

SEQ ID NO: 41990 - DNA, 1491 bp, Artificial Sequence; identical to SEQ ID NO: 41985
  Description of Artificial Sequence: Synthetic coding sequence

SEQ ID NO: 41991 - DNA, 630 bp, Artificial Sequence
  Description of Artificial Sequence: Synthetic coding sequence
atgagcaacctgaagccagatggagagcacggcggcagcacaggcaccggcagcggggccggcagcggcggggccctggaggaggaggtgaggaccctgtttgtgtctggcctgcctgtggacatcaagccccgggagctgtacctgctcttccggcccttcaagggctatgagggcagcctcatcaagctgacagcccggcagcctgtgggcttcgtcatctttgacagcagagctggagctgaggccgccaagaatgccctgaatggcatccgctttgatcctgagaacccccagaccctgcggctggagtttgccaaggccaacaccaagatggccaagagcaagctgatggccacccccaaccccagcaatgtgcacccagccctgggcgcccacttcatcgcccgggacccctatgacctgatgggcgccgccctgatcccagccagccctgaggcctgggccccctaccccctgtacaccacagagctgaccccagccatcagccacgccgccttcacctaccccacagccacagctgctgctgctgccctgcacgcccaggtgcgctggtaccccagcagtgacaccacccagcagggctggaagtaccggcagttctgctag

SEQ ID NO: 41992 - DNA, 1731 bp, Artificial Sequence
  Description of Artificial Sequence: Synthetic coding sequence
atggatgtgcgcttctacccagctgctgctggggaccctgccagcctggactttgcccagtgcctgggctactacggctacagcaagtttggaaacaacaacaactacatgaacatggccgaggccaacaatgccttctttgctgccagcgagcagaccttccacacccccagcctgggagatgaggagtttgagatcccccccatcaccccacctcctgagagtgaccctgccctgggcatgccagatgtgctgctgcccttccaggccctgagtgaccccctgcccagccagggcagcgagttcaccccccagtttcctccccagagcctggacctgcccagcatcaccatcagcaggaacctggtggagcaggatggagtgctgcacagcagcggcctgcacatggaccagagccacacccaggtgtcccagtaccggcaggaccccagcctcatcatgaggagcatcgtgcacatgacagatgctgcccggtctggagtgatgcccccagcccagctgaccaccatcaaccagagccagctgagcgcccagctgggcctgaacctgggcggggcctccatgccccacaccagccccagccccccagccagcaagagcgccacccccagccccagcagcagcatcaatgaagaagatgctgatgaggccaacagagccatcggggagaagagagctgccccagattctgggaagaagcccaagacccccaagaagaagaagaagaaggaccccaatgagccccagaagcctgtgtctgcctatgccctcttcttccgggacacccaggccgccatcaagggccagaaccccaatgccaccttcggggaggtgtccaagatcgtggcctccatgtgggacagcctgggggaggagcagaagcaggtgtacaagaggaagacagaggccgccaagaaggagtacctgaaggccctggccgcctaccgggccagcctggtgtccaaggctgctgctgagagcgctgaggcccagaccatccgctctgtgcagcagaccctggccagcaccaacctgaccagcagcctgctgctgaacacccccctgagccagcacggcaccgtgtctgccagcccccagaccctgcagcagagcctgcccaggagcatcgcccccaagcccctgaccatgaggctgcccatgaaccagatcgtgacctctgtgaccatcgccgccaacatgcccagcaacattggagcccccctcatcagctccatgggcaccaccatggtgggcagcgcccccagcacccaggtgagccccagcgtgcagacccagcagcaccagatgcagctgcagcagcagcagcagcagcagcagcagcagatgcagcagatgcagcagcagcagctgcagcagcaccagatgcaccagcagatccagcagcagatgcagcagcagcacttccagcaccacatgcagcagcacctgcagcagcagcagcagcacctgcagcagcagatcaaccagcagcagctgcagcagcagctgcagcagaggctgcagctgcagcagctgcagcacatgcagcaccagagccagcccagcccccggcagcacagccctgtggccagccagatcaccagccccatcccagccatcggcagcccccagcctgccagccagcagcaccagagccagatccagagccagacccagacccaggtgctgagccaggtgtccatcttctag

SEQ ID NO: 41993 - DNA, 1023 bp, Artificial Sequence
  Description of Artificial Sequence: Synthetic coding sequence
atggccgcccccctgctgcacacccggctgcctggagatgctgctgccagccccagcgctgtgaagatgctgggcgccagcaggacaggcatcagcaacatgagggccctggagaatgacttcttcaacagcccccccaggaagacagtgcagtttggaggcaccgtgacagaggtgctgctgaagtacaagacaggagagaccaatgactttgagctgctgaagaaccagctgctggaccctgacatcaaggatgaccagatcatcaactggctgctggagttccgcagcagcatcatgtacctgaccaaggactttgagcagctgatcagcatcatcctgcggctgccctggctgaacagaagccagacagtggtggaggagtacctggccttcctgggcaacctggtgtctgcccagacagtgttcctgcggccctgcctgtccatgattgccagccactttgtgccccccagggtcatcatcaaggagggagatgtggatgtgtctgacagtgatgatgaagatgacaacctgcctgccaactttgacaccagccagagcctggccaacaacagcaagatctgcaccattgaatgttatgtgcacaacctgctgcgcatctctgtgtacttccccaccctgcggcatgagatcctggagctgatcatcgagaagctgctgaagctggatgtgaatgccagccggcagggcattgaagatgctgaggagacagccaaccagacctgtggcggcacagacagcacagagggcctgtgcaacatgggctttgctgaggccttcctggagcccctgtggaagaagctgcaggaccccagcaacccagccatcatccggcaggccgccggcaactacatcggcagcttcctggcccgggccaagttcatccccctgatgatccgggagcagaggcacagcgccatgctgctgtccatggaccacttcacccagcctgccaagctgtgcagcacccccctcttcctggacaccagcagcttctag

SEQ ID NO: 41994 - DNA, 1461 bp, Artificial Sequence
  Description of Artificial Sequence: Synthetic coding sequence
atggccgcccccctgctgcacacccggctgcctggagatgctgctgccagccccagcgctgtgaagatgctgggcgccagcaggacaggcatcagcaacatgagggccctggagaatgacttcttcaacagcccccccaggaagacagtgcagtttggaggcaccgtgacagaggtgctgctgaagtacaagacaggagagaccaatgactttgagctgctgaagaaccagctgctggaccctgacatcaagaggctgccctggctgaacagaagccagacagtggtggaggagtacctggccttcctgggcaacctggtgtctgcccagacagtgttcctgcggccctgcctgtccatgattgccagccactttgtgccccccagggtcatcatcaaggagggagatgtggatgtgtctgacagtgatgatgaagatgacaacctgcctgccaactttgacaccagccagagcctggccaacaacagcaagatctgcaccattgaatgttatgtgcacaacctgctgcgcatctctgtgtacttccccaccctgcggcatgagatcctggagctgatcatcgagaagctgctgaagctggatgtgaatgccagccggcagggcattgaagatgctgaggagacagccaaccagacctgtggcggcacagacagcacagagggcctgtgcaacatggtgagcagcctgctgatgaaggtggagatgaagttcatcatcatcaagggctggaagcagctggtgctgctgatcttcggctttgctgaggccttcctggagcccctgtggaagaagctgcaggaccccagcaacccagccatcatccggcaggccgccggcaactacatcggcagcttcctggcccgggccaagttcatccccctcatcaccgtgaagagctgcctggacctgctggtgaactggctgcacatctacctgaacaaccaggacagcggcaccaaggccttctgtgatgtggccctgcacggccccttctacagcgcctgccaggccgtgttctacacctttgtgttccgccacaagcagctgctgagcggcaacctgaaggagggcctgcagtacctgcagagcctgaactttgagtggatcgtgatgagccagctgaaccccctgaagatctgcctgcccagcgtggtgaacttctttgctgccatcaccaacaagtaccagctggtgttctgctacaccatcattgaaagaaacaaccggcagatgctgcccgtcatccgcagcaccaccggcggggacagcgtgcagacctgcaccaaccccctggacaccttcttcccctttgacccctgtgtgctgaagaggagcaagaagttcatcgaccccatctaccaggtgtgggaggacatgtctgctgaggagctgcaggagttcaagaagcccatgaagaagctgttctggaggatcatgtag

SEQ ID NO: 41995 - DNA, 939 bp, Artificial Sequence
  Description of Artificial Sequence: Synthetic coding sequence
atggagcccggctctgtggagaacctgagcatcgtgtaccgcagccgggacttcctggtggtgaacaagcactgggatgtgagaattgacagcaaggcctggagggagaccctgaccctgcagaagcagctgcgctaccgcttccctgagctggccgaccctgacacctgctacggcttccgcttctgccaccagctggacttcagcaccagcggggccctgtgtgtggccctgaacaaggctgctgctggcagcgcctaccgctgcttcaaggagaggagagtgaccaaggcctacctggccctgctgcggggccacatccaggagagccgggtgaccatcagccacgccatcggcaggaacagcacagagggccgggcccacaccatgtgcatcgagggcagccagggctgtgagaaccccaagcccagcctgacagacctggtggtgctggagcacggcctgtatgctggggaccctgtgtccaaggtgctgctgaagcccctgaccggccgcacccaccagctgcgggtgcactgcagcgccctgggccaccctgtggtgggggacctgacctatggagaggtgtctggccgggaggaccggcccttcaggatgatgctgcacgccttctacctgcgcatccccacagacacagaatgtgtggaggtgtgcaccccagaccccttcctgcccagcctggatgcctgctggagcccccacaccctgctgcagagcctggaccagctggtgcaggccctgcgggccaccccagaccctgaccctgaagatcggggccccaggcctggcagccccagcgccctgctgcccggccctggccggcccccacctccacccaccaagcccccagagacagaggcccagaggggcccctgcctgcagtggctgtctgagtggaccctggagccagacagctag

SEQ ID NO: 41996 - DNA, 1638 bp, Artificial Sequence
  Description of Artificial Sequence: Synthetic coding sequence
atgtggctggacagaagaggctggctgcgggtgctgggccactggaggtatgacctgcggcggcccagcttcaccaggacctggagcggggacaagggccccatggccgagaccgtgtccacccaggtgggcacagaaggaggcctgcgggccagccaccagcagaatggagatgctggaggagatgccaaggtggagctgagccctggcccccccaagccagctggccgggaggtggagcccgcccctgtgggcggggagcaccccagcgctgctgcccctggccctgggaagcacaagaagagaagaggagccacccgggagcgggtggtgcccccacccaagaagagaagaactggagtgtcctttggagatgagcactttgctgagaccagctactactttgaaggaggcctgaggaaggtgcggccctactactttgacttccgcacctactgcaagggccgctgggtgggccacagcctgctgcacgtgttcagcacagagttccgggcccagcccctggcctactatgaggccgctgtgcgggccggccgcctgcagctgaatgagaagcctgtgcaggacctgaacatcgtgctgaaggacaatgacttcctgaggaacacagtgcacagacatgagccccctgtgacagctgagcccatccggctgctggccgagaatgaagatgtggtggtggtggacaagcccagcagcatccctgtgcacccctgtggccgcttccgccacaacacagtcatcttcatcctgggcaaggagcaccagctgaaggagctgcaccccctgcaccggctggaccggctgaccagcggcgtgctgatgtttgccaagacagctgctgtgtctgagcgcatccacgagcaggtgcgggaccggcagctggagaaggagtatgtgtgccgggtggagggggagttccccacagaggaggtgacctgcaaggagcccatcctggtggtgtcctacaaggtgggcgtgtgccgggtggacccccggggcaagccctgtgagaccgtcttccagaggctgagctacaacggccagagctctgtggtgcgctgccggcccctgaccggccgcacccaccagatccgggtgcacctgcagttcctgggccaccccatcctgaatgaccccatctacaacagcgtggcctggggccccagccggggccggggcggctacatccccaagaccaatgaggagctgctgcgggacctggtggccgagcaccaggccaagcagagcctggatgtgctggacctgtgtgagggggacctgagccctggcctgacagacagcacagcccccagcagcgagctgggcaaggatgacctggaggagctggccgccgccgcccagaagatggaggaggtggccgaggccgccccccaggagctggacaccatcgccctggccagcgagaaggctgtggagacagatgtgatgaaccaggagacagaccccctgtgtgctgaatgtcggctggtgcggcaggaccccctgccccaggacctggtgatgttcctgcacgccctgcgctacaagggccctggctttgagtacttcagccccatgcctgcctgggcccaggatgactggcagaaggactag

SEQ ID NO: 41997 - DNA, 1575 bp, Artificial Sequence
  Description of Artificial Sequence: Synthetic coding sequence
atgtggctggacagaagaggctggctgcgggtgctgggccactggaggtatgacctgcggcggcccagcttcaccaggacctggagcggggacaagggccccatggccgagaccgtgtccacccaggtgggcacagaaggaggcctgcgggccagccaccagcagaatggagatgctggaggagatgccaaggtggagctgagccctggcccccccaagccagctggccgggaggtggagcccgcccctgtggcccgggagcgggtggtgcccccacccaagaagagaagaactggagtgtcctttggagatgagcactttgctgagaccagctactactttgagggcggcctgaggaaggtgcggccctactactttgacttccgcacctactgcaagggccgctgggtgggccacagcctgctgcacgtgttcagcacagagttccgggcccagcccctggcctactatgaagctgctgtgcgggccggccgcctgcagctgaatgagaagcctgtgcaggacctgaacatcgtgctgaaggacaatgacttcctgaggaacacagtgcacagacatgagccccctgtgacagctgagcccatccggctgctggctgaaaatgaagatgtggtggtggtggacaagcccagcagcatccctgtgcacccctgtggccgcttccgccacaacacagtcatcttcatcctgggcaaggagcaccagctgaaggagctgcaccccctgcaccggctggaccggctgaccagcggcgtgctgatgtttgccaagacagctgctgtgtctgagcgcatccacgagcaggtgcgggaccggcagctggagaaggagtatgtgtgccgggtggagggggagttccccacagaggaggtgacctgcaaggagcccatcctggtggtgtcctacaaggtgggcgtgtgccgggtggacccccggggcaagccctgtgaaacagtgttccagaggctgagctacaacggccagagctctgtggtgcgctgccggcccctgactggaagaacccaccagatccgggtgcacctgcagttcctgggccaccccatcctgaatgaccccatctacaacagcgtggcctggggccccagccggggccggggcggctacatccccaagaccaatgaggagctgctgcgggacctggtggccgagcaccaggccaagcagagcctggatgtgctggacctgtgtgagggggacctgagccctggcctgacagacagcacagcccccagcagcgagctgggcaaggatgacctggaggagctggccgctgctgcccagaagatggaggaggtggccgaggccgccccccaggagctggacaccatcgccctggccagcgagaaggctgtggagacagatgtgatgaaccaggagacagaccccctgtgtgccgagtgccgcctggtgcggcaggaccccctgccccaggacctggtgatgttcctgcacgccctgcgctacaagggccctggctttgagtacttcagccccatgcctgcctgggcccaggatgactggcagaaggactag

SEQ ID NO: 41998 - DNA, 1056 bp, Artificial Sequence
  Description of Artificial Sequence: Synthetic coding sequence
atgagagctgtgctggcccgggagatggatggccggcgggtgctgggccgcttctggagcggctggaggcggggcctgggcgtgcggcctgtgcctgaagatgctggctttggaacagaggcccggcaccagaggcagccccggggcagctgccagaggagcggccccctgggggaccagccctttgctggcctgctgcccaagaacctgagccgggaggagctggtggatgccctgcgggctgctgtggtggacaggaagggccccctggtgaccctgaacaagccccagggcctgcctgtgacaggcaagccaggagagctgaccctcttctctgtgctgcctgagctgagccagagcctgggcctgcgggagcaggagctgcaggtggtgcgggccagcggcaaggagagcagcggcctggtgctgctgagcagctgcccccagacagccagccggctgcagaagtacttcacccacgcccggcgggcccagaggcccacagccacctactgtgctgtgacagatggcatcccagctgccagcgagggcaagatccaggccgccctgaagctggagcacattgatggagtgaacctgactgtgcctgtgaaggcccccagcaggaaggacatcctggagggcgtgaagaagaccctgagccacttccgggtggtggccaccggcagcggctgtgccctggtgcagctgcagcccctgactgtgttcagcagccagctgcaggtgcacatggtgctgcagctgtgccctgtgctgggggaccacatgtacagcgcccgggtgggcaccgtgctgggccagcgcttcctgctgcctgctgagaacaacaagccccagaggcaggtgctggatgaggccctgctgcggcggctgcacctgacccccagccaggccgcccagctgcccctgcacctgcacctgcaccggctgctgctgcccggcacccgggcccgggacacccctgtggagctgctggcccccctgcccccctacttcagcaggaccctgcagtgcctgggcctgcggctgcagtag

SEQ ID NO: 41999 - DNA, 1011 bp, Artificial Sequence
  Description of Artificial Sequence: Synthetic coding sequence
atgagagctgtgctggcccgggagatggatggccggcgggtgctgggccgcttctggagcggctggaggcggggcctgggcgtgcggcctgtgcctgaagatgctggctttggaacagaggcccggcaccagaggcagccccggggcagctgccagaggagcggccccctgggggaccagccctttgctggcctgctgcccaagaacctgagccgggaggagctggtggatgccctgcgggctgctgtggtggacaggaagggcaagccaggagagctgaccctcttctctgtgctgcctgagctgagccagagcctgggcctgcgggagcaggagctgcaggtggtgcgggccagcggcaaggagagcagcggcctggtgctgctgagcagctgcccccagacagccagccggctgcagaagtacttcacccacgcccggcgggcccagaggcccacagccacctactgtgctgtgacagatggcatcccagctgccagcgagggcaagatccaggccgccctgaagctggagcacattgatggagtgaacctgactgtgcctgtgaaggcccccagcaggaaggacatcctggagggcgtgaagaagaccctgagccacttccgggtggtggccactggaagtggctgtgccctggtgcagctgcagcccctgaccgtcttcagcagccagctgcaggtgcacatggtgctgcagctgtgccctgtgctgggggaccacatgtacagcgcccgggtgggcaccgtgctgggccagcgcttcctgctgcctgctgagaacaacaagccccagaggcaggtgctggatgaggccctgctgcggcggctgcacctgacccccagccaggccgcccagctgcccctgcacctgcacctgcaccggctgctgctgcccggcacccgggcccgggacacccctgtggagctgctggcccccctgcccccctacttcagcaggaccctgcagtgcctgggcctgcggctgcagtag

SEQ ID NO: 42000 - DNA, 864 bp, Artificial Sequence
  Description of Artificial Sequence: Synthetic coding sequence
atggccaccgtgatggccgccacagctgctgagagagctgtgctggaggaggagttccgctggctgctgcatgatgaggtgcatgctgtgctgaagcagctgcaggacatcctgaaggaggccagcctgcgcttcaccctgcccggcagcggcacagagggccctgccaagcaggagaacttcatcctgggcagctgtggcacagaccaggtgaagggcgtgctgaccctgcagggagatgccctgagccaggctgatgtgaacctgaagatgcccaggaacaaccagctgctgcactttgccttccgggaggacaagcagtggaagctgcagcagatccaggatgccagaaatcatgtgtcccaggccatctacctgctgaccagccgggaccagagctaccagttcaagacaggagctgaggtgctgaagctgatggatgctgtgatgctgcagctgacccgggccaggaaccggctgaccaccccagccaccctgaccctgcctgagattgctgccagcggcctgaccaggatgtttgccccagccctgcccagcgacctgctggtgaatgtgtacatcaacctgaacaagctgtgcctgactgtgtaccagctgcacgccctgcagcccaacagcaccaagaacttccggcctgctgggggcgctgtgctgcacagccctggggccatgtttgagtggggcagccagaggctggaggtgagccacgtgcacaaggtggagtgtgtgatcccctggctgaatgatgccctggtgtacttcaccgtgtccctgcagctgtgccagcagctgaaggacaagatcagcgtcttcagcagctactggagctaccggcccttctag

SEQ ID NO: 42001 - DNA, 6681 bp, Artificial Sequence
  Description of Artificial Sequence: Synthetic coding sequence
atggtgctggccggcctcatcaggaagctgggccaccagctggccgagatccgggagcgggccctgaagagcatcctgtgcaagattgagcacaacctgatctgctatgctgacctgatccaggagcggcagctgttcctgcacctgctggagtggttcaacttccccagcgtgcccatgaaggaggaggtgctgaacctgctgagccggctggtgaagtacccacctgctgtgcagcacctggtggatgtgggcgctgtggagttcctgagcaagctgcggagcaatgtggagcccaacctgcaggccgagattgatggcatcctggatggcctcttcctgctgcccagcgaggtgcctgccctgagcagcgccagctaccagaccaaccagacagagctgagcaagaaccctgagatcctgaccggctacttcccccaggacaagagcaacttccagcagatggaggtgccccccaggcctgtggtgaaccagacagtgaagtgcctgaagttcagcaccttcccctggctgcccctgaccaccacagacagacatgtgctgagcagcaatgaaagcagcctgcggagcagcaaccacaccctcatctggaacacctgtgagctgctgaaggatgtgatcatgcaggacttccctgctgagatcttcctgcagaggcccaagatcgtgcagagcctgctgagcctgctgaagctggcctttggagatggcaagcaccggctggccctgcagagcgtgtcctgcctgcagcagctgtgcatgtacctgaggaaccggctgaacttccaccgggaccccggcttcttcagcaacaagcatgacacagtgtcccagaacagcagcctgagctactgccacgaggcccggggcacccaccacagccagaaccccagccctggcagcagcagcccccggcccagcgtggtgggccgcacaggccagaggcccagaggagatggccaggactgggatgctgccagcagcagcggcagcagcagccacgcccacgtgaacagccgcatctctgtgcacagccccctggacatgggccacatcgacctgcctgagctggagacagaggacaccctggagctgcagttccagcagctgagcctgccccagttctgtgtgtccatcctggagagcgctgtgcccctgctgaggacaggcagccggcaggtgatcatccgggtgctggagctgctgacagaggacatgaccctcatcggggaggccatcagcacagacatctgggatgacagcagcctgtttggaattgacatgaaggagaagctgctgctggtgctgggcgccctgggggagaccatgtgctaccacaagagcagcatcagcctggagcagcctgaggtgatgctggtgcaccacaggatggccttcatcagcatcagcctgtttgctgtgcggctgctgcagaccctgctgcctgtggagaaggccagcgagttcctgtctgagcccatgagcacagccctcttcctgctgagcctggacatgcccatcagcctggagtaccccaacatccacgaggccgtggtggcctacctggagcagctgaacagcgagaactacagcatctacaagaggacagctgaggccgtgtacagcattgaatgtacctgcaacttcctgagtgacatcggcaaggagggggagaagaacctgctggagctggtggagctggccgaccaggccctgcgctccttctcctaccaccagcacttccccctcatcaaggagatcatcagcatctgcagcaagatctggaagagcgcccaggccagccccctgctgcagggcgagagccagaaggtgctgctgcacatgctgagccaccccctgccccgggtgaaggccgagacctaccactgctgcctggagatcaccaaggagtgcctgggcgtgcacaacgtgaccaagcctgtgagcagcctgtgcaatggcatccacttcctgctgcaccccaaggtgctgtatgagatctctgtgtttggcatccaggagcctgagagcgaggtgaacacagctgccaaggccatcctgctgtacctgctgcagggccgcctgatgatgacagccctgacctggaacaagttcatcgagagcctgtgccctgtgatccccatcctgcagggctatgctgacacagaggaccccctgggcaactgcatcctgctgctgagcaaggccagcagtgacacagaggagatgctgccctgcaccacccggctgaagtccatgctgcggctgctgctggtgaagaagcccagcgtgcgcagcctggccctgaagctgctggccttccacctgaccagcgaggagggcgctgacaccaagaggcccctgattgatgcccgggtgctgagccgggtgacagacctcttcatcggcaagaagcccatcgagctgcggctggatgacagaagagagctggtgatcaagctggagaccgtggagaaggtgtatgagatcttcaccagtgatgatgtggacctggtgctgaggaagtctgctgctgagcagctggccgtcatcatgcaggacatcaagatgcatgctgtggtgaagaagctgtgcctgattgacaagatcatcgagtacctgaatgaatgtgtgtcccaggacggcaaggtggtggagtgcctggtgcagccctgcctgaccctgctgaggaaggtgctgtgtggggaccctgtgatgagggtgtccctgagccagcagagcagcctgctgactgtgctcttccgggtgtccctcatcttccacgaggactgcagcgtggtgacagaggtgggcgccctcttctgcctgctgctgtttgatgaggtgtccaggatggacatgtggagcgtgaaccccagcaacaagcccagcctgcccagcgtcttcagcctgcctgtgtctgtgttccgccgctaccacctgcctgtgcacgtgattggccaccacgctgtgagcccctacagcatcgtgctgcccctgtctgctgactgcctggccctgaagcctgtgtctgacatgctgagaattgcctggaacctgtcctggtaccacggcagtgacaacctgctgaagcagatgaacagcgagaccaagacccaggagatcctggatgccctgaagctgagcacagaggacatcctgaccctgaagatcacccacatggccagcggcctgcaggactgcctgcacagcatcgtgcaggccgccacccaccgggaggtgcgggctgctgtgaccaggatgtccttctacctgctgaatgaccggctgagcctgaagggctgccccggcccctgtggggtgaccctgaagagcctggcctggcacacagccctgaaccgcttcctgcaggtgctgcctgcctgcacagaagatgagaagctgctgattgacatcatccacttcctgaacaagctgatcaaggagcagaggaagaacagcagcctggagctgctgaactggatcctggagctgctgctgcggcacagcgccaaccccctgctggacctgctggtgctgacagagagccaggcccgggaggagacagatgacatcagaacagctgtgcggcagcagctgcagaaggagctgattgccctgtttgacaccctgctgctgaacttcatggaggtgacagacagaaaatgttctgagctgctgtatgtgttccagacccagctggccctgaagctgctgcagtgcctgaaggtgacagatgccccccacttctacggcctgcccagcctggagaggaccctgcggggcatggccaacctgacagccttccctggctggagcagccacagccccctgaccaagcccctggacatctgtgtgaagtacctgagcggcctgctggaggtgatcaccagcttctacgtggagcggggcggcaatgccatgtccttcatgggcaagggcgtgaccaagagcaccatcctgtgcctgctgcacctgagccatgagatgatggcccaggccggcagcctggagtggatgagcctgtggttcctgcccctgggcagccacagcgaggagcacatccccacccagcagggcctggcctggctgatccccctgtgggtggaccgggaccctgaggtgcgcttcaccagcctgggcctgggcagcgccctgaccaccctggagaccggctgtgtggccctggccaacagctgccagaacatcagcggcggcctgtggggcaccgtggtgaacatcctgctggaccagagtgaatgttccatggtgcggcgggaggccgccttcatcctgcagaacctgctggtgatccccatgcccacagagatcatcaaggactacacctggcagggcccctgtgtgcatgatgaagattctggcctgagcctcatcggcaagccagccctgcaggccctgctgtaccactgccacttctatgagcacctgaaccagatggtgaagcactgctacctgggccgctgcatgtttgacctgaacttcagcgcctttgacagaaattctgagagcaatgacctgaatggcctggatgacagcttcaagttctggagggcccccagcaggaccagccaggaccgggaccccagcagcctgagcaccagcgagaccaccgtggcccccagcctgggcagcacagagttccagcccctggtgcagagcaccaccctgctgcctgaggccagccatgaccagtttgtggcccagggccaccaggagagcaccagcccccggccccctcatgacagcagcctgagcgcccccctgcccaagctgtgtgtgtttgtgacccccagcctgctgagcgccatgtgcagcctgctggacaacctgctgaccatcgccccccgggacacagccaaggccttccggcaggcccacctgattgagctgctgtgcagcattgctgatgccaccctcatccagacctgtgtgcaggagctgcgggccctgctgcccagcagccccccagctgagcacacccaggcccaggtgtccttcctgctggagtacctgagcagcctgagccggctgctgcagagctgcctgctggtggagccagacctggtgatccaggatgagctggtgaagcccctcatcaccaacatcatcggcatcctgaccatctgcaccaaggatgtgctggacaaggagctgatcagcgccttctaccacacctggacccacctgttcaacctgctggccatgctgctgaggaaggccggggccatcaccctgccctttgtgacagtggccctggccaagcactggacagctgccatcgacatgttctgcacctgtgccggcctgagcgccacctgcccagccctgtacacagccagcctgcagttcctgtctgtgctgctgacagaggaggccaagggccacctgcaggccaagagcaagacccacctgtgctgcagccccaccgtggccagcctgctggatgacagccaggagaaccagaagagcctggagcagctgagtgatgtgatcctgcagtgctatgagggcaagagcagcaaggacatcctgaagagggtggccgccaatgccctgatgagcctgctggccgtgtcccggcgggcccagaagcacgccctgaaggccaacctgattgacaactgcatggagcagatgaagcacatcaatgcccagctgaacctggacagcctgcggcctgggaaggccgccctgaagaagaaggaggatggagtcatcaaggagctgagcatcgccatgcagctgctgaggaactgcctgtaccagaatgaggagtgcaaggaggccgccctggaggcccacctggtgcctgtgctgcacagcctgtggccctggatcctgatggatgacagcctgatgcagatcagcctgcagctgctgtgtgtgtacacagccaacttccccaacggctgcagcagcctgtgctggagcagctgtggccagcaccctgtgcaggccacccacagaggagctgtgagcaacagcctgatgctgtgcatcctgaagctggccagccagatgcccctggagaacaccaccgtgcagcagatggtgttcatgctgctgagcaacctggccctgagccatgactgcaagggcgtcatccagaagagcaacttcctgcagaacttcctgagcctggccctgcccaagggcggcaacaagcacctgagcaacctgaccatcctgtggctgaagctgctgctgaacatcagcagtggagaagatggccagcagatgatcctgcggctggatggctgcctggacctgctgacagagatgagcaagtacaagcacaagagcagccccctgctgcccctgctgatcttccacaacgtgtgcttctccccagccaacaagcccaagatcctggccaatgagaaggtgatcaccgtgctggccgcctgcctggagagcgagaaccagaatgcccagagaattggagctgctgccctgtgggccctgatctacaactaccagaaggccaagacagccctgaagagccccagcgtgaagagaagagtggatgaggcctacagcctggccaagaagaccttccccaacagcgaggccaaccccctgaatgcctactacctgaagtgcctggagaacctggtgcagctgctgaacagcagctag

SEQ ID NO: 42002 - DNA, 4782 bp, Artificial Sequence
  Description of Artificial Sequence: Synthetic coding sequence
atggtgctggccggcctcatcaggaagctgggccaccagctggccgagatccgggagcgggccctgaagagcatcctgtgcaagattgagcacaacctgatctgctatgctgacctgatccaggagcggcagctgttcctgcacctgctggagtggttcaacttccccagcgtgcccatgaaggaggaggtgctgaacctgctgagccggctggtgaagtacccacctgctgtgcagcacctggtggatgtgggcgctgtggagttcctgagcaagctgcggagcaatgtggagcccaacctgcaggccgagattgatggcatcctggatggcctcttcctgctgcccagcgaggtgcctgccctgagcagcgccagctaccagaccaaccagacagagctgagcaagaaccctgagatcctgaccggctacttcccccaggacaagagcaacttccagcagatggaggtgccccccaggcctgtggtgaaccagacagtgaagtgcctgaagttcagcaccttcccctggctgcccctgaccaccacagacagacatgtgctgagcagcaatgaaagcagcctgcggagcagcaaccacaccctcatctggaacacctgtgagctgctgaaggatgtgatcatgcaggacttccctgctgagatcttcctgcagaggcccaagatcgtgcagagcctgctgagcctgctgaagctggcctttggagatggcaagcaccggctggccctgcagagcgtgtcctgcctgcagcagctgtgcatgtacctgaggaaccggctgaacttccaccgggaccccggcttcttcagcaacaagcatgacacagtgtcccagaacagcagcctgagctactgccacgaggcccggggcacccaccacagccagaaccccagccctggcagcagcagcccccggcccagcgtggtgggccgcacaggccagaggcccagaggagatggccaggactgggatgctgccagcagcagcggcagcagcagccacgcccacgtgaacagccgcatctctgtgcacagccccctggacatgggccacatcgacctgcctgagctggagacagaggacaccctggagctgcagttccagcagctgagcctgccccagttctgtgtgtccatcctggagagcgctgtgcccctgctgaggacaggcagccggcaggtgatcatccgggtgctggagctgctgacagaggacatgaccctcatcggggaggccatcagcacagacatctgggatgacagcagcctgtttggaattgacatgaaggagaagctgctgctggtgctgggcgccctgggggagaccatgtgctaccacaagagcagcatcagcctggagcagcctgaggtgatgctggtgcaccacaggatggccttcatcagcatcagcctgtttgctgtgcggctgctgcagaccctgctgcctgtggagaaggccagcgagttcctgtctgagcccatgagcacagccctcttcctgctgagcctggacatgcccatcagcctggagtaccccaacatccacgaggccgtggtggcctacctggagcagctgaacagcgagaactacagcatctacaagaggacagctgaggccgtgtacagcattgaatgtacctgcaacttcctgagtgacatcggcaaggagggggagaagaacctgctggagctggtggagctggccgaccaggccctgcgctccttctcctaccaccagcacttccccctcatcaaggagatcatcagcatctgcagcaagatctggaagagcgcccaggccagccccctgctgcagggcgagagccagaaggtgctgctgcacatgctgagccaccccctgccccgggtgaaggccgagacctaccactgctgcctggagatcaccaaggagtgcctgggcgtgcacaacgtgaccaagcctgtgagcagcctgtgcaatggcatccacttcctgctgcaccccaaggtgctgtatgagatctctgtgtttggcatccaggagcctgagagcgaggtgaacacagctgccaaggccatcctgctgtacctgctgcagggccgcctgatgatgacagccctgacctggaacaagttcatcgagagcctgtgccctgtgatccccatcctgcagggctatgctgacacagaggaccccctgggcaactgcatcctgctgctgagcaaggccagcagtgacacagaggagatgctgccctgcaccacccggctgaagtccatgctgcggctgctgctggtgaagaagcccagcgtgcgcagcctggccctgaagctgctggccttccacctgaccagcgaggagggcgctgacaccaagaggcccctgattgatgcccgggtgctgagccgggtgacagacctcttcatcggcaagaagcccatcgagctgcggctggatgacagaagagagctggtgatcaagctggagaccgtggagaaggtgtatgagatcttcaccagtgatgatgtggacctggtgctgaggaagtctgctgctgagcagctggccgtcatcatgcaggacatcaagatgcatgctgtggtgaagaagctgtgcctgattgacaagatcatcgagtacctgaatgaatgtgtgtcccaggacggcaaggtggtggagtgcctggtgcagccctgcctgaccctgctgaggaaggtgctgtgtggggaccctgtgatgagggtgtccctgagccagcagagcagcctgctgactgtgctcttccgggtgtccctcatcttccacgaggactgcagcgtggtgacagaggtgggcgccctcttctgcctgctgctgtttgatgaggtgtccaggatggacatgtggagcgtgaaccccagcaacaagcccagcctgcccagcgtcttcagcctgcctgtgtctgtgttccgccgctaccacctgcctgtgcacgtgattggccaccacgctgtgagcccctacagcatcgtgctgcccctgtctgctgactgcctggccctgaagcctgtgtctgacatgctgagaattgcctggaacctgtcctggtaccacggcagtgacaacctgctgaagcagatgaacagcgagaccaagacccaggagatcctggatgccctgaagctgagcacagaggacatcctgaccctgaagatcacccacatggccagcggcctgcaggactgcctgcacagcatcgtgcaggccgccacccaccgggaggtgcgggctgctgtgaccaggatgtccttctacctgctgaatgaccggctgagcctgaagggctgccccggcccctgtggggtgaccctgaagagcctggcctggcacacagccctgaaccgcttcctgcaggtgctgcctgcctgcacagaagatgagaagctgctgattgacatcatccacttcctgaacaagctgatcaaggagcagaggaagaacagcagcctggagctgctgaactggatcctggagctgctgctgcggcacagcgccaaccccctgctggacctgctggtgctgacagagagccaggcccgggaggagacagatgacatcagaacagctgtgcggcagcagctgcagaaggagctgattgccctgtttgacaccctgctgctgaacttcatggaggtgacagacagaaaatgttctgagctgctgtatgtgttccagacccagctggccctgaagctgctgcagtgcctgaaggtgacagatgccccccacttctacggcctgcccagcctggagaggaccctgcggggcatggccaacctgacagccttccctggctggagcagccacagccccctgaccaagcccctggacatctgtgtgaagtacctgagcggcctgctggaggtgatcaccagcttctacgtggagcggggcggcaatgccatgtccttcatgggcaagggcgtgaccaagagcaccatcctgtgcctgctgcacctgagccatgagatgatggcccaggccggcagcctggagtggatgagcctgtggttcctgcccctgggcagccacagcgaggagcacatccccacccagcagggcctggcctggctgatccccctgtgggtggaccgggaccctgaggtgcgcttcaccagcctgggcctgggcagcgccctgaccaccctggagaccggctgtgtggccctggccaacagctgccagaacatcagcggcggcctgtggggcaccgtggtgaacatcctgctggaccagagtgaatgttccatggtgcggcgggaggccgccttcatcctgcagaacctgctggtgatccccatgcccacagagatcatcaaggactacacctggcagggcccctgtgtgcatgatgaagattctggcctgagcctcatcggcaagccagccctgcaggccctgctgtaccactgccacttctatgagcacctgaaccagatggtgaagcactgctacctgggccgctgcatgtttgacctgaacttcagcgcctttgacagaaattctgagagcaatgacctgaatggcctggatgacagcttcaagttctggagggcccccagcaggaccagccaggaccgggaccccagcagcctgagcaccagcgagaccaccgtggcccccagcctgggcagcacagagttccagcccctggtgcagagcaccaccctgctgcctgaggccagccatgaccagtttgtggcccagggcaacagacacttcggcaccaacatccagttctag

SEQ ID NO: 42003 - DNA, 2640 bp, Artificial Sequence
  Description of Artificial Sequence: Synthetic coding sequence
atggtgctggccggcctcatcaggaagctgggccaccagctggccgagatccgggagcgggccctgaagagcatcctgtgcaagattgagcacaacctgatctgctatgctgacctgatccaggagcggcagctgttcctgcacctgctggagtggttcaacttccccagcgtgcccatgaaggaggaggtgctgaacctgctgagccggctggtgaagtacccacctgctgtgcagcacctggtggatgtgggcgctgtggagttcctgagcaagctgcggagcaatgtggagcccaacctgcaggccgagattgatggcatcctggatggcctcttcctgctgcccagcgaggtgcctgccctgagcagcgccagctaccagaccaaccagacagagctgagcaagaaccctgagatcctgaccggctacttcccccaggacaagagcaacttccagcagatggaggtgccccccaggcctgtggtgaaccagacagtgaagtgcctgaagttcagcaccttcccctggctgcccctgaccaccacagacagacatgtgctgagcagcaatgaaagcagcctgcggagcagcaaccacaccctcatctggaacacctgtgagctgctgaaggatgtgatcatgcaggacttccctgctgagatcttcctgcagaggcccaagatcgtgcagagcctgctgagcctgctgaagctggcctttggagatggcaagcaccggctggccctgcagagcgtgtcctgcctgcagcagctgtgcatgtacctgaggaaccggctgaacttccaccgggaccccggcttcttcagcaacaagcatgacacagtgtcccagaacagcagcctgagctactgccacgaggcccggggcacccaccacagccagaaccccagccctggcagcagcagcccccggcccagcgtggtgggccgcacaggccagaggcccagaggagatggccaggactgggatgctgccagcagcagcggcagcagcagccacgcccacgtgaacagccgcatctctgtgcacagccccctggacatgggccacatcgacctgcctgagctggagacagaggacaccctggagctgcagttccagcagctgagcctgccccagttctgtgtgtccatcctggagagcgctgtgcccctgctgaggacaggcagccggcaggtgatcatccgggtgctggagctgctgacagaggacatgaccctcatcggggaggccatcagcacagacatctgggatgacagcagcctgtttggaattgacatgaaggagaagctgctgctggtgctgggcgccctgggggagaccatgtgctaccacaagagcagcatcagcctggagcagcctgaggtgatgctggtgcaccacaggatggccttcatcagcatcagcctgtttgctgtgcggctgctgcagaccctgctgcctgtggagaaggccagcgagttcctgtctgagcccatgagcacagccctcttcctgctgagcctggacatgcccatcagcctggagtaccccaacatccacgaggccgtggtggcctacctggagcagctgaacagcgagaactacagcatctacaagaggacagctgaggccgtgtacagcattgaatgtacctgcaacttcctgagtgacatcggcaaggagggggagaagaacctgctggagctggtggagctggccgaccaggccctgcgctccttctcctaccaccagcacttccccctcatcaaggagatcatcagcatctgcagcaagatctggaagagcgcccaggccagccccctgctgcagggcgagagccagaaggtgctgctgcacatgctgagccaccccctgccccgggtgaaggccgagacctaccactgctgcctggagatcaccaaggagtgcctgggcgtgcacaacgtgaccaagcctgtgagcagcctgtgcaatggcatccacttcctgctgcaccccaaggtgctgtatgagatctctgtgtttggcatccaggagcctgagagcgaggtgaacacagctgccaaggccatcctgctgtacctgctgcagggccgcctgatgatgacagccctgacctggaacaagttcatcgagagcctgtgccctgtgatccccatcctgcagggctatgctgacacagaggaccccctgggcaactgcatcctgctgctgagcaaggccagcagtgacacagaggagatgctgccctgcaccacccggctgaagtccatgctgcggctgctgctggtgaagaagcccagcgtgcgcagcctggccctgaagctgctggccttccacctgaccagcgaggagggcgctgacaccaagaggcccctgattgatgcccgggtgctgagccgggtgacagacctcttcatcggcaagaagcccatcgagctgcggctggatgacagaagagagctggtgatcaagctggagaccgtggagaaggtgtatgagatcttcaccagtgatgatgtggacctggtgctgaggaagtctgctgctgagcagctggccgtcatcatgcagggctgcaggatgtttggcaccaccatgccccacaccctggaggagggcttcatgtggtag

SEQ ID NO: 42004 - DNA, 438 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggagcagagcatcatcagtgaatatgagaagagcctgcagtttgatgagaagtgcctgagcatcatgctggccgagtgggaggccaaccccctcatctgccctgtgtgcaccaacctgctgtcctag

SEQ ID NO: 42005 - DNA, 519 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggagcagagcatcatcagtgaatatgagaagagcctgcagtttgatgagaagtgcctgagcatcatgctggccgagtgggaggccaaccccctcatctgccctgtgtgcaccaagtacaacctgcgcatcaccagcggcgtggtggtgtgccagtgtggcctgagcatccccagccacgcctgtgacacctgggccgtcatcctgtag

SEQ ID NO: 42006 - DNA, 660 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggagcagagcatcatcagtgaatatgagaagagcctgcagtttgatgagaagtgcctgagcatcatgctggccgagtgggaggccaaccccctcatctgccctgtgtgcaccaagtacaacctgcgcatcaccagcggcgtggtggtgtgccagtgtggcctgagcatccccagccacagcagcgagctgacagagcagaagctgcgggcctgcctggagggcagcatcaatgagcacagcgcccactgcccccacaccccagagttctctgtgactggaggaacagaggagaagagcagcctgctgatgagctgcctggcctgtgacacctgggccgtcatcctgtag

SEQ ID NO: 42007 - DNA, 696 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggagcagagcatcatcagtgaatatgagaagagcctgcagtttgatgagaagtgcctgagcatcatgctggccgagtgggaggccaaccccctcatctgccctgtgtgcaccaagtacaacctgcgcatcaccagcggcgtggtggtgtgccagtgtggcctgagcatccccagccacagcagcgagctgacagagcagaagctgcgggcctgcctggagggcagcatcaatgagcacagcgcccactgcccccacaccccagagttctctgtgactggaggaacagaggagaagagcagcctgctgatgagctgcctggtgtctgtgtcctgggaccccctgtgtgggaagagggacctgtggctggtgctcttccccccatag

SEQ ID NO: 42008 - DNA, 321 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccagggcctgtag

SEQ ID NO: 42009 - DNA, 447 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggagcagagcatcatcagtgaatatgagaagagcctgcagtttgatgagaagtgcctgagcatcatgctggccgagtgggaggccaaccccctcatctgccctgtgtgcaccaagcctgtgatcctgggcctgtag

SEQ ID NO: 42010 - DNA, 321 bp, Artificial Sequence
  Description of Artificial Sequence: Synthetic coding sequence
atggccgagagcctgcggagccccaggaggagcctgtacaagctggtgggcagccccccctggaaggaggccttccggcagcgctgcctggagaggatgaggaacagccgggaccggctgctgaaccgctaccggcaggccggcagcagcggccctggcaacagccagaacagcttcctggtgcaggaggtgatggaggaggagtggaatgccctgcagagcgtggagaactgcccagaggacctggcccagctggaggagctgattgacatggctgtgctggaggagatccagcaggagctgatcaaccaggtgttctag

SEQ ID NO: 42011 - DNA, 591 bp, Artificial Sequence
  Description of Artificial Sequence: Synthetic coding sequence
atggaggccgaggatgaagatgagaagtacctgcaggagtgcctgagcaagagtgacagcctgcagaagcagatcagccagaaggagaagcagctggtgcagctggagacagacctgaagattgagaaggagtggaggcagaccctgcaggaggacctgcagaaggagaaggatgccctgagccacctgagaaatgagacccagcagatcatcagcctgaagaaggagttcctgaacctgcaggatgagaaccagcagctgaagaagatctaccacgagcaggagcaggccctgcaggagctgggcaacaagctgtctgagagcaagctgaagattgaggacatcaaggaggccaacaaggccctgcagggcctggtgtggctgaaggacaaggaggccacccactgcaagctgtgtgagaaggagttcagcctgagcaagaggaagcaccactgcaggaactgtggggagatcttctgcaatgcctgcagcgacaatgagctgcccctgcccagcagccccaagcctgtgcgggtgtgtgacagctgccacgccctgctgatccagcgctgcagcagcaacctgccctag

SEQ ID NO: 42012 - DNA, 699 bp, Artificial Sequence
  Description of Artificial Sequence: Synthetic coding sequence
atggccaccaaggaccccacagctgtggagcgggccaacctgctgaacatggccaagctgagcatcaagggcctcatcgagagcgccctgagctttggccgcaccctggacagcgactacccacccctgcagcagttctttgtggtgatggagcactgcctgaagcacggcctgaaggtgaggaagagcttcctgagctacaacaagaccatctggggccccctggagctggtggagaagctgtacccagaggccgaggagatcggggcctctgtgcgggacctgcccggcctgaagacccccctgggccgggcccgggcctggctgcggctggccctgatgcagaagaagatggctgactacctgcgctgcctgatcatccagagggacctgctgtctgagttctatgagtaccacgccctgatgatggaggaggagggcgccgtcatcgtgggcctgctggtgggcctgaatgtgattgatgccaacctgtgtgtgaagggggaggacctggacagccaggtgggcgtcatcgacttctccatgtacctgaagaatgaggaggacatcggcaacaaggagagatatgacttccacaagctgttccacatcctgggcttcctgtacagcagcctgcagatcatcatccgcagcatctacctgcagtgtggcttcatcctgctcttcagccccctgtag

SEQ ID NO: 42013 - DNA, 1926 bp, Artificial Sequence
  Description of Artificial Sequence: Synthetic coding sequence
atgaccttccaggtgtggggctggaggagagaagatgccagccaggtgctggcctgggtgcctgatgctgagggcggcagaagaggcatgctgaccaggaggagcctggccaccaaggaccccacagctgtggagcgggccaacctgctgaacatggccaagctgagcatcaagggcctgattgaaagtgccctgagctttggaagaaccctggacagcgactacccacccctgcagcagttctttgtggtgatggagcactgcctgaagcacggcctgaaggtgaggaagagcttcctgagctacaacaagaccatctggggccccctggagctggtggagaagctgtacccagaggccgaggagattggagcctctgtgcgggacctgcccggcctgaagacccccctgggccgggcccgggcctggctgcggctggccctgatgcagaagaagatggctgactacctgcgctgcctgatcatccagagggacctgctgtctgagttctatgagtaccacgccctgatgatggaggaggagggcgctgtgattgtgggcctgctggtgggcctgaatgtgattgatgccaacctgtgtgtgaagggggaggacctggacagccaggtgggcgtgattgacttctccatgtacctgaagaatgaagaagatattggcaacaaggagagaaatgtgcagattgctgccatcctggaccagaagaactacgtggaggagctgaaccggcagctgaacagcacagtgagcagcctgcacagccgggtggacagcctggagaagagcaacaccaagctgattgaggagctggccatcgccaagaacaacatcatcaagctgcaggaggagaaccaccagctgcggtctgagaacaagctgatcctgatgaagacccagcagcacctggaggtgaccaaggtggatgtggagacagagctgcagacctacaagcacagccggcagggcctggatgagatgtacaatgaggcccggcggcagctgagagatgagagccagctgcggcaggatgtggagaatgagctggccgtgcaggtgtccatgaagcatgaaattgagctggccatgaagctgctggagaaggacatccacgagaagcaggacaccctgattggcctgcggcagcagctggaggaggtgaaggccatcaacatcgagatgtaccagaagctgcagggctctgaagatggcctgaaggagaagaatgagatcatcgcccggctggaggagaagaccaacaagatcacagctgccatgaggcagctggagcagaggctgcagcaggccgagaaggcccagatggaggctgaagatgaagatgagaagtacctgcaggagtgcctgagcaagagtgacagcctgcagaagcagatcagccagaaggagaagcagctggtgcagctggagacagacctgaagattgagaaggagtggaggcagaccctgcaggaggacctgcagaaggagaaggatgccctgagccacctgagaaatgagacccagcagatcatcagcctgaagaaggagttcctgaacctgcaggatgagaaccagcagctgaagaagatctaccacgagcaggagcaggccctgcaggagctgggcaacaagctgtctgagagcaagctgaagattgaggacatcaaggaggccaacaaggccctgcagggcctggtgtggctgaaggacaaggaggccacccactgcaagctgtgtgagaaggagttcagcctgagcaagaggaagcaccactgcaggaactgtggggagatcttctgcaatgcctgcagcgacaatgagctgcccctgcccagcagccccaagcctgtgcgggtgtgtgacagctgccacgccctgctgatccagcgctgcagcagcaacctgccctag

SEQ ID NO: 42014 - DNA, 1212 bp, Artificial Sequence
  Description of Artificial Sequence: Synthetic coding sequence
atggccaccaaggaccccacagctgtggagcgggccaacctgctgaacatggccaagctgagcatcaagggcctcatcgagagcgccctgagctttggccgcaccctggacagcgactacccacccctgcagcagttctttgtggtgatggagcactgcctgaagcacggcctgaaggtgaggaagagcttcctgagctacaacaagaccatctggggccccctggagctggtggagaagctgtacccagaggccgaggagatcggggcctctgtgcgggacctgcccggcctgaatgagttctatgagtaccacgccctgatgatggaggaggagggcgccgtcatcgtgggcctgctggtgggcctgaatgtgattgatgccaacctgtgtgtgaagggggaggacctggacagccaggtgggcgtcatcgacttctccatgtacctgaagaatgaggaggacatcggcaacaaggagagaaatgtgcagattgctgccatcctggaccagaagaactacgtggaggagctgaaccggcagctgaacagcacagtgagcagcctgcacagccgggtggacagcctggagaagagcaacaccaagctgattgaggagctggccatcgccaagaacaacatcatcaagctgcaggaggagaaccaccagctgcggtctgagaacaagctgatcctgatgaagacccagcagcacctggaggtgaccaaggtggatgtggagacagagctgcagacctacaagcacagccggcagggcctggatgagatgtacaatgaggcccggcggcagctgagagatgagagccagctgcggcaggatgtggagaatgagctggccgtgcaggtgtccatgaagcatgaaattgagctggccatgaagctgctggagaaggacatccacgagaagcaggacaccctcatcggcctgcggcagcagctggaggaggtgaaggccatcaacatcgagatgtaccagaagctgcagggctctgaagatggcctgaaggagaagaatgagatcatcgcccggctggaggagaagaccaacaagatcacagctgccatgaggcagctggagcagagcgacaatgacctgctgacccagaccaggaccatcgccatgagcctggtgaagtgtgccagcagtgacacccaggaccagtacaagctggtgaaggacatctccttctag

SEQ ID NO: 42015 - DNA, 1140 bp, Artificial Sequence
  Description of Artificial Sequence: Synthetic coding sequence
atggtgaggaagagcttcctgagctacaacaagaccatctggggccccctggagctggtggagaagctgtacccagaggccgaggagatcggggcctctgtgcgggacctgcccggcctgaagacccccctgggccgggcccgggcctggctgcggctggccctgatgcagaagaagatggctgactacctgcgctgcctgatcatccagagggacctgctgtctgagttctatgagtaccacgccctgatgatggaggaggagggcgccgtcatcgtgggcctgctggtgggcctgaatgtgattgatgccaacctgtgtgtgaagggggaggacctggacagccaggtgggcgtcatcgacttctccatgtacctgaagaatgaggaggacatcggcaacaaggagagaaatgtgcagattgctgccatcctggaccagaagaactacgtggaggagctgaaccggcagctgaacagcacagtgagcagcctgcacagccgggtggacagcctggagaagagcaacaccaagctgattgaggagctggccatcgccaagaacaacatcatcaagctgcaggaggagaaccaccagctgcggtctgagaacaagctgatcctgatgaagacccagcagcacctggaggtgaccaaggtggatgtggagacagagctgcagacctacaagcacagccggcagggcctggatgagatgtacaatgaggcccggcggcagctgagagatgagagccagctgcggcaggatgtggagaatgagctggccgtgcaggtgtccatgaagcatgaaattgagctggccatgaagctgctggagaaggacatccacgagaagcaggacaccctcatcggcctgcggcagcagctggaggaggtgaaggccatcaacatcgagatgtaccagaagctgcagggctctgaagatggcctgaaggagaagaatgagatcatcgcccggctggaggagaagaccaacaagatcacagctgccatgaggcagctggagcagagcgacaatgacctgctgacccagaccaggaccatcgccatgagcctggtgaagtgtgccagcagtgacacccaggaccagtacaagctggtgaaggacatctccttctag

SEQ ID NO: 42016 - DNA, 2529 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgacagcgtgtgccgctatgacctgaatgacatggatgctgcctggctggagctgaccaatgaggagttcaaggagatgggcatgcctgagctggatgagtacaccatggagcgggtgctggaggagtttgagcagcgctgctatgacaacatgaaccacgccatcgagacagaggagggcctgggcatcgagtatgatgaagatgtggtgtgtgatgtgtgccagagcccagatggagaagatggaaatgagatggtgttctgtgacaagtgcaacatctgtgtgcaccaggcctgctacggcatcctgaaggtgcctgagggctcctggctgtgcaggacctgtgccctgggcgtgcagcccaagtgcctgctgtgccccaagaagggcggggccatgaagcccaccaggagcggcaccaagtgggtgcacgtgtcctgtgccctgtggatccctgaggtgtccatcggcagccctgagaagatggagcccatcaccaaggtgagccacatccccagcagccgctgggccctggtgtgcagcctgtgcaatgagaagtttggagccagcatccagtgcagcgtgaagaactgcaggacagccttccacgtgacctgtgcctttgaccggggcctggagatgaagaccatcctggctgaaaatgatgaggtgaagttcaagagctactgccccaagcacagcagccacaggaagccagaggagagcctgggcaagggggccgcccaggagaatggagcccctgagtgcagccccaggaaccccctggagccctttgccagcctggagcagaaccgggaggaggcccaccgggtgtctgtgaggaagcagaagctgcagcagctggaggatgagttctacacctttgtgaacctgctggatgtggcccgggccctgcggctgcctgaggaggtggtggacttcctgtaccagtactggaagctgaagaggaaggtgaacttcaacaagcccctcatcacccccaagaaggatgaggaggacaacctggccaagcgggagcaggatgtgctcttccggcggctgcagctgttcacccacctgcggcaggacctggagcgggtgaggaacctgacctacatggtgacccggcgggagaagatcaagaggtctgtgtgcaaggtgcaggagcagatcttcaacctgtacaccaagctgctggagcaggagcgggtgtctggagtgcccagcagctgcagcagcagcagcctggagaacatgctgctcttcaacagccccagcgtgggcccagatgcccccaagattgaggacctgaagtggcacagcgccttcttcaggaagcagatgggcaccagcctggtgcacagcctgaagaagccccacaagagggaccccctgcagaacagccctggcagcgagggcaagaccctgctgaagcagcctgacctgtgtggccggcgggagggcatggtggtgcctgagagcttcctgggcctggagaagacctttgctgaggcccggctcatcagcgcccagcagaagaatggagtggtgatgccagaccacggcaagagaagagacaaccgcttccactgtgacctgatcaagggggacctgaaggacaagagcttcaagcagagccacaagcccctgcggagcacagatgtgtcccagaggcacctggacaacacccgggccgccaccagccctggggtgggccagagcgcccctggcaccaggaaggagatcgtgcccaagtgcaatggcagcctcatcaaggtgaactacaaccagacagctgtgaaggtgcccaccaccccagccagccctgtgaagaactggggcggcttccgcatccccaagaagggggagcggcagcagcagggcgaggcccatgatggagcctgccaccagcacagcgactacccctacctgggcctgggccgggtgcctgccaaggagcgggccaagagcaagctgaagagtgacaatgaaaatgatggctacgtgcctgatgtggagatgtctgacagcgagagcgaggccagcgagaagaagtgcatccacaccagcagcaccatcagcagaagaacagacatcatccgccgcagcatcctggccagctag

SEQ ID NO: 42017 - DNA, 1521 bp, Artificial Sequence
  Description of Artificial Sequence: Synthetic coding sequence
atggccgagaccccacctccacccacagctggagctgagagctgcagcgaggagcccgcccggggcggggagtggaggcctgaggagccccggcgggccccagctgggggcacagaccgggagggggaggccggccccccaccagccagccctgctggccagagcgagccagacagccctgtggccgcccccttcttcctgctgtacccaggagatggaggagctggctttggagtgcggcccccaccccagcagcagaggtcctggaggaccccacccagccctggcagccccctgcccttcctgctgctgagctaccccagcggcggcggcggcagcagcggcagcggcaagcaccaccccaactacctgatggccaatgaaagaatgaacctgatgaacatggccaagctgagcatcaagggcctcatcgagagcgccctgaacctgggccgcaccctggacagcgactatgcccccctgcagcagttctttgtggtgatggagcactgcctgaagcacggcctgaaggccaagaagaccttcctgggccagaacaagagcttctggggccccctggagctggtggagaagctggtgcctgaggccgctgagatcacagcctctgtgaaggacctgcccggcctgaagacccctgtgggccggggccgggcctggctgcggctggccctgatgcagaagaagctgtctgagtacatgaaggccctgatcaacaagaaggagctgctgtctgagttctatgagcccaatgccctgatgatggaggaggagggcgccatcatcgccggcctgctggtgggcctgaatgtgattgatgccaacttctgcatgaagggggaggacctggacagccaggtgggcgtcatcgacttctccatgtacctgaaggatggcaacagcagcaaaggaacagaaggagatggccagatcacagccatcctggaccagaagaactacgtggaggagctgaacagacacctgaatgccaccgtgaacaacctgcaggccaaggtggatgccctggagaagagcaacaccaagctgacagaggagctggccgtggccaacaaccgcatcatcaccctgcaggaggagatggagcgggtgaaggaggagagcagctacatcctggagagcaacaggaagggccccaagcaggacagaacagctgagggccaggccctgtctgaggccaggaagcacctgaaggaggagacccagctgcggctggatgtggagaaggagctggagatgcagatctccatgaggcaggagatggagctggccatgaagatgctggagaaggatgtgtgtgagaagcaggatgccctggtgtccctgcggcagcagctggatgacctgcgggccctgaagcatgagctggccttcaagctgcagagcagtgacctgggcgtgaagcagaagtctgagctgaacagccggctggaggagaagaccaaccagatggccgccaccatcaagcagctggagcagaggtag

SEQ ID NO: 42018 - DNA, 297 bp, Artificial Sequence
  Description of Artificial Sequence: Synthetic coding sequence
atggccgagaccccacctccacccacagctggagctgagagctgcagcgaggagcccgcccggggcggggagtggaggcctgaggagccccggcgggccccagctgggggcacagaccgggagggggaggccggccccccaccagccagccctgctggccagagcgagccagacagccctgtggccgcccccttcttcctgctgtacccaggagatggaggagctggctttggagtgcggcccccaccccagcagcagaggtcctggaggaccccacccagccctggcagcccctag

SEQ ID NO: 42019 - DNA, 1362 bp, Artificial Sequence
  Description of Artificial Sequence: Synthetic coding sequence
atggatggagagtggctgtgcctgcgggagctggatgacatcagcctgaccccagaccctgagcccacccatgaagattcctgggaggacctgacagacctggtggagcagatgagagatgacacagaggaccccaactacctgatggccaatgaaagaatgaacctgatgaacatggccaagctgagcatcaagggcctcatcgagagcgccctgaacctgggccgcaccctggacagcgactatgcccccctgcagcagttctttgtggtgatggagcactgcctgaagcacggcctgaaggccaagaagaccttcctgggccagaacaagagcttctggggccccctggagctggtggagaagctggtgcctgaggccgctgagatcacagcctctgtgaaggacctgcccggcctgaagacccctgtgggccggggccgggcctggctgcggctggccctgatgcagaagaagctgtctgagtacatgaaggccctgatcaacaagaaggagctgctgtctgagttctatgagcccaatgccctgatgatggaggaggagggcgccatcatcgccggcctgctggtgggcctgaatgtgattgatgccaacttctgcatgaagggggaggacctggacagccaggtgggcgtcatcgacttctccatgtacctgaaggatggcaacagcagcaaaggaacagaaggagatggccagatcacagccatcctggaccagaagaactacgtggaggagctgaacagacacctgaatgccaccgtgaacaacctgcaggccaaggtggatgccctggagaagagcaacaccaagctgacagaggagctggccgtggccaacaaccgcatcatcaccctgcaggaggagatggagcgggtgaaggaggagagcagctacatcctggagagcaacaggaagggccccaagcaggacagaacagctgagggccaggccctgtctgaggccaggaagcacctgaaggaggagacccagctgcggctggatgtggagaaggagctggagatgcagatctccatgaggcaggagatggagctggccatgaagatgctggagaaggatgtgtgtgagaagcaggatgccctggtgtccctgcggcagcagctggatgacctgcgggccctgaagcatgagctggccttcaagctgcagagcagtgacctgggcgtgaagcagaagtctgagctgaacagccggctggaggagaagaccaaccagatggccgccaccatcaagcagctggagcagagcgagaaggacctggtgaagcaggccaagaccctgaacagcgctgccaacaagctgatccccaagcaccactag

SEQ ID NO: 42020 - DNA, 1863 bp, Artificial Sequence
  Description of Artificial Sequence: Synthetic coding sequence
atgtctgccctgaccccacccacagacatgcccacccccaccacagacaagatcacccaggccgccatggagaccatctacctgtgcaagttccgggtgtccatggatggagagtggctgtgcctgcgggagctggatgacatcagcctgaccccagaccctgagcccacccatgaggaccccaactacctgatggccaatgaaagaatgaacctgatgaacatggccaagctgagcatcaagggcctcatcgagagcgccctgaacctgggccgcaccctggacagcgactatgcccccctgcagcagttctttgtggtgatggagcactgcctgaagcacggcctgaaggccaagaagaccttcctgggccagaacaagagcttctggggccccctggagctggtggagaagctggtgcctgaggccgctgagatcacagcctctgtgaaggacctgcccggcctgaagacccctgtgggccggggccgggcctggctgcggctggccctgatgcagaagaagctgtctgagtacatgaaggccctgatcaacaagaaggagctgctgtctgagttctatgagcccaatgccctgatgatggaggaggagggcgccatcatcgccggcctgctggtgggcctgaatgtgattgatgccaacttctgcatgaagggggaggacctggacagccaggtgggcgtcatcgacttctccatgtacctgaaggatggcaacagcagcaaaggaacagaaggagatggccagatcacagccatcctggaccagaagaactacgtggaggagctgaacagacacctgaatgccaccgtgaacaacctgcaggccaaggtggatgccctggagaagagcaacaccaagctgacagaggagctggccgtggccaacaaccgcatcatcaccctgcaggaggagatggagcgggtgaaggaggagagcagctacatcctggagagcaacaggaagggccccaagcaggacagaacagctgagggccaggccctgtctgaggccaggaagcacctgaaggaggagacccagctgcggctggatgtggagaaggagctggagatgcagatctccatgaggcaggagatggagctggccatgaagatgctggagaaggatgtgtgtgagaagcaggatgccctggtgtccctgcggcagcagctggatgacctgcgggccctgaagcatgagctggccttcaagctgcagagcagtgacctgggcgtgaagcagaagtctgagctgaacagccggctggaggagaagaccaaccagatggccgccaccatcaagcagctggagcagaggctgcggcaggccgagaggagccggcagagcgctgagctggacaacagactcttcaagcaggactttggagacaagatcaacagcctgcagctggaggtggaggagctgacccggcagaggaaccagctggagctggagctgaagcaggagaaggagcggcggctgcagaatgacaggagcatccctggccggggcagccagaagtctgagagcaagatggatggcaagcacaagatgcaggaggagaatgtgaagctgaagaagcccctggaggagagccaccggctgcagccccaccccatggatgagcaggaccagctgctgctgtctgagaagccccagctgtgccagctgtgccaggaggatggcagcctgaccaagaatgtgtgcaagaactgcagcggcaccttctgtgatgcctgcagcaccaatgagctgcccctgcccagcagcatcaagctggagcgggtgtgcaacccctgccacaagcacctgatgaagcagtacagcaccagccccagctag

SEQ ID NO: 42021 - DNA, 1716 bp, Artificial Sequence
  Description of Artificial Sequence: Synthetic coding sequence
atggccgaggagggcgccatcctgaaggtgaccaaggacctgcgggctgctgtgtctgccatcctgcagggctatggagatggccagggccctgtgacagacaccagcgctgagctgcaccggctgtgtggctgcctggagctgctgctgcagtttgaccagaaggagcagaagagcttcctgggccccaggaaggactactgggacttcctgtgcacagccctgcggcggcagaggggcaacatggagcccatccactttgtgcgcagccaggacaagctgaagacccccctgggcaagggccgggccttcatccgcttctgcctggcccggggccagctggccgaggccctgcagctgtgcctgctgaacagcgagctgacccgggagtggtacggccccaggagccccctgctgtgcccagagcggcaggaggacatcctggacagcctgtatgccctgaatggagtggcctttgagctggacctgcagcagcctgacctggatggagcctggcccatgttcagcgagagccgctgcagcagcagcacccagacccagggcagaagacccaggaagaacaaggatgcccccaagaagatcccagctgcctatggaggcccagaaaatgtgcagatcgaggacagccacaccagccaggccatctgcctgcaggatgcccccagcggccagcagctggccggcctgcccaggagccagcagcagaggcacctgcccttcttcctggagaagaagggggagagcagcaggaagcaccgctacccccagagcatgtgggagcctgagggcaaggagctgcagctggaccaggaggagcgggccccctggattgagatcttcctgggcaacagcacccccagcacccagggccagggcaagggggccatgggcacccagaaggaggtgattggcatggaggccgaggtgactggagtgctgctggtggccgagggccagaggaccacagagggcacccacaagaaggaggccgagtggagccacgtgcagaggctgctgatgcccagccccagaggagctgtggagggcgctgtgtctggcagccggcagggcagcggcggcagcagcatcctgggggagccctgggtgctgcagggccacgccaccaaggaggacagcacagtggagaacccccaggtgcagacagaggtgaccctggtggcccggcgggaggagcaggccgaggtgtccctgcaggatgagatcaagagcctgcggctgggcctgaggaaggccgaggagcaggcccagaggcaggagcagctgctgcgggagcaggagggggagctgcaggccctgcgggagcagctgagccgctgccaggaggagcgggcagagctgcaggcccagctggagcagaagcagcaggaggccgagaggagagatgccatgtaccaggaggagctgggcggccagagggacctggtgcaggccatgaagagaagagtgctggagctgatccaggagaaggaccggctgtggcagaggctgcagcacctgagctccatggcccctgagtgctgcgtggcctgcagcaagatcttcggccgcttcagccgccgctacccctgccgcctgtgtggcggcctgctgtgccacgcctgcagcatggactacaagaagagggaccgctgctgccccccctgtgcccagggccgggaggcccaggtgacctag

SEQ ID NO: 42022 - DNA, 1824 bp, Artificial Sequence
  Description of Artificial Sequence: Synthetic coding sequence
atggccgaggagggcgccatcctgaaggtgaccaaggacctgcgggctgctgtgtctgccatcctgcagggctatggagatggccagggccctgtgacagacaccagcgctgagctgcaccggctgtgtggctgcctggagctgctgctgcagtttgaccagaaggagcagaagagcttcctgggccccaggaaggactactgggacttcctgtgcacagccctgcggcggcagaggggcaacatggagcccatccactttgtgcgcagccaggacaagctgaagacccccctgggcaagggccgggccttcatccgcttctgcctggcccggggccagctggccgaggccctgcagctgtgcctgctgaacagcgagctgacccgggagtggtacggccccaggagccccctgctgtgcccagagcggcaggaggacatcctggacagcctgtatgccctgaatggagtggcctttgagctggacctgcagcagcctgacctggatggagcctggcccatgttcagcgagagccgctgcagcagcagcacccagacccagggcagaagacccaggaagaacaaggatgcccccaagaaggtgcccctgccctgcctgcacagcgagctgcccctgccccacctgctgggcatcctgaagatcccagctgcctatggaggcccagaaaatgtgcagatcgaggacagccacaccagccaggccatctgcctgcaggatgcccccagcggccagcagctggccggcctgcccaggagccagcagcagaggcacctgcccttcttcctggagaagaagggggagagcagcaggaagcaccgctacccccagagcatgtgggagcctgagggcaaggagctgcagctggaccaggaggagcgggccccctggattgagatcttcctgggcaacagcacccccagcacccagggccagggcaagggggccatgggcacccagaaggaggtgattggcatggaggccgaggtgactggagtgctgctggtggccgagggccagaggaccacagagggcacccacaagaaggaggccgagtggagccacgtgcagaggctgctgatgcccagccccagaggagctgtggagggcgctgtgtctggcagccggcagggcagcggcggcagcagcatcctgggggagccctgggtgctgcagggccacgccaccaaggaggacagcacagtggagaacccccaggtgcagacagaggtgaccctggtggcccggcgggaggagcaggccgaggtgtccctgcaggatgagatcaagagcctgcggctgggcctgaggaaggccgaggagcaggcccagaggcaggagcagctgctgcgggagcaggagggggagctgcaggccctgcgggagcagctgagccgctgccaggaggagcgggcagagctgcaggcccagctggagcagaagcagcaggaggccgagaggagagatgccatgtaccaggaggagctgggcggccagagggacctggtgcaggccatgaagagaagagtgctggagctgatccaggagaaggaccggctgtggcagaggctgcagcacctgagctccatggcccctgagtgctgcgtggcctgcagcaagatcttcggccgcttcagccgccgctacccctgcagcgcccggaccagcctgggccgggaggagagcgagcccccaggagaggccgccatgtggcgctggaggctgtggaggggccgggccagcggccaccccagcggggagggccggcccccagagaccaaccagggccacagcactggaagatag

SEQ ID NO: 42023 - DNA, 519 bp, Artificial Sequence
  Description of Artificial Sequence: Synthetic coding sequence
atggccgaggagggcgccatcctgaaggtgaccaaggacctgcgggctgctgtgtctgccatcctgcagggctatggagatggccagggccctgtgacagacaccagcgctgagctgcaccggctgtgtggctgcctggagctgctgctgcagtttgaccagaaggagcagaagagcttcctgggccccaggaaggactactgggacttcctgtgcacagccctgcggcggcagaggggcaacatggagcccatccactttgtgcgcagccaggacaagggcatggtgtggaccccagagcccagcgccctgcccaggaccccaagaagacaccctggcctgagcctgtgcagccagtggggcggcctgcgggtgggccccccagctgcccggcccggctggagcctggcccacgtgctgcgggtgaccctgctgcagttccaccccaaccctgggaaggagacccagaagaagcagcgctgccccaaggaggaccccagccgcatctggagggcctag

SEQ ID NO: 42024 - DNA, 1842 bp, Artificial Sequence
  Description of Artificial Sequence: Synthetic coding sequence
atggctgctgtggaggccgctgctgagcctgtgacagtggtggccgctgtgggccccaaggccaaggatgaggaggaggaggaggaggagcccctgcccccctgtgaggccgtgcgctgggcccctgtgggcgctgtggccgaggcccggcctggggccacagccttcctggaggaggccacagctgaggagcctggagctgcccctggcagccccccagacagccctggccgcaccctgcggcggctgcgggcagagcggcggcggctggacagcgccctgctggccctgagcagccactttgcccaggtgcagttccggctgcggcaggtggtgcggggggccccagctgagcagcagaggctgctgcgggagctggaggactttgccttccggggctgcccccacgtgctgggctatgagggccctggggaccctgccagtgatgaaggagatggcctgcccggggaccggccctggctgcggggggaggaccagagcgagcaggagaagcaggagcggctggagacccagcgggagaagcagaaggagctgatcctgcagctgaagacccagctggatgacctggagacctttgcctaccaggagggcagctatgacagcctgccccagagcgtggtgctggagcggcagagggtcatcattgatgagctgatcaagaagctggacatgaacctgaatgaagacatcagcagcctgagcacagaggagctgcggcagagggtggatgctgctgtggcccagatcgtgaacccagcccgggtgaaggagcagctggtggagcagctgaagacccagatccgggacctggagatgttcatcaacttcatccaggatgaggtgggcagccccctgcagacaggaggcggccactgtgagtgcaaggccggcggcaagacaggaaatggctgcagcaggacaggcagcagcaggaccccacctggcaacagcaagaccaaggcagaagatgtgaagaaggtgcgggagaccggcctgcacctgatgagaagagccctggccgtgctgcagatctttgctgtgtcccagtttggctgtgccaccggccagatcccccccaccctgtggcagagggtgcaggccgaccgggactacagccccctgctgaagaggctggaggtgtctgtggacagagtgaagcagctggccctgcggcagcagccccatgaccacgtgatcaccagcgccaacctgcaggacctgagcctgggcggcaaggatgagctgaccatggctgtgaggaaggagctgactgtggccgtgcgggacctgctggcccacggcctgtatgccagcagccctggcatgagcctggtgatggcccccatcgcctgcctgctgcctgccttcagcagcgcccctgaggccatgcacccctgggagctgtttgtgaagtactaccacgccaagaatggccgggcctacgtggagagccctgccaggaagctgagccagagctttgccctgcctgtgactggaggcaccgtggtgacccccaagcagagcctgctgacagccatccacatggtgctgacagaacatgaccccttcaagaggtctgctgacagcgagctgaaggccctggtgtgcatggccctgaatgagcagaggctggtgtcctgggtgaacctgatctgcaagagcggcagcctgattgagccccactaccagccctggagctacatggcccacacaggctttgagagcgccctgaacctgctgagccggctgagcagcctgaagttcagcctgcctgtggacctggccgtgcggcagctgaagaacatcaaggatgccttctag

SEQ ID NO: 42025 - DNA, 1422 bp, Artificial Sequence
  Description of Artificial Sequence: Synthetic coding sequence
atggccagccgcagcctgggcggcctgagcggcatccggggcggcggcggcggcggcggcaagaagagcctgagcgccagaaatgctgctgtggagaggaggaacctgatcaccgtgtgccgcttctctgtgaagaccctgattgacaggagctgctttgagaccattgatgacagcagccctgagttcaacaactttgctgccatcctggagcagatcctgagccaccggctgaaggagatcagccagagctgccgctggctggcccacctgcagatccccctgcagggccaggtgacctggtttggctatgagagccccaggagcttctgggactacatccgggtggcctgcaggaaggtgtcccagaactgcatctgcagcattgagaacatggagaatgtgagcagcagccgggccaagggccgggcctggatccgggtggccctgatggagaagcacctgtctgagtacatcagcacagccctgcgggacttcaagaccacccggcgcttctatgaagatggagccatcgtgctgggggaggaggccaacatgctggccggcatgctgctgggcctgaatgccatcgacttctccttctgcctgaagggggagggcctggatggcagcttccctgctgtgattgactacaccccctacctgaagtacatccagagcagtgacagcatcagcagtgatgaggaggagctgcggaccctgggcagcagcggcagcgagagcagcaccccagaaaatgtgggcccccccttcctgatggatgagaacagctggttcaacaagtgcaagagggtgaagcagaagtaccagctgaccctggagcagaagggctacctggaggagctgctgcggctgcgggagaaccagctgtctgagagcgtgtcccagaacaagatcctgctgcagagaattgaggacagcgacctggcccacaagctggagaaggagcagctggagtacatcatcgtggagctgcaggaccagctgactgtgctgaagaacaatgacctgcggagccggcaggagctgacagcccacctgaccaaccagtggcccagccctggggccctggatgtgaatgctgtggccctggacaccctgctgtacaggaagcacaacaagcagtggtatgagaagagctaccagagcctggaccagctgtctgctgaggtgtccctgagccagaccagcctggaccccggccagagccaggagggagatggcaagcaggacaccctgaatgtgatgtctgagggcaaggaggacacccccagcctgctgggcctgtgtggcagcctgacctctgtggccagctacaagagcctgaccagcctgaagagcaatgactacctggccagccccaccacagagatgaccagccctggcctgacccccagctag

SEQ ID NO: 42026 - DNA, 1371 bp, Artificial Sequence
  Description of Artificial Sequence: Synthetic coding sequence
atggccagccgcagcctgggcggcctgagcggcatccggggcggcggcggcggcggcggcaagaagagcctgagcgccagaaatgctgctgtggagaggaggaacctgatcaccgtgtgccgcttctctgtgaagaccctgattgacaggagctgctttgagaccattgatgacagcagccctgagttcaacaactttgctgccatcctggagcagatcctgagccaccggctgaagggccaggtgacctggtttggctatgagagccccaggagcttctgggactacatccgggtggcctgcaggaaggtgtcccagaactgcatctgcagcattgagaacatggagaatgtgagcagcagccgggccaagggccgggcctggatccgggtggccctgatggagaagcacctgtctgagtacatcagcacagccctgcgggacttcaagaccacccggcgcttctatgaagatggagccatcgtgctgggggaggaggccaacatgctggccggcatgctgctgggcctgaatgccatcgacttctccttctgcctgaagggggagggcctggatggcagcttccctgctgtgattgactacaccccctacctgaagtacatccagagcagtgacagcatcagcagtgatgaggaggagctgcggaccctgggcagcagcggcagcgagagcagcaccccagaaaatgtgggcccccccttcctgatggatgaaaattcctggttcaacaagtgcaagagggtgaagcagaagtaccagctgaccctggagcagaagggctacctggaggagctgctgcggctgcgggagaaccagctgtctgagagcgtgtcccagaacaagatcctgctgcagagaattgaagattctgacctggcccacaagctggagaaggagcagctggagtacatcatcgtggagctgcaggaccagctgactgtgctgaagaacaatgacctgcggagccggcaggagctgacagcccacctgaccaaccagtggcccagccctggggccctggatgtgaatgctgtggccctggacaccctgctgtacaggaagcacaacaagcagtggtatgagaagagctaccagagcctggaccagctgtctgctgaggtgtccctgagccagaccagcctggaccccggccagagccaggagggagatggcaagcaggacaccctgaatgtgatgtctgagggcaaggaggacacccccagcctgctgggcctgtgtggcagcctgacctctgtggccagctacaagagcctgaccagcctgaagagcaatgactacctggccagccccaccacagagatgaccagccctggcctgacccccagctag

SEQ ID NO: 42027 - DNA, 1224 bp, Artificial Sequence
  Description of Artificial Sequence: Synthetic coding sequence
atggccagccgcagcctgggcggcctgagcggcatccggggcggcggcggcggcggcggcaagaagagcctgagcgccagaaatgctgctgtggagaggaggaacctgatcaccgtgtgccgcttctctgtgaagaccctgattgacaggagctgctttgagaccattgatgacagcagccctgagttcaacaactttgctgccatcctggagcagatcctgagccaccggctgaagggccaggtgacctggtttggctatgagagccccaggagcttctgggactacatccgggtggcctgcaggaaggtgtcccagaactgcatctgcagcattgagaacatggagaatgtgagcagcagccgggccaagggccgggcctggatccgggtggccctgatggagaagcacctgtctgagtacatcagcacagccctgcgggacttcaagaccacccggcgcttctatgaagatggagccatcgtgctgggggaggaggccaacatgctggccggcatgctgctgggcctgaatgccatcgacttctccttctgcctgaagggggagggcctggatggcagcttccctgctgtgattgactacaccccctacctgaagtacatccagagcagtgacagcatcagcagtgatgaggaggagctgcggaccctgggcagcagcggcagcgagagcagcaccccagaaaatgtgggcccccccttcctgatggatgaaaattcctggttcaacaagtgcaagagggtgaagcagaagtaccagctgaccctggagcagaagggctacctggaggagctgctgcggctgcgggagaaccagctgtctgagagcgtgtcccagaacaagatcctgctgcagagaattgaagattctgacctggcccacaagctggagaaggagcagctggagtacatcatcgtggagctgcaggaccagctgaagagctaccagagcctggaccagctgtctgctgaggtgtccctgagccagaccagcctggaccccggccagagccaggagggagatggcaagcaggacaccctgaatgtgatgtctgagggcaaggaggacacccccagcctgctgggcctgtgtggcagcctgacctctgtggccagctacaagagcctgaccagcctgaagagcaatgactacctggccagccccaccacagagatgaccagccctggcctgacccccagctag

SEQ ID NO: 42028 - DNA, 156 bp, Artificial Sequence
  Description of Artificial Sequence: Synthetic coding sequence
atggtgatgatcttcaccctggtgacagctgtgcaggagaagctgaatgagatcgtggaccagatcaagacccggcgggaggaggagaagaagcagaaggagaaggaggccgaggaggccgagaagcagctgttccacggcacccctgtgacctag

SEQ ID NO: 42029 - DNA, 444 bp, Artificial Sequence
  Description of Artificial Sequence: Synthetic coding sequence
atggtgatgatcttcaccctggtgacagctgtgcaggagaagctgaatgagatcgtggaccagatcaagacccggcgggaggaggagaagaagcagaaggagaaggaggccgaggaggccgagaagcagctgttccacggcacccctgtgaccatcgagaacttcctgaactggaaggccaagtttgatgctgagctgctggagatcaagaagaagaggatgaaggaggaggagcaggccggcaagaacaagctgagcggcaagcagctgtttgaaacagaccacaacctggacaccagtgacatccagttcctggaggatgctggcaacaacgtggaggtggatgagagcctcttccaggagatggatgacctggagctggaggatgatgaagatgatcctgactacaacccagctgaccctgagagtgacagcgctgactag

SEQ ID NO: 42030 - DNA, 732 bp, Artificial Sequence
  Description of Artificial Sequence: Synthetic coding sequence
atgacagattatggagaggagcagagaaatgagctggaggccctggagagcatctacccagacagcttcaccgtgctgtctgagaacccccccagcttcaccatcaccgtgaccagcgaggccggagaaaatgatgaaacagtgcagaccaccctgaagttcacctacagcgagaagtacccagatgaggcccccctgtatgagatcttcagccaggagaacctggaggacaatgatgtgtctgacatcctgaagctgctggccctgcaggccgaggagaacctgggcatggtgatgatcttcaccctggtgacagctgtgcaggagaagctgaatgagatcgtggaccagatcaagacccggcgggaggaggagaagaagcagaaggagaaggaggccgaggaggccgagaagcagctgttccacggcacccctgtgaccatcgagaacttcctgaactggaaggccaagtttgatgctgagctgctggagatcaagaagaagaggatgaaggaggaggagcaggccggcaagaacaagctgagcggcaagcagctgtttgaaacagaccacaacctggacaccagtgacatccagttcctggaggatgctggcaacaacgtggaggtggatgagagcctcttccaggagatggatgacctggagctggaggatgatgaagatgatcctgactacaacccagctgaccctgagagtgacagcgctgactag

SEQ ID NO: 42031 - DNA, 204 bp, Artificial Sequence
  Description of Artificial Sequence: Synthetic coding sequence
atggtgatgatcttcaccctggtgacagctgtgcaggagaagctgaatgagatcgtggaccagatcaagacccggcgggaggaggagaagaagcagaaggagaaggaggccgaggaggccgagaagcagctgttccacggcacccctgtgaccatcgagaacttcctgaactggaaggccaagtttgatgctgagctgctgtag

SEQ ID NO: 42032 - DNA, 444 bp, Artificial Sequence; identical to SEQ ID NO: 42029
  Description of Artificial Sequence: Synthetic coding sequence

SEQ ID NO: 42033 - DNA, 219 bp, Artificial Sequence
  Description of Artificial Sequence: Synthetic coding sequence
atggtgatgatcttcaccctggtgacagctgtgcaggagaagctgaatgagatcgtggaccagatcaagacccggcgggaggaggagaagaagcagaaggagaaggaggccgaggaggccgagaagcagctgttccacggcacccctgtgaccatcgagaacttcctgaactggaaggccaagtttgatgctgagctgctggagatcaagaagaagtag

SEQ ID NO: 42034 - DNA, 879 bp, Artificial Sequence
  Description of Artificial Sequence: Synthetic coding sequence
atgtctgcctctgtgaaggagagcctgcagctgcagctgctggagatggagatgctgttctccatgttccccaaccagggcgaggtgaagctggaggatgtgaatgccctgaccaacatcaagcgctacctggagggcacccgggaggccctgccccccaagattgaatttgtgatcaccctgcagatcgaggagcccaaggtgaagattgacctgcaggtgaccatgccccacagctacccctacgtggccctgcagctgtttggccgcagcagcgagctggacagacaccagcagctgctgctgaacaagggcctgaccagctacatcggcacctttgatcctggagagctgtgtgtgtgtgccgccatccagtggctgcaggacaacagcgccagctacttcctgaacaggaagctggtgtatgagcccagcacccaggccaagcctgtgaagaacaccttcctgaggatgtggatctacagccaccacatctaccagcaggacctgaggaagaagatcctggatgtgggcaagaggctggatgtgacaggcttctgcatgaccgggaagccaggcatcatctgtgtggagggcttcaaggagcactgtgaggagttctggcacaccatccgctaccccaactggaagcacatcagctgcaagcacgccgagagcgtggagacagagggcaatggagaggacctgcggctcttccacagctttgaggagctgctgctggaggcccacggggactatggcctgagaaatgactaccacatgaacctgggccagttcctggagttcctgaagaagcacaagtcagaacatgtgttccagatcctgtttggaattgagagcaagagcagtgacagctag

SEQ ID NO: 42035 - DNA, 717 bp, Artificial Sequence
  Description of Artificial Sequence: Synthetic coding sequence
atgctgtggtacctgaacctgtttgacttccacttcaaggtgaagattgacctgcaggtgaccatgccccacagctacccctacgtggccctgcagctgtttggccgcagcagcgagctggacagacaccagcagctgctgctgaacaagggcctgaccagctacatcggcacctttgatcctggagagctgtgtgtgtgtgccgccatccagtggctgcaggacaacagcgccagctacttcctgaacaggaagctggtgtatgagcccagcacccaggccaagcctgtgaagaacaccttcctgaggatgtggatctacagccaccacatctaccagcaggacctgaggaagaagatcctggatgtgggcaagaggctggatgtgacaggcttctgcatgaccgggaagccaggcatcatctgtgtggagggcttcaaggagcactgtgaggagttctggcacaccatccgctaccccaactggaagcacatcagctgcaagcacgccgagagcgtggagacagagggcaatggagaggacctgcggctcttccacagctttgaggagctgctgctggaggcccacggggactatggcctgagaaatgactaccacatgaacctgggccagttcctggagttcctgaagaagcacaagtcagaacatgtgttccagatcctgtttggaattgagagcaagagcagtgacagctag

SEQ ID NO: 42036 - DNA, 960 bp, Artificial Sequence
  Description of Artificial Sequence: Synthetic coding sequence
atgaagattgagctgtccatgcagccctggaaccctggctacagcagcgagggcgccacagcccaggagacctacacctgccccaagatgattgagatggagcaggccgaggcccagctggccgagctggacctgctggcctccatgtttcctggagaaaatgagctgattgtgaatgaccagctggccgtggccgagctgaaggactgcatcgagaagaagaccatggagggccgcagcagcaaggtgtacttcaccatcaacatgaacctggatgtgtctgatgagaagatggccatgttcagcctggcctgcatcctgcccttcaagtacccagctgtgctgcctgagatcaccgtgcgctctgtgctgctgagccgcagccagcagacccagctgaacacagacctgacagccttcctgcagaagcactgccacggagatgtgtgcatcctgaatgccacagagtgggtgcgggagcacgccagcggctacgtgtcccgggacaccagcagcagccccaccaccggcagcacagtgcagagcgtggacctgatcttcacccggctgtggatctacagccaccacatctacaacaagtgcaagaggaagaacatcctggagtgggccaaggagctgagcctgagcggcttctccatgcctgggaagccaggagtggtgtgtgtggagggcccccagagcgcctgtgaggagttctggagccggctgaggaagctgaactggaagaggatcctgatccgccaccgggaggacatcccctttgatggcaccaatgatgaaacagagcggcagaggaagttcagcatctttgaggagaaggtgttttctgtgaatggagcccggggcaaccacatggactttggccagctgtaccagttcctgaacaccaagggctgtggagatgtgttccagatgttcttcggcgtggagggccagtag

SEQ ID NO: 42037 - DNA, 567 bp, Artificial Sequence
  Description of Artificial Sequence: Synthetic coding sequence
atgtctgccaatgaagaccaggagatggagctggaggccctgcggagcatctatgaaggagatgagagcttccgggagctgagccctgtgtccttccagtaccgcatcggggagaatggagaccccaaggccttcctgattgagatctcctggacagagacctacccccagaccccacccatcctgtccatgaatgccttcttcaacaacaccatcagcagcgctgtgaagcagagcatcctggccaagctgcaggaggccgtggaggccaacctgggcacagccatgacctacaccctgtttgaatatgccaaggacaacaaggagcagttcatggagaaccacaaccccatcaacagcgccaccagcatcagcaacatcatcagcattgagacccccaacacagcccccagcagcaagaagaaggacaagaaggagcagctgagcaaggcccagaagaggaagctggccgacaagacagaccacaagggggagctgccccggggctggaactgggtggatgtggtgaagcacctgagcaagacaggcagcaaggatgatgaatag

SEQ ID NO: 42038 - DNA, 564 bp, Artificial Sequence
  Description of Artificial Sequence: Synthetic coding sequence
atgtctgccaatgaagaccaggagatggagctggaggccctgcggagcatctatgaaggagatgagagcttccgggagctgagccctgtgtccttccagtaccgcatcggggagaatggagaccccaaggccttcctgattgagatctcctggacagagacctacccccagaccccacccatcctgtccatgaatgccttcttcaacaacaccatcagcagcgctgtgaagcagagcatcctggccaagctgcaggaggccgtggaggccaacctgggcacagccatgacctacaccctgtttgaatatgccaaggacaacaaggagcagttcatggagaaccacaaccccatcaacagcgccaccagcatcagcaacatcatcagcattgagacccccaacacagcccccagcagcaagaagaaggacaagaaggagcagctgagcaaggcccagaagaggaagctggccgacaagacagaccacaagggggagctgccccggggctggaactgggtggatgtggtgaagctgagcaagacaggcagcaaggatgatgaatag

SEQ ID NO: 42039 - DNA, 2988 bp, Artificial Sequence
  Description of Artificial Sequence: Synthetic coding sequence
atgagcagcctgccccggcgggccaaggtgcaggtgcaggatgtggtgctgaaggatgagttcagcagcttcagcgagctgagcagcgcctctgaagaagatgacaaggaggacagcgcctgggagccccagaagaaggtgcccaggagcaggaagcagcccccacccaaggagagcaagcccaagaggatgccccgggtgaagaagaatgccccccagatcagtgatggcagcgaggtggtggtggtgaaggaggagctgaacagctctgtggccatcgctgacacagccctggaggacaggaagaacaagctggacacagtgcagaccctgaagacagccaagaccaagcagaagtgtgccgcccagccccacacagtgcggaggaccaagaagctgaaggtggaggaggagaccagcaaggccagcaacctggagggggagagcaacagcagcgagacccccagcaccagcacagtgtggggcggcacctgcaagaaggaggagaatgatgatgacttcaccttcggccagagcgccctgaagaagatcaagacagagacctacccccagggccagcctgtgaagtttcctgccaatgccaacagcaccaaggaggaggtggagatgaactgggacatggtgcaggtgctgtctgagaggaccaacatcgagccctgggtgtgtgccaacatcatccgcctcttcaatgatgacaacaccatccccttcatcatccgctacaggaaggagctgatcaacaacctggatgctgacagcctgcgggaggtgcagcagaccctggaggagctgcgggctgtggccaagaaggtgcacagcaccatccagaagatcaagaaggagggcaagatgtctgaatgtctgctgaaggccatgctgaactgcaagacctttgaggagctggagcacgtgtctgccccctacaagacaggcagcaagggcaccaaggcccagagggcccggcagctgggcctggagggcgccgcccgggccctgctggagaagccaggagagctgagcctgctgagctacatccggccagatgtgaagggcctgagcaccctgcaggacattgaaattggagtgcagcacatcctggccgacatgattgccaaggacaaggacaccctggacttcatccggaacctgtgccagaagagacatgtgtgcatccagagcagcctggccaaggtgagcagcaagaaggtgaatgagaaggatgtggacaagttcctgctgtaccagcacttcagctgcaacatccggaacatccaccaccaccagatcctggccatcaacagaggagagaacctgaaggtgctgactgtgaaggtgaacatcagtgatggagtgaaggatgagttctgccgctggtgcatccagaaccgctggaggcccaggagctttgcccggcctgagctgatgaagatcctgtacaacagcctgaatgacagcttcaagaggctcatctaccccctgctgtgccgggagttccgggccaagctgaccagtgatgctgagaaggagagcgtgatgatgtttggaagaaacctgcggcagctgctgctgaccagccctgtgcccggccgcaccctgatgggcgtggaccccggctacaagcacggctgcaagctggccatcatcagccccaccagccagatcctgcacacagatgtggtgtacctgcactgcggccagggcttccgggaggccgagaagatcaagaccctgctgctgaacttcaactgcagcacagtggtgattggaaatggaacagcctgccgggagacagaggcctactttgctgacctgatcatgaagaactactttgcccccctggatgtggtgtactgcatcgtgtctgaggccggggccagcatctacagcgtgtccccagaggccaacaaggagatgcctggcctggaccccaacctgcggtctgctgtgtccatcgcccggcgggtgcaggaccccctggccgagctggtgaagattgagcccaagcacatcggcgtgggcatgtaccagcatgatgtgtcccagaccctgctgaaggccaccctggacagcgtggtggaggagtgtgtgtcctttgtgggcgtggacatcaacatctgcagcgaggtgctgctgcggcacatcgccggcctgaatgccaacagagccaagaacatcatcgagtggagggagaagaatggccccttcatcaaccgggagcagctgaagaaggtgaagggcctgggccccaagagcttccagcagtgtgccggcttcatccgcatcaaccaggactacatccgcaccttctgcagccagcagacagagaccagcggccagatccagggcgtggccgtgaccagcagcgcagatgtggaggtgaccaatgagaagcagggcaagaagaagagcaagacagctgtgaatgtgctgctgaagcccaaccccctggaccagacctgcatccaccctgagagctatgacatcgccatgaggttcctgagcagcattggaggcaccctgtatgaggtgggcaagccagagatgcagcagaagatcaacagcttcctggagaaggagggcatggagaagattgctgagcggctgcagaccaccgtgcacaccctgcaggtgatcattgatggcctgagccagcctgagagctttgacttcagaacagactttgacaagccagacttcaagaggagcatcgtgtgcctggaggacctgcagatcggcaccgtgctgaccgggaaggtggagaatgccaccctgtttggcatctttgtggacatcggcgtgggcaagagcggcctcatccccatcagaaatgtgacagaggccaagctgagcaagaccaagaagaggaggagcctgggcctgggccctggagagcgggtggaggtgcaggtgctgaacatcgacatccccaggagccgcatcaccctggacctgatccgggtgctgtag

SEQ ID NO: 42040 - DNA, 1545 bp, Artificial Sequence
  Description of Artificial Sequence: Synthetic coding sequence
atgaagatcctgtacaacagcctgaatgacagcttcaagaggctcatctaccccctgctgtgccgggagttccgggccaagctgaccagtgatgctgagaaggagagcgtgatgatgtttggaagaaacctgcggcagctgctgctgaccagccctgtgcccggccgcaccctgatgggcgtggaccccggctacaagcacggctgcaagctggccatcatcagccccaccagccagatcctgcacacagatgtggtgtacctgcactgcggccagggcttccgggaggccgagaagatcaagaccctgctgctgaacttcaactgcagcacagtggtgattggaaatggaacagcctgccgggagacagaggcctactttgctgacctgatcatgaagaactactttgcccccctggatgtggtgtactgcatcgtgtctgaggccggggccagcatctacagcgtgtccccagaggccaacaaggagatgcctggcctggaccccaacctgcggtctgctgtgtccatcgccaggagagtgcaggaccccctggccgagctggtgaagattgagcccaagcacatcggcgtgggcatgtaccagcatgatgtgtcccagaccctgctgaaggccaccctggacagcgtggtggaggagtgtgtgtcctttgtgggcgtggacatcaacatctgcagcgaggtgctgctgcggcacatcgccggcctgaatgccaacagagccaagaacatcatcgagtggagggagaagaatggccccttcatcaaccgggagcagctgaagaaggtgaagggcctgggccccaagagcttccagcagtgtgccggcttcatccgcatcaaccaggactacatccgcaccttctgcagccagcagacagagaccagcggccagatccagggcgtggccgtgaccagcagcgcagatgtggaggtgaccaatgagaagcagggcaagaagaagagcaagacagctgtgaatgtgctgctgaagcccaaccccctggaccagacctgcatccaccctgagagctatgacatcgccatgaggttcctgagcagcatcggcggcaccctgtatgaggtgggcaagccagagatgcagcagaagatcaacagcttcctggagaaggagggcatggagaagattgctgagcggctgcagaccaccgtgcacaccctgcaggtgatcattgatggcctgagccagcctgagagctttgacttcagaacagactttgacaagccagacttcaagaggagcatcgtgtgcctggaggacctgcagattggaacagtgctgaccgggaaggtggagaatgccaccctgtttggcatctttgtggacattggagtgggcaagagcggcctcatccccatcagaaatgtgacagaggccaagctgagcaagaccaagaagagaagaagcctgggcctgggccctggagagcgggtggaggtgcaggtgctgaacatcgacatccccaggagccgcatcaccctggacctgatccgggtgctgtag

SEQ ID NO: 42041 - DNA, 306 bp, Artificial Sequence
  Description of Artificial Sequence: Synthetic coding sequence
atgaacatccccctgggggagaaggtgatgctggacatcgtggccatgttccggcagtacagcggagatgatggccgcatggacatgcctggcctggtgaacctgatgaaggagaacttccccaacttcctgagcggctgtgagaagagtgacatggactacctgagcaatgccctggagaagaaggatgacaacaaggacaagaaggtgaactacagcgagttcctgagcctgctgggggacatcaccatcgaccaccacaagatcatgcatggagtggccccctgcagcggcggcagccagtag

SEQ ID NO: 42042 - DNA, 306 bp, Artificial Sequence; identical to SEQ ID NO: 42041
  Description of Artificial Sequence: Synthetic coding sequence

SEQ ID NO: 42043 - DNA, 339 bp, Artificial Sequence
  Description of Artificial Sequence: Synthetic coding sequence
atgctgcccagcagcggcttcctgaaggccaagatgaacatccccctgggggagaaggtgatgctggacatcgtggccatgttccggcagtacagcggagatgatggccgcatggacatgcctggcctggtgaacctgatgaaggagaacttccccaacttcctgagcggctgtgagaagagtgacatggactacctgagcaatgccctggagaagaaggatgacaacaaggacaagaaggtgaactacagcgagttcctgagcctgctgggggacatcaccatcgaccaccacaagatcatgcacggcgtggccccctgcagcggcggcagccagtag

SEQ ID NO: 42044 - DNA, 2715 bp, Artificial Sequence
  Description of Artificial Sequence: Synthetic coding sequence
atgcaggccagccccctgcagaccagccagcccaccccacctgaggagctgcatgctgctgcctacgtgttcaccaatgatggccagcagatgagaagtgatgaggtgaacctggtggccaccggccaccagagcaagaagaagcacagcaggaagagcaagaggcacagcagcagcaagaggaggaagtccatgagctcctggctggacaagcaggaggatgctgctgtgacccacagcatctgtgaggagcgcatcaacaacggccagcctgtggccgacaacgtgctgagcacagccccaccctggccagatgccaccatcgcccacaacatccgggaggagaggatggagaatggccagagcaggacagacaaggtgctgagcacagccccaccccagctggtgcacatggctgctgctggcatccccagcatgagcacccgggacctgcacagcacagtgacccacaacatccgggaggagaggatggagaatggccagccccagcctgacaacgtgctgagcacaggccccaccggcctcatcaacatggccgccacccccatcccagccatgtctgcccgggacctgtatgccaccgtgacccacaacgtgtgtgagcagaagatggagaatgtgcagcctgccccagacaacgtgctgctgaccctgcggccccggcgcatcaacatgacagacaccggcatcagccccatgagcacccgggacccctatgccaccatcacctacaacgtgcctgaggagaagatggagaagggccagccccagcctgacaacatcctgagcacagccagcacaggcctcatcaacgtggccggggccggcaccccagccatcagcaccaacggcctgtacagcacagtgccccacaacgtgtgtgaggagaagatggagaatgaccagccccagcccaacaacgtgctgagcacagtgcagcctgtgatcatctacctgacagccaccggcatccctggcatgaacacccgggaccagtatgccaccatcacccacaacgtgtgtgaggagcgggtggtgaacaaccagcccctgcccagcaatgccctgagcacagtgctgcccggcctggcctacctggccacagctgacatgcctgccatgagcacccgggaccagcacgccaccatcatccacaacctgcgggaggagaagaaggacaacagccagcccaccccagacaacgtgctgtctgctgtgaccccagagctgatcaacctggccggggccggcatcccccccatgagcacccgggaccagtatgccaccgtgaaccaccacgtgcatgaggccaggatggagaatggccagaggaagcaggacaacgtgctgagcaatgtgctgagcggcctcatcaacatggccggggccagcatcccagccatgagcagccgggacctgtatgccaccatcacccacagcgtgcgggaggagaagatggagagcggcaagccccagacagacaaggtgatcagcaatgatgccccccagctgggccacatggccgccggcggcatccccagcatgagcaccaaggacctgtatgccaccgtgacccagaatgtgcatgaggagaggatggagaacaaccagccccagcccagctatgacctgagcacagtgctgcccggcctgacctacctgactgtggccggcatcccagccatgagcacccgggaccagtatgccaccgtgacccacaacgtgcatgaggagaagatcaagaatggccaggccgccagtgacaacgtgttcagcacagtgcccccagccttcatcaacatggccgccactggagtgtcctccatgagcacccgggaccagtatgctgctgtgacccacaacatccgggaggagaagatcaacaacagccagcctgcccctggcaacatcctgagcacagccccaccctggctgcggcacatggctgctgctggcatcagcagcaccatcacccgggacctgtatgtgacagccacccacagcgtgcatgaggagaagatgaccaacggccagcaggccccagacaacagcctgagcacagtgcccccaggctgcatcaacctgtctggagctggcatcagctgccgcagcacccgggacctgtatgccaccgtcatccatgacatccaggaggaggagatggagaatgaccagaccccaccagatggcttcctgagcaacagcgacagccctgagctgatcaacatgacaggccactgcatgcccccaaatgccctggacagcttcagccatgacttcaccagcctgagcaaggatgagctgctgtacaagccagacagcaatgaatttgctgtgggcaccaagaactacagcgtgtctgctggggacccccctgtgacagtgatgagcctggtggagaccgtgcccaacaccccccagatcagccctgccatggccaagaagatcaatgatgacatcaagtaccagctgatgaaggaggtgcggcgcttcggccagaactatgaaagaatcttcatcctgctggaggaggtgcagggctccatgaaggtgaagaggcagtttgtggagttcaccatcaaggaggccgcccgcttcaagaaggtggtgctgatccagcagctggagaaggccctgaaggagattgacagccactgccacctgaggaaggtgaagcacatgaggaagaggtag

SEQ ID NO: 42045 - DNA, 2715 bp, Artificial Sequence; identical to SEQ ID NO: 42044
  Description of Artificial Sequence: Synthetic coding sequence

SEQ ID NO: 42046 - DNA, 2715 bp, Artificial Sequence; identical to SEQ ID NO: 42044
  Description of Artificial Sequence: Synthetic coding sequence

SEQ ID NO: 42047 - DNA, 1587 bp, Artificial Sequence
  Description of Artificial Sequence: Synthetic coding sequence
atgcaggccagccccctgcagaccagccagcccaccccacctgaggagctgcatgctgctgcctacgtgttcaccaatgatggccagcagatgagaagtgatgaggtgaacctggtggccaccggccaccagagcaagaagaagcacagcaggaagagcaagaggcacagcagcagcaagaggaggaagtccatgagctcctggctggacaagcaggaggatgctgctgtgacccacagcatctgtgaggagcgcatcaacaacggccagcctgtggccgacaacgtgctgagcacagccccaccctggccagatgccaccatcgcccacaacatccgggaggagaggatggagaatggccagagcaggacagacaaggtgctgagcacagccccaccccagctggtgcacatggctgctgctggcatccccagcatgagcacccgggacctgcacgccaccgtgacccagaatgtgcatgaggagaggatggagaacaaccagccccagcccagctatgacctgagcacagtgctgcccggcctgacctacctgactgtggccggcatcccagccatgagcacccgggaccagtatgccaccgtgacccacaacgtgcatgaggagaagatcaagaatggccaggccgccagtgacaacgtgttcagcacagtgcccccagccttcatcaacatggccgccactggagtgtcctccatgagcacccgggaccagtatgctgctgtgacccacaacatccgggaggagaagatcaacaacagccagcctgcccctggcaacatcctgagcacagccccaccctggctgcggcacatggctgctgctggcatcagcagcaccatcacccgggacctgtatgtgacagccacccacagcgtgcatgaggagaagatgaccaacggccagcaggccccagacaacagcctgagcacagtgcccccaggctgcatcaacctgtctggagctggcatcagctgccgcagcacccgggacctgtatgccaccgtcatccatgacatccaggaggaggagatggagaatgaccagaccccaccagatggcttcctgagcaacagcgacagccctgagctgatcaacatgacaggccactgcatgcccccaaatgccctggacagcttcagccatgacttcaccagcctgagcaaggatgagctgctgtacaagccagacagcaatgaatttgctgtgggcaccaagaactacagcgtgtctgctggggacccccctgtgacagtgatgagcctggtggagaccgtgcccaacaccccccagatcagccctgccatggccaagaagatcaatgatgacatcaagtaccagctgatgaaggaggtgcggcgcttcggccagaactatgaaagaatcttcatcctgctggaggaggtgcagggctccatgaaggtgaagaggcagtttgtggagttcaccatcaaggaggccgcccgcttcaagaaggtggtgctgatccagcagctggagaaggccctgaaggagattgacagccactgccacctgaggaaggtgaagcacatgaggaagaggtag

SEQ ID NO: 42048 - DNA, 2715 bp, Artificial Sequence; identical to SEQ ID NO: 42044
  Description of Artificial Sequence: Synthetic coding sequence

SEQ ID NO: 42049 - DNA, 225 bp, Artificial Sequence
  Description of Artificial Sequence: Synthetic coding sequence
cggggcagccggggccgccaccactggagcggcggcgctgctgtgagcagcggctaccccagcaacatcgagaagaaggagtaccaggagcagagcgtgctgagctgctgcagcgagaggaaggatgccaaccccaagtctgtggtgtgcagcttcttcatgcaggagcagtgcaccaagggggagaagcaggccgtggtgatcagtgactttggagagagctag

SEQ ID NO: 42050 - DNA, 2385 bp, Artificial Sequence
  Description of Artificial Sequence: Synthetic coding sequence
atggaggccgtgtccagggtcttccctgccctggccggccaggcccctgaggagcagggcgagatcatcaaggtgaaggtgaaggaggaggaccacacctgggaccaggagagcgccctgcggaggaacctgagctacacccgggagctgagccggcagcgcttccggcagttctgctaccaggagaccccaggcccccgggaggccctgagccagctgcgggagctgtgccggcagtggctgaaccctgagatccacaccaaggagcagatcctggagctgctggtgctggagcagttcctgaccatcctgcctgaggagctgcagagctgggtgcgggagcacaaccctgagagcggggaggaggtggtgaccctgctggaggacctggagcgggagctggatgagccccggcagcaggtgtcccagggcacctacggccaggaggtgtccatggaggagatgatccccctggacagcgccaaggagagcctgggcacccagctgcagagcatggaggacaggatggagtgtgagagccctgagccccaccccctgcaggacaatggcagcttcctgtggttctccatgatgagccagagcatgggcggggacaacctgagcagcctggacaccaatgaagctgagattgagcctgagaacatgagggagaagttcttccgcagcctggcccggctgctggagaacaagagcaacaacaccaagatcttcagcaaggccaagtactgccagctgatcaaggaggtgaaggaggccaaggccaaggccaagaaggagagcgtggactacagaaggctggccaggtttgatgtgatcctggtgcagggcaatgagaagctgattgaggccgtgaatggagaaacagacaagatccgctactacctgcacagcgaggacctgtttgacatcctgcacaacacccacctgagcatcggccacggcggccgcaccaggatggagaaggagctgcaggccaagtacaagaacatcaccaaggaggtgatcatgctgtacctgaccctgtgcaagccctgccagcagaagaacagcaagctgaagaaggtgctgaccagcaagagcatcaaggaggtgagcagccgctgccaggtggacctgattgacatgcagctgaacccagatggagagtaccgcttcatcctgcactaccaggacctgtgcaccaagctgaccttcctgcggagcctgaagagcaagaggcccacagaggtggcccacgccctgctggacatcttcaccatcatcggggcccccagcgtgctgcagagcgacaatggccgggagttcagcagccaggtggtgtctgagctgagcaacatctggccagagctgaagatcgtgcacggcaagagccagacctgccagagccagagcagcgctgagcagacagaggacatcaggaagaggatcttctcctggatgcagaccaacaacagcagccactggacagagttcctgtggttcatccagatgagccagaaccagccctaccaccgctccatgcagcagaccccctgtgagagcgccttcagcagcgaggccaagctgggcctgagccacagccagctgacagaggagctggtggccagcctgcacacagaaaatgagctggaccaggccgacaaggagctggagaacaccctgcgggcccagtatgaagaaaatattgaaacaggaacagacagcagtgacatcgaggagaacctgtctgtgacccccaaggtggccgagaagagccccccagagagccggctgcgcttcctgagctgtgtggtgtgtgagaaggaatgtactggagtgaacagctgcatcagctgtgatggcaacatccacgccatctgtggggtgcccagccagcacggcacagagggctgcggccggcagatcacctgcagcctgtgctatgagaccagcaccatgaagaggaagcatgatgagatccagaggagcctgcctgtgaagcccagcaagatgctgaagcccagcggcacccccttctccccagacaaggtgggggactggatggccaagcaggccagcctggacttctttgtgaagaagagacatgccttcagcgagcacagcagcagcaacaagagaaatgtgaacaacagaagctacccagaggagggcaagaccaagagggtgcacgccagcttcaccaggaaatatgaccccagctacatcgagtttggatttgtggccgtgattgatggagaggtgctgaagccccagtgcatcatctgtggagatgtgctggccaatgaggccatgaagcccagcaagctgaagaggcacctgtacagcaagcacaaggagatcagcagccagcccaaggagttctag

SEQ ID NO: 42051 - DNA, 1737 bp, Artificial Sequence
  Description of Artificial Sequence: Synthetic coding sequence
atgaacatctctgtggacctggagaccaactatgcagagctggtgctggatgtgggccgggtgaccctgggggagaacagcaggaagaagatgaaggactgcaagctgaggaagaagcagaatgaatctgtgtcccgggccatgtgtgccctgctgaacagcggcggcggcgtcatcaaggccgagattgaaaatgaagactacagctacaccaaggatggcatcggcctggacctggagaacagcttcagcaacatcctgctgtttgtgcctgagtacctggacttcatgcagaatggaaactacttcctgatctttgtgaagtcctggagcctgaacaccagcggcctgcgcatcaccaccctgagcagcaacctgtacaagagggacatcaccagcgccaaggtgatgaatgccacagctgccctggagttcctgaaggacatgaagaagacccggggccgcctgtacctgcggcctgagctgctggccaagaggccctgtgtggacatccaggaggagaacaacatgaaggccctggccggggtcttctttgacagaacagagctggacaggaaggagaagctgaccttcacagagagcacccacgtggagatcaagaacttcagcacagagaagctgctgcagaggatcaaggagatcctgccccagtatgtgtctgcctttgccaacacagatggcggctacctgttcatcggcctgaatgaagacaaggagatcatcggcttcaaggccgagatgtctgacctggatgacctggagcgggagattgagaagagcatcaggaagatgcctgtgcaccacttctgcatggagaagaagaagatcaactacagctgcaagttcctgggcgtgtatgacaagggcagcctgtgtggctacgtgtgtgccctgcgggtggagcgcttctgctgtgctgtgtttgccaaggagccagacagctggcacgtgaaggacaacagagtgatgcagctgaccaggaaggagtggatccagttcatggtggaggccgagcccaagttcagcagcagctatgaggaggtgatcagccagatcaacaccagcctgcctgccccccacagctggcccctgctggagtggcagaggcagaggcaccactgccccggcctgagcggccgcatcacctacaccccagagaacctgtgcaggaagctgttcctgcagcacgagggcctgaagcagctgatctgtgaggagatggacagcgtgaggaagggcagcctcatcttcagccgctcctggagcgtggacctgggcctgcaggagaaccacaaggtgctgtgtgatgccctgctgatcagccaggacagcccccctgtgctgtacaccttccacatggtgcaggatgaggagttcaagggctacagcacccagacagccctgaccctgaagcagaagctggccaagattggaggctacaccaagaaggtgtgtgtgatgaccaagatcttctacctgagccctgagggcatgaccagctgccagtatgacctgcggagccaggtgatctacccagagagctactacttcaccaggaggaagtacctgctgaaggccctcttcaaggccctgaagaggctgaagagcctgcgggaccagttctcctttgctgagaacctgtaccagatcatcggcatcgactgcttccagaagaatgacaagaagatgttcaagagctgccggcggctgacctag

SEQ ID NO: 42052 - DNA, 1737 bp, Artificial Sequence; identical to SEQ ID NO: 42051
  Description of Artificial Sequence: Synthetic coding sequence

SEQ ID NO: 42053 - DNA, 48 bp, Artificial Sequence
  Description of Artificial Sequence: Synthetic coding sequence
atgaacatctctgtggacctggagaccaactatgcagagctggtgtag

SEQ ID NO: 42054 - DNA, 210 bp, Artificial Sequence
  Description of Artificial Sequence: Synthetic coding sequence
atgaacatctctgtggacctggagaccaactatgcagagctggtgctggatgtgggccgggtgaccctgggggagaacagcaggaagaagatgaaggactgcaagctgaggaagaagcagaatgaatctgtgtcccgggccatgtgtgccctgctgaacagcggcggcggcgtcatcaaggccgagattgaaaatgaagactacagctag

SEQ ID NO: 42055 - DNA, 387 bp, Artificial Sequence
  Description of Artificial Sequence: Synthetic coding sequence
atgaacatctctgtggacctggagaccaactatgcagagctggtgctggatgtgggccgggtgaccctgggggagaacagcaggaagaagatgaaggactgcaagctgaggaagaagcagaatgaatctgtgtcccgggccatgtgtgccctgctgaacagcggcggcggcgtcatcaaggccgagattgaaaatgaagactacagctacaccaaggatggcatcggcctggacctggagaacagcttcagcaacatcctgctgtttgtgcctgagtacctggacttcatgcagaatggaaactacttcctgatctttgtgaagtcctggagcctgaacaccagcggcctgcgcatcaccaccctgagcagcaacctgtacaagtag

SEQ ID NO: 42056 - DNA, 1737 bp, Artificial Sequence; identical to SEQ ID NO: 42051
  Description of Artificial Sequence: Synthetic coding sequence

SEQ ID NO: 42057 - DNA, 1854 bp, Artificial Sequence
  Description of Artificial Sequence: Synthetic coding sequence
atggccatgaagatcatggagaagatcagaaatgtgttccactgtgaggcccaccgcatcctgtacatctgtgagagccagttcctgaggaacttcatcaggaaggagttcctgcggggaaatggcctggccgccggcaagatgaacatcagcattgacctggacaccaactatgcagagctggtgctgaatgtgggccgggtgaccctgggggagaacaacaggaagaagatgaaggactgccagctgaggaagcagcagaatgaaaatgtgtccagagctgtgtgtgccctgctgaacagcggcggcggcgtcatcaaggccgaggtggagaacaagggctacagctacaagaaggatggcatcggcctggacctggagaacagcttcagcaacatgctgccctttgtgcccaacttcctggacttcatgcagaatggaaactacttccacatctttgtgaagtcctggagcctggagaccagcggcccccagatcgccaccctgagcagcagcctgtacaagagagatgtgaccagcgccaaggtgatgaatgccagcgctgccctggagttcctgaaggacatggagaagacaggaggccgggcctacctgcggcctgagttccctgccaagagggcctgtgtggatgtgcaggaggagagcaacatggaggccctggccgctgacttcttcaacagaacagagctgggctacaaggagaagctgaccttcacagagagcacccacgtggagatcaagaacttcagcacagagaagctgctgcagaggatcacagagatcctgccccagtatgtgtctgcctttgccaacacagatggcggctacctgtttgtgggcctgaatgaagacaaggaggtgattggcttcaaggccgagaagagctacctgaccaagctggaggaggtgaccaagaacagcatcggcaagctgcctgtgcaccacttctgtgtggagaagggcaccatcaactacctgtgcaagttcctgggcgtgtatgacaagggccgcctgtgtggctacgtgtatgccctgcgggtggagcgcttctgctgtgctgtgtttgccaagaagccagacagctggcacgtgaaggacaacagagtgaagcagctgacagagaaggagtggatccagttcatggtggacagcgagcctgtgtgtgaggagctgcccagccctgccagcaccagcagccctgtgtcccagagctaccccctgcgggagtacatcaacttcaagatccagcccctgcgctaccacctgcccggcctgtctgagaagatcacctgtgcccccaagaccttctgcaggaacctcttcagccagcacgagggcctgaagcagctgatctgtgaggagatgggctctgtgaacaagggcagcctcatcttcagccgctcctggagcctggacctgggcctgcaggagaaccacaaggtgctgtgtgatgccctgctgatcagccaggacaagccccctgtgctgtacaccttccacatggtgcaggatgaggagttcaaggactacagcacccagacagcccagaccctgaagcagaagctggccaagattggaggctacaccaagaaggtgtgtgtgatgaccaagatcttctacctgagccctgagggcaagaccagctgccagtatgacctgaacagccaggtgatctacccagagagctactactggaccacagcccagaccatgaaggacctggagaaggccctgagcaacatcctgcccaaggagaaccagatcttcctgtttgtgtgcctcttccgcttctgcctgtttgtgtgctggtttgtgtgcttcttcctgaggtag

SEQ ID NO: 42058 - DNA, 1860 bp, Artificial Sequence
  Description of Artificial Sequence: Synthetic coding sequence
atgcagctgtctgagggcctggccgcccacacccggcgggccggcaagtggaagaggacccaggtgcccctgctgggggaggagtgtgccgacatggacctggccaggaaggagttcctgcggggaaatggcctggccgccggcaagatgaacatcagcattgacctggacaccaactatgcagagctggtgctgaatgtgggccgggtgaccctgggggagaacaacaggaagaagatgaaggactgccagctgaggaagcagcagaatgaaaatgtgtccagagctgtgtgtgccctgctgaacagcggcggcggcgtcatcaaggccgaggtggagaacaagggctacagctacaagaaggatggcatcggcctggacctggagaacagcttcagcaacatgctgccctttgtgcccaacttcctggacttcatgcagaatggaaactacttccacatctttgtgaagtcctggagcctggagaccagcggcccccagatcgccaccctgagcagcagcctgtacaagagagatgtgaccagcgccaaggtgatgaatgccagcgctgccctggagttcctgaaggacatggagaagacaggaggccgggcctacctgcggcctgagttccctgccaagagggcctgtgtggatgtgcaggaggagagcaacatggaggccctggccgctgacttcttcaacagaacagagctgggctacaaggagaagctgaccttcacagagagcacccacgtggagatcaagaacttcagcacagagaagctgctgcagaggatcacagagatcctgccccagtatgtgtctgcctttgccaacacagatggcggctacctgtttgtgggcctgaatgaagacaaggaggtgattggcttcaaggccgagaagagctacctgaccaagctggaggaggtgaccaagaacagcatcggcaagctgcctgtgcaccacttctgtgtggagaagggcaccatcaactacctgtgcaagttcctgggcgtgtatgacaagggccgcctgtgtggctacgtgtatgccctgcgggtggagcgcttctgctgtgctgtgtttgccaagaagccagacagctggcacgtgaaggacaacagagtgaagcagctgacagagaaggagtggatccagttcatggtggacagcgagcctgtgtgtgaggagctgcccagccctgccagcaccagcagccctgtgtcccagagctaccccctgcgggagtacatcaacttcaagatccagcccctgcgctaccacctgcccggcctgtctgagaagatcacctgtgcccccaagaccttctgcaggaacctcttcagccagcacgagggcctgaagcagctgatctgtgaggagatgggctctgtgaacaagggcagcctcatcttcagccgctcctggagcctggacctgggcctgcaggagaaccacaaggtgctgtgtgatgccctgctgatcagccaggacaagccccctgtgctgtacaccttccacatggtgcaggatgaggagttcaaggactacagcacccagacagcccagaccctgaagcagaagctggccaagattggaggctacaccaagaaggtgtgtgtgatgaccaagatcttctacctgagccctgagggcaagaccagctgccagtatgacctgaacagccaggtgatctacccagagagctactactggaccacagcccagaccatgaaggacctggagaaggccctgagcaacatcctgcccaaggagaaccagatcttcctgtttgtgtgcctcttccgcttctgcctgtttgtgtgctggtttgtgtgcttcttcctgaggtag

SEQ ID NO: 42059 - DNA, 2694 bp, Artificial Sequence
  Description of Artificial Sequence: Synthetic coding sequence
atggaggccaaccactgcagcctgggcgtgtaccccagctacccagacctggtgattgatgtgggggaggtgaccctgggggaggagaacaggaagaagctgcagaagacccagagggaccaggagcgggcccgggtcatccgggccgcctgtgccctgctgaacagcggcggcggcgtcatccagatggagatggccaacagagatgagcggcccacagagatgggcctggacctggaggagagcctgaggaagctgatccagtacccctacctgcaggccttctttgagaccaagcagcacggccgctgcttctacatctttgtgaagtcctggagcggggaccccttcctgaaggatggcagcttcaacagccgcatctgcagcctgagcagcagcctgtactgccgcagcggcacctctgtgctgcacatgaacagccggcaggcctttgacttcctgaagaccaaggagcggcagagcaagtacaacctgatcaatgaaggcagcccccccagcaagatcatgaaggctgtgtaccagaacatcagcgagagcaacccagcctatgaggtgttccagacagacaccatcgagtatggagagatcctgtccttccctgagagccccagcattgagttcaagcagttcagcaccaagcacatccagcagtatgtggagaacatcatccctgagtacatcagcgcctttgccaacacagagggcggctacctgttcatcggcgtggatgacaagagcaggaaggtgctgggctgtgccaaggagcaggtggaccctgacagcctgaagaatgtgattgcccgggccatcagcaagctgcccatcgtgcacttctgcagcagcaagccccgggtggagtacagcaccaagatcgtggaggtgttctgtgggaaggagctgtatggctacctgtgtgtgatcaaggtgaaggccttctgctgcgtggtgttttctgaggcccccaagtcctggatggtgcgggagaagtacatccggcccctgaccacagaggagtgggtggagaagatgatggatgctgaccctgagttccccccagactttgctgaggcctttgagagccagctgagcctgagtgacagccccagcctgtgcaggcctgtgtacagcaagaagggcctggagcacaaggctgacctgcagcagcacctgtttcctgtgcccccaggccacctggagtgcaccccagagagcctgtggaaggagctgagcctgcagcacgagggcctgaaggagctgatccacaagcagatgaggcccttcagccagggcatcgtcatcctgagccgctcctgggccgtggacctgaacctgcaggagaagccaggagtcatctgtgatgccctgctgattgcccagaacagcacccccatcctgtacaccatcctgcgggagcaggatgctgagggccaggactactgcaccaggacagccttcaccctgaagcagaagctggtgaacatgggcggctacacaggcaaggtgtgtgtgcgggccaaggtgctgtgcctgagccctgagagcagcgctgaggccctggaggccgctgtgagccccatggactacccagccagctacagcctggccggcacccagcacatggaggccctgctgcagagcctggtgattgtgctgctgggcttccgcagcctgctgagtgaccagctgggctgtgaggtgctgaacctgctgacagcccagcagtatgagatcttcagccgcagcctgaggaagaaccgggagctgtttgtgcacggcctgcccggcagcggcaagaccatcatggccatgaagatcatggagaagatcagaaatgtgttccactgtgaggcccaccgcatcctgtatgtgtgtgagaaccagcccctgaggaacttcatcagtgacaggaacatctgcagagctgagacccgggagaccttcctgcgggagaagtttgagcacatccagcacatcgtgattgatgaggcccagaacttcagaacagaagatggagactggtacaggaaggccaagaccatcacccagcgggagaaggactgccctggggtgctgtggatcttcctggactacttccagaccagccacctgggccacagcggcctgccccccctgagcgcccagtacccccgggaggagctgaccagggtggtgagaaatgctgatgaaattgctgagtacatccagcaggagatgcagctgatcatcgagaacccccccatcaacatcccccacggctacctggccatcctgtctgaggccaagtgggtgcctggggtgcccggcaacaccaagatcatcaagaacttcaccctggagcagatcgtgacctacgtggccgacacctgccgctgcttctttgagcggggctacagccccaaggatgtggccgtgctggtgtccacagtgacagaggtggagcagtaccagagcaagctgctgaaggccatgaggaagaagatggtggtgcagctgagtgatgcctgtgacatgctgggcgtgcacatcgtgctggacagcgtgcggcgcttcagcggcctggagaggagcatcgtgtttggcatccaccccaggacagctgaccctgccatcctgcccaacatcctgatctgcctggccagccgggccaagcagcacctgtacatcttcctgtag

SEQ ID NO: 42060 - DNA, 1740 bp, Artificial Sequence
  Description of Artificial Sequence: Synthetic coding sequence
atggaggccaaccactgcagcctggcccccaagtcctggatggtgcgggagaagtacatccggcccctgaccacagaggagtgggtggagaagatgatggatgctgaccctgagttccccccagactttgctgaggcctttgagagccagctgagcctgagtgacagccccagcctgtgcaggcctgtgtacagcaagaagggcctggagcacaaggctgacctgcagcagcacctgtttcctgtgcccccaggccacctggagtgcaccccagagagcctgtggaaggagctgagcctgcagcacgagggcctgaaggagctgatccacaagcagatgaggcccttcagccagggcatcgtcatcctgagccgctcctgggccgtggacctgaacctgcaggagaagccaggagtcatctgtgatgccctgctgattgcccagaacagcacccccatcctgtacaccatcctgcgggagcaggatgctgagggccaggactactgcaccaggacagccttcaccctgaagcagaagctggtgaacatgggcggctacacaggcaaggtgtgtgtgcgggccaaggtgctgtgcctgagccctgagagcagcgctgaggccctggaggccgctgtgagccccatggactacccagccagctacagcctggccggcacccagcacatggaggccctgctgcagagcctggtgattgtgctgctgggcttccgcagcctgctgagtgaccagctgggctgtgaggtgctgaacctgctgacagcccagcagtatgagatcttcagccgcagcctgaggaagaaccgggagctgtttgtgcacggcctgcccggcagcggcaagaccatcatggccatgaagatcatggagaagatcagaaatgtgttccactgtgaggcccaccgcatcctgtatgtgtgtgagaaccagcccctgaggaacttcatcagtgacaggaacatctgcagagctgagacccgggagaccttcctgcgggagaagtttgagcacatccagcacatcgtgattgatgaggcccagaacttcagaacagaagatggagactggtacaggaaggccaagaccatcacccagcgggagaaggactgccctggggtgctgtggatcttcctggactacttccagaccagccacctgggccacagcggcctgccccccctgagcgcccagtacccccgggaggagctgaccagggtggtgagaaatgctgatgaaattgctgagtacatccagcaggagatgcagctgatcatcgagaacccccccatcaacatcccccacggctacctggccatcctgtctgaggccaagtgggtgcctggggtgcccggcaacaccaagatcatcaagaacttcaccctggagcagatcgtgacctacgtggccgacacctgccgctgcttctttgagcggggctacagccccaaggatgtggccgtgctggtgtccacagtgacagaggtggagcagtaccagagcaagctgctgaaggccatgaggaagaagatggtggtgcagctgagtgatgcctgtgacatgctgggcgtgcacatcgtgctggacagcgtgcggcgcttcagcggcctggagaggagcatcgtgtttggcatccaccccaggacagctgaccctgccatcctgcccaacatcctgatctgcctggccagccgggccaagcagcacctgtacatcttcctgtag

SEQ ID NO: 42061 - DNA, 321 bp, Artificial Sequence
  Description of Artificial Sequence: Synthetic coding sequence
atggaggccaaccactgcagcctgggcgtgtaccccagctacccagacctggtgattgatgtgggggaggtgaccctgggggaggagaacaggaagaagctgcagaagacccagagggaccaggagcgggcccgggtcatccgggccgcctgtgccctgctgaacagcggcggcggcgtcatccagatggagatggccaacagagatgagcggcccacagagatgggcctggacctggaggagagcctgaggaagctgatccagtacccctacctgcaggccttctttgagaccaagcagcacggccgctgcttctactag

SEQ ID NO: 42062 - DNA, 2694 bp, Artificial Sequence; identical to SEQ ID NO: 42059
  Description of Artificial Sequence: Synthetic coding sequence

SEQ ID NO: 42063 - DNA, 1740 bp, Artificial Sequence; identical to SEQ ID NO: 42060
  Description of Artificial Sequence: Synthetic coding sequence

SEQ ID NO: 42064 - DNA, 2694 bp, Artificial Sequence; identical to SEQ ID NO: 42059
  Description of Artificial Sequence: Synthetic coding sequence

SEQ ID NO: 42065 - DNA, 2739 bp, Artificial Sequence
  Description of Artificial Sequence: Synthetic coding sequence
atggagagcctgaagacagacacagagatgccctacccagaggtgattgtggatgtgggccgggtcatctttggagaagaaaataggaagaagatgaccaacagctgcctgaagagaagtgagaacagccgcatcatccgggccatctgtgccctgctgaacagcggcggcggcgtcatcaaggccgagattgatgacaagacctacagctaccagtgccacggcctgggccaggacctggagaccagcttccagaagctgctgcccagcggcagccagaagtacctggactacatgcagcagggccacaacctgctgatctttgtgaagtcctggagcccagatgtgttcagcctgcccctgcgcatctgcagcctgcggagcaacctgtacagaagagatgtgaccagcgccatcaacctgagcgccagcagcgccctggagctgctgcgggagaagggcttccgggcccagaggggccggccccgggtgaagaagctgcacccccagcaggtgctgaaccgctgcatccaggaggaggaggacatgaggatcctggccagcgagttcttcaagaaggacaagctgatgtacaaggagaagctgaacttcacagagagcacccacgtggagttcaagcgcttcaccaccaagaaggtgatcccccgcatcaaggagatgctgccccactacgtgtctgcctttgccaacacccagggcggctacgtgctgattggagtggatgacaagagcaaggaggtggtgggctgcaagtgggagaaggtgaacccagacctgctgaagaaggagattgagaactgcatcgagaagctgcccaccttccacttctgctgtgagaagcccaaggtgaacttcaccaccaagatcctgaatgtgtaccagaaggatgtgctggatggctacgtgtgtgtgatccaggtggagcccttctgctgcgtggtgtttgctgaggccccagacagctggatcatgaaggacaacagcgtgacccggctgacagctgagcagtgggtggtgatgatgctggacacccagagcgccccacccagcctggtgacagactacaacagctgcctgatcagcagcgccagcagcgccaggaagagccctggctaccccatcaaggtgcacaagttcaaggaggccctgcagaggcacctgtttcctgtgacccaggaggaggtgcagttcaagccagagagcctgtgcaagaagctgttcagtgaccacaaggagctggagggcctgatgaagaccctcatccacccctgcagccagggcatcgtcatcttcagccgctcctgggccggagatgtgggcttcaggaaggagcagaatgtgctgtgtgatgccctgctgattgctgtgaacagccctgtggtgctgtacaccatcctgattgaccccaactggccaggcggcctggagtatgccaggaacacagcccaccagctgaagcagaagctgcagacagtgggcggctacacaggcaaggtgtgcatcatccccaggctcatccacctgagcagcacccagagcaggcctggagagatccccctgcgctaccccaggagctaccgcctggctgatgaggaggagatggaggacctgctgcaggccctggtggtggtgtccctgagcagccgcagcctgctgagtgaccagatgggctgtgagttcttcaacctgctgatcatggagcagagccagctgctgtctgagagcctgcagaagacccgggagctgttcatctactgcttccctggggtgaggaagacagccctggccatcaagatcatggagaagatcaaggacctcttccactgcaagcccaaggagatcctgtatgtgtgtgagagtgacagcctgaaggactttgtgacccagcagaccacctgccaggccgtgaccaggaagaccttcatgcagggcgagttcctgaagatcaagcacatcgtgatggatgaaacagagaacttctgcagcaaatatggcaactggtacatgaaggccaagaacatcacccaccccaaggccaagggcactggaagtgagaacctgcaccacggcatcctgtggctgttcctggaccccttccagatccaccacgcagatgtgaatggcctgcccccacccagcgcccagttccccaggaagaccatcaccagcggcatccactgtgccctggagatcgccaaggtgatgaaggaggagatgaagaggatcaaggaaaatccacccagcaacatgagcccagacaccctggccctcttcagcgagacagcctatgaggaggccacctgtgcccaggccctgcccggggtgtgtgagaccaagaccaacctgaccacagagcagatcgccaactacgtggccaggaagtgccacagcctcttccagtgtggctacctgcccaaggacatcgccatcctgtgcagaagaggagaagatcggggccgctaccgcctggccctgctgaaggccatggagctgattgagacccaccggcccagcgaggtggtgttctccccagccactggagtgtggggcagccacatcgtgctggacagcatccagcagttcagcggcctggagaggacagtggtgtttggcctgagcccagaatgtgaccagagcgaggagttccacaagctgtgctttgccagccgggccatcaagcacctgtacctgctgtatgagaagagagctgcctactag

SEQ ID NO: 42066 - DNA, 2676 bp, Artificial Sequence
  Description of Artificial Sequence: Synthetic coding sequence
atgagcctgagaattgatgtggacaccaacttcccagaatgtgtggtggatgctgggaaggtgaccctgggcacccagcagaggcaggagatggacccccggctgcgggagaagcagaatgagatcatcctgcgggctgtgtgtgccctgctgaacagcggcggcggcatcatcaaggccgagattgaaaataaaggctacaactatgaaagacatggagtgggcctggatgtgccccccatcttccgcagccacctggacaagatgcagaaggagaaccacttcctgatctttgtgaagtcctggaacacagaggccggcgtgcccctggccaccctgtgcagcaacctgtaccaccgggagaggaccagcacagatgtgatggacagccaggaggccctggccttcctgaagtgcaggacccagacccccaccaacatcaacgtgagcaacagcctgggcccccaggccgcccagggctctgtgcagtatgagggcaacatcaacgtgtctgctgctgccctgtttgacaggaagaggctgcagtacctggagaagctgaacctgcctgagagcacccacgtggagtttgtgatgttcagcacagatgtgagccactgtgtgaaggaccggctgcccaagtgtgtgtctgcctttgccaacacagagggcggctacgtgttctttggagtgcatgatgagacctgccaggtgattggctgtgagaaggagaagattgacctgaccagcctgcgggccagcattgatggctgcatcaagaagctgcctgtgcaccacttctgcacccagaggcctgagatcaagtatgtgctgaacttcctggaggtgcatgacaagggggccctgcggggctacgtgtgtgccatcaaggtggagaagttctgctgtgctgtgtttgccaaggtgcccagctcctggcaggtgaaggacaacagagtgcggcagctgcccacccgggagtggacagcctggatgatggaggccgaccctgacctgagccgctgcccagagatggtgctgcagctgagcctgagcagcgccacccccaggagcaagcctgtgtgcatccacaagaacagcgagtgcctgaaggagcagcagaagcgctacttccctgtgttcagtgacagagtggtgtacaccccagagagcctgtacaaggagctgttcagccagcacaagggcctgcgggacctgatcaacacagagatgaggcccttcagccagggcatcctgatcttcagccagagctgggccgtggacctgggcctgcaggagaagcagggcgtcatctgtgatgccctgctgatcagccagaacaacacccccatcctgtacaccatcttcagcaagtgggatgctggctgcaagggctacagcatgattgtggcctacagcctgaagcagaagctggtgaacaagggcggctacacaggccgcctgtgcatcacccccctggtgtgtgtgctgaacagcgacaggaaggcccagagcgtgtacagcagctacctgcagatctacccagagagctacaacttcatgaccccccagcacatggaggccctgctgcagagcctggtgattgtgctgctgggcttcaagagcttcctgtctgaggagctgggcagcgaggtgctgaacctgctgaccaacaagcagtatgagctgctgagcaagaacctgaggaagacccgggagctgtttgtgcacggcctgcccggcagcggcaagaccatcctggccctgcgcatcatggagaagatcagaaatgtgttccactgtgagcccgccaacatcctgtacatctgtgagaaccagcccctgaagaagctggtgtccttcagcaagaagaacatctgccagcctgtgaccaggaagaccttcatgaagaacaactttgagcacatccagcacatcatcattgatgatgcccagaacttcagaacagaagatggagactggtacggcaaggccaagttcatcacccagacagccagagatggccctggggtgctgtggatcttcctggactacttccagacctaccacctgagctgcagcggcctgcccccacccagcgaccagtacccccgggaggagatcaacagagtggtgagaaatgccggccccatcgccaactacctgcagcaggtgatgcaggaggcccggcagaaccccccacccaacctgcccccaggcagcctggtgatgctgtatgagcccaagtgggcccagggcgtgcccggcaacctggagatcatcgaggacctgaacctggaggagatcctgatctacgtggccaacaagtgccgcttcctgctgagaaatggctacagccccaaggacattgctgtgctcttcaccaaggccagcgaggtggagaagtacaaggaccggctgctgacagccatgaggaagaggaagctgagccagctgcacgaggagagtgacctgctgctgcagattggagatgccagtgatgtgctgacagaccacatcgtgctggacagcgtgtgccgcttcagcggcctggagagaaatattgtgtttggcatcaaccctggggtggcccctcctgctggggcctacaacctgctgctgtgcctggccagccgggccaagaggcacctgtacatcctgaaggcctctgtgtag

SEQ ID NO: 42067 - DNA, 1170 bp, Artificial Sequence
  Description of Artificial Sequence: Synthetic coding sequence
atgagcctgagaattgatgtggacaccaacttcccagaatgtgtggtggatgctgggaaggtgaccctgggcacccagcagaggcaggagatggacccccggctgcgggagaagcagaatgagatcatcctgcgggctgtgtgtgccctgctgaacagcggcggcggcatcatcaaggccgagattgaaaataaaggctacaactatgaaagacatggagtgggcctggatgtgccccccatcttccgcagccacctggacaagatgcagaaggagaaccacttcctgatctttgtgaagtcctggaacacagaggccggcgtgcccctggccaccctgtgcagcaacctgtaccaccgggagaggaccagcacagatgtgatggacagccaggaggccctggccttcctgaagtgcaggacccagacccccaccaacatcaacgtgagcaacagcctgggcccccaggccgcccagggctctgtgcagtatgagggcaacatcaacgtgtctgctgctgccctgtttgacaggaagaggctgcagtacctggagaagctgaacctgcctgagagcacccacgtggagtttgtgatgttcagcacagatgtgagccactgtgtgaaggaccggctgcccaagtgtgtgtctgcctttgccaacacagagggcggctacgtgttctttggagtgcatgatgagacctgccaggtgattggctgtgagaaggagaagattgacctgaccagcctgcgggccagcattgatggctgcatcaagaagctgcctgtgcaccacttctgcacccagaggcctgagatcaagtatgtgctgaacttcctggaggtgcatgacaagggggccctgcggggctacgtgtgtgccatcaaggtggagaagttctgctgtgctgtgtttgccaaggtgcccagctcctggcaggtgaaggacaacagagtgcggcagctgcccacccgggagtggacagcctggatgatggaggccgaccctgacctgagccgctgcccagagatggtgctgcagctgagcctgagcagcgccacccccaggagcaagcctgtgtgcatccacaagaacagcgagtgcctgaaggagcagcagaagcgctacttccctgtgtctgccaggaagaccagcgccagccagtag

SEQ ID NO: 42068 - DNA, 1224 bp, Artificial Sequence
  Description of Artificial Sequence: Synthetic coding sequence
atgacccccatgaagaggtctgtgcagacccaggtgtctgagcccttcatggagagctggggcgaggagagcctgcctgagctgcctgctgagcagagcctgacagagtacagcgacctggaggaggcccccagcgcccacaccctgtatgtgggccacctgaacccccagttctctgtgcctgtgctggcctgcctgctgcgggacaccctggagcggctggagatgcctgtggcccgggagcacatcgaggtggtgagaagacccaggaaggcctatgccctggtgcaggtgacagtgcaccgggacaccctggccagcctgccctggaggctgcagacagccctggaggagcacctgatcctgaaggagctggccgcccggggcaaggacctgctgctgtctgaggcccagggccccttcagccaccgggaggagaaggaggaggaggaggaggacagcggcctgagccctggccccagccctggcagcggcgtgcccctgcccacctggcccacccacaccctgcctgaccggccccaggcccagcagctgcagagctgccagggccggcccagcggcgtgtgcagcgacagcgccatcgtgcaccagcagatcgtgggcaaggaccagctgttccagggcgccttcctgggcagcgagaccaggaacatggagttcaagaggggcagcggggagtacctgagcctggccttcaagcaccacgtgcggcgctacgtgtgtgccttcctgaacagcgagggcggcagcctgctggtgggcgtggaggacagcggcctggtgcagggcatccgctgcagccacagagatgaggaccgggcccggctgctggtggacagcatcctgcagggcttcaagccccagatcttcccagatgcctacaccctgaccttcatccctgtgatcagcaccagcgagacctctgtgcccctgaaggtgatccggctgactgtgcacacccccaaggcccagagccagccccagctgtaccagacagaccagggcgaggtgttcctgcggagagatggcagcatccagggccccctgagcgccagcgccatccaggagtggtgccggcagcgctggctggtggagctgggcaagctggaggagaagatgaaggccctgatgatggagaaggagcagctgcagcagcagctgcagcagcacggccctgtgtcctgcacctgctgcgtgctgtag

SEQ ID NO: 42069 - DNA, 1224 bp, Artificial Sequence; identical to SEQ ID NO: 42068
  Description of Artificial Sequence: Synthetic coding sequence

SEQ ID NO: 42070 - DNA, 1047 bp, Artificial Sequence
  Description of Artificial Sequence: Synthetic coding sequence
atgacccccatgaagaggtctgtgcagacccaggtgtctgagcccttcatggagagctggggcgaggagagcctgcctgagctgcctgctgagcagagcctgacagagtacagcgacctggaggaggcccccagcgcccacaccctgtatgtgggccacctgaacccccagttctctgtgcctgtgctggcctgcctgctgcgggacaccctggagcggctggagatgcctgtggcccgggagcacatcgaggtggtgagaagacccaggaaggcctatgccctggtgcaggtgacagtgcaccgggacaccctggccagcctgccctggaggctgcagacagccctggaggagcacctgatcctgaaggagctggccgcccggggcaaggacctgctgctgtctgaggcccagggccccttcagccaccgggagcagatcgtgggcaaggaccagctgttccagggcgccttcctgggcagcgagaccaggaacatggagttcaagaggggcagcggggagtacctgagcctggccttcaagcaccacgtgagaagatatgtgtgtgccttcctgaacagcgagggcggcagcctgctggtgggcgtggaggacagcggcctggtgcagggcatccgctgcagccacagagatgaagatcgggcccggctgctggtggacagcatcctgcagggcttcaagccccagatcttcccagatgcctacaccctgaccttcatccctgtgatcagcaccagcgagacctctgtgcccctgaaggtgatccggctgactgtgcacacccccaaggcccagagccagccccagctgtaccagacagaccagggcgaggtgttcctgcggagagatggcagcatccagggccccctgagcgccagcgccatccaggagtggtgccggcagcgctggctggtggagctgggcaagctggaggagaagatgaaggccctgatgatggagaaggagcagctgcagcagcagctgcagcagcacggccctgtgtcctgcacctgctgcgtgctgtag

SEQ ID NO: 42071 - DNA, 1080 bp, Artificial Sequence
  Description of Artificial Sequence: Synthetic coding sequence
atgacccccatgaagaggtctgtgcagacccaggtgtctgagcccttcatggagagctggggcgaggagagcctgcctgagctgcctgctgagcagagcctgacagagtacagcgacctggaggaggcccccagcgcccacaccctgtatgtgggccacctgaacccccagttctctgtgcctgtgctggcctgcctgctgcgggacaccctggagcggctggagatgcctgtggcccgggagcacatcgaggtggtgagaagacccaggaaggcctatgccctggtgcaggtgacagtgcaccgggacaccctggccagcctgccctggaggctgcagacagccctggaggagcacctgatcctgaaggagctggccgcccggggcaaggacctgctgctgtctgaggcccagggccccttcagccaccgggaggagaaggaggaggaggaggaggacagcggcctgagccctggccccagccctggcagcggcgtgcccctgcccacctggcccacccacaccctgcctgaccggccccaggcccagcagctgcagagctgccagggccggcccagcggcgtgtgcagcgacagcgccatcgtgcaccagcagatcgtgggcaaggaccagctgttccagggcgccttcctgggcagcgagaccaggaacatggagttcaagaggggcagcggggagtacctgagcctggccttcaagcaccacgtgcggcgctacgtgtgtgccttcctgaacagcgagggcggcagcctgctggtgggcgtggaggacagcggcctggtgcagggcatccgctgcagccacagagatgaggaccgggcccggctgctggtggacagcatcctgcagggcttcaagccccagatcttcccagatgcctacaccctgaccttcatccctgtgatcagcaccagcgagacctctgtgcccctgaagcgctggctggtggagctgggcaagctggaggagaagatgaaggccctgatgatggagaaggagcagctgcagcagcagctgcagcagcacggccctgtgtcctgcacctgctgcgtgctgtag

SEQ ID NO: 42072 - DNA, 1080 bp, Artificial Sequence; identical to SEQ ID NO: 42071
  Description of Artificial Sequence: Synthetic coding sequence

SEQ ID NO: 42073 - DNA, 1224 bp, Artificial Sequence; identical to SEQ ID NO: 42068
  Description of Artificial Sequence: Synthetic coding sequence

SEQ ID NO: 42074 - DNA, 1920 bp, Artificial Sequence
  Description of Artificial Sequence: Synthetic coding sequence
atgtctgccagcggcgtgctgtccttcacccagcagggctgggagcaggtgctggccaaggtgaagagagctgtggtgtacctggatgctgcctgtgccgagagcctgcactggggctgcggcagcacccggctgctggaggccgtgggcggccctgactgccacctgcgggagtttgagccagatgccatcggcggcggggccaagcagcccaaggctgtgtttgtgctgagctgcctgctgaagggccgcacagtggagatcctgcgggacatcatctgccgcagccacttccagtactgtgtggtggtgaccaccgtgtcccatgctgtgcacctgacagccaaccacgtgcctgctgctgctgctgctgagatggagggccagcagcctgtgtttgagcagctggaggagaagctgtgtgagtggatgggcaacatgaactacacagctgaggtgttccacgtgcccctgctgctggcccctgtggccccccactttgccctgaccccagcctttgccagcctcttccccctgctgccccaggatgtgcacctgctgaacagcgcccggccagacaagaggaagctgggcagcctgggagatgtggacagcaccaccctgaccccagagctgctgctgcagatccgctgcctggtgtctggcctgagcagcctgtgtgagcacctgggcgtgcgggaggagtgctttgctgtgggcagcctgagccaggtgattgctgctgacctggccaactatgccccagccaagaacaggaagaagacagctgctggccgggcctctgtggtgtttgtggacaggaccctggacctgactggagctgtgggccaccacggggacaacctggtggagaagatcatcagcgccctgccccagctgcccggccacaccaatgatgtgatggtgaacatgattgccctgacagccctgcacacagaggaggagaactacaacgtggtggcccctggctgcctgagccagagcagtgacaccacagccaaggccctgtgggaggccctgctgaacaccaagcacaaggaggccgtgatggaggtgcggcggcacctggtggaggccgccagccgggagaacctgcccatcaagatgtccatgggccgggtgaccccaggccagctgatgagctacatccagctgttcaagaacaacctgaaggccctgatgaaccactgcggcctgctgcagctgggcctggccacagcccagaccctgaagcacccccagacagccaagtgggacaacttcctggcctttgagcggctgctgctgcagagcattggagagagcgccatgtctgtggtgctgaaccagctgctgcccatgatcaagcctgtgacccagaggaccaatgaagactacagccctgaggagctgctgatcctgctgatctacatctacagcgtgactggagagctgactgtggacaaggacctgtgtgaggccgaggagaaggtgaagaaggccctggcccaggtgttctgtgaggagagcggcctgagccccctgctgcagaagatcacagactgggacagcagcatcaacctgaccttccacaagagcaagattgctgtggatgagctgttcaccagcctgcgggacattgctggggcccggagcctgctgaagcagttcaagtctgtgtatgtgcccggcaaccacacccaccaggtgtcccggccccaccccagcgactaccccctgctgatcctgtttgtggtgggcggcgtgacagtgtctgaggtgaagatggtgaaggacctggtggccagcctgaagccaggcacccaggtgattgtgctgagcacccggctgctgaagcccctgaacatccctgagctgctgtttgccacagaccggctgcacccagacctgggcttctag

SEQ ID NO: 42075 - DNA, 2055 bp, Artificial Sequence
  Description of Artificial Sequence: Synthetic coding sequence
atgtctgccagcggcgtgctgtccttcacccagcagggctgggagcaggtgctggccaaggtgaagagagctgtggtgtacctggatgctgcctgtgccgagagcctgcactggggctgcggcagcacccggctgctggaggccgtgggcggccctgactgccacctgcgggagtttgagccagatgccatcggcggcggggccaagcagcccaaggctgtgtttgtgctgagctgcctgctgaagggccgcacagtggagatcctgcgggacatcatctgccgcagccacttccagtactgtgtggtggtgaccaccgtgtcccatgctgtgcacctgacagccaaccacgtgcctgctgctgctgctgctgagatggagggccagcagcctgtgtttgagcagctggaggagaagctgtgtgagtggatgggcaacatgaactacacagctgaggtgttccacgtgcccctgctgctggcccctgtggccccccactttgccctgaccccagcctttgccagcctcttccccctgctgccccaggatgtgcacctgctgaacagcgcccggccagacaagaggaagctgggcagcctgggagatgtggacagcaccaccctgaccccagagctgctgctgcagatccgctgcctggtgtctggcctgagcagcctgtgtgagcacctgggcgtgcgggaggagtgctttgctgtgggcagcctgagccaggtgattgctgctgacctggccaactatgccccagccaagaacaggaagaagacagctgctggccgggcctctgtggtgtttgtggacaggaccctggacctgactggagctgtgggccaccacggggacaacctggtggagaagatcatcagcgccctgccccagctgcccggccacaccaatgatgtgatggtgaacatgattgccctgacagccctgcacacagaggaggagaactacaacgtggtggcccctggctgcctgagccagagcagtgacaccacagccaaggccctgtgggaggccctgctgaacaccaagcacaaggaggccgtgatggaggtgcggcggcacctggtggaggccgccagccgggagaacctgcccatcaagatgtccatgggccgggtgaccccaggccagctgatgagctacatccagctgttcaagaacaacctgaaggccctgatgaaccactgcggcctgctgcagctgggcctggccacagcccagaccctgaagcacccccagacagccaagtgggacaacttcctggcctttgagcggctgctgctgcagagcattggagagagcgccatgtctgtggtgctgaaccagctgctgcccatgatcaagcctgtgacccagaggaccaatgaagactacagccctgaggagctgctgatcctgctgatctacatctacagcgtgactggagagctgactgtggacaaggacctgtgtgaggccgaggagaaggtgaagaaggccctggcccaggtgttctgtgaggagagcggcctgagccccctgctgcagaagatcacagactgggacagcagcatcaacctgaccttccacaagagcaagattgctgtggatgagctgttcaccagcctgcgggacattgctggggcccggagcctgctgaagcagttcaagtctgtgtatgtgcccggcaaccacacccaccaggccagctacaagcccctgctgaagcaggtggtggaggagatcttccaccctgagaggccagattctgtggacatcgagcacatgagcagcggcctgacagacctgctgaagacaggcttctccatgttcatgaaggtgtcccggccccaccccagcgactaccccctgctgatcctgtttgtggtgggcggcgtgacagtgtctgaggtgaagatggtgaaggacctggtggccagcctgaagccaggcacccaggtgattgtgctgagcacccggctgctgaagcccctgaacatccctgagctgctgtttgccacagaccggctgcacccagacctgggcttctag

SEQ ID NO: 42076 - DNA, 777 bp, Artificial Sequence
  Description of Artificial Sequence: Synthetic coding sequence
atgcagatcagcggggctgtggccccagccccacccagcagcggcctgggcttcggcccccccaccagcctggccagcgccagcggcagcttccccaacagcggcctgtatggcagctacccccagggccaggccccacccctgagccaggcccagggccaccctggcatccagaccccccagaggtctgcccccagccaggccagcagcttcaccccaccagccagcggcggcccccggctgcccagcatgacaggccccctgctgcccggccagagctttggaggccccagcgtgtcccagcccaaccacgtgagcagccccccccaggccctgcccccaggcacccagatgacaggccccctgggccccctgccccccatgcacagcccccagcagcccggctaccagccccagcagaatggcagctttggacctgcccggggcccccagagcaactacggcggcccctacccagctgcccccaccttcggcagccagcccggccccccccagcccctgccccccaagaggctggaccctgatgccatccccagccctgccagcccctacgtggtggaccatggagagagcggccccctgcgctgcaaccgctgcaaggcctacatgtgccccttcatgcagttcattgaaggaggaagacgcttccagtgctgcttctgcagctgcatcaatgatggccgggtgggccagaagagccagcagagcgccctggccctgagccccaccatccgctgcagcaccagcatcatgtag

SEQ ID NO: 42077 - DNA, 1278 bp, Artificial Sequence
  Description of Artificial Sequence: Synthetic coding sequence
atggccagcagcagcccagacagcccctgcagctgtgactgctttgtgtctgtgcccccagccagcgccatcccagctgtgatctttgccaagaacagcgaccggcccagagatgaggtgcaggaggtggtgtttgtgcctgctggcacccacaccccaggcagccggctgcagtgcacctacatcgaggtggagcaggtgtccaagacccacgccgtcatcctgagccggcccagctggctgtggggcgctgagatgggcgccaatgaacatggagtgtgcattggaaatgaagctgtgtggaccaaggagcctgtgggggagggggaggccctgctgggcatggacctgctgcggctggccctggagaggagcagcagcgcccaggaggccctgcacgtgatcaccggcctgctggagcactacggccagggcggcaactgcctggaggatgctgcccccttctcctaccacagcaccttcctgctggccgacagaacagaggcctgggtgctggagacagctggccgcctgtgggccgcccagaggatccaggagggcgccaggaacatcagcaaccagctgagcattggaacagacatcagcgcccagcaccctgagctgcggacccacgcccaggccaagggctggtgggatggccagggcgcctttgattttgcccagatcttcagcctgacccagcagcctgtgaggatggaggccgccaaggcccgcttccaggccggccgggagctgctgcggcagaggcagggcggcatcacagctgaggtgatgatgggcatcctgcgggacaaggagagcggcatctgcatggacagcggcggcttccgcaccacagcctccatggtgtctgtgctgccccaggaccccacccagccctgtgtgcacttcctgacagccaccccagaccccagccgcagcgtcttcaagcccttcatcttcggcatgggcgtggcccaggccccccaggtgctgagccccaccttcggggcccaggaccctgtgaggaccctgccccgcttccagacccaggtggaccggcggcacaccctgtaccggggccaccaggccgccctgggcctgatggagcgggaccaggaccggggccagcagctgcagcagaagcagcaggacctggagcaggagggcctggaggccacccagggcctgctggccggggagtgggccccacccctgtgggagctgggcagcctcttccaggcctttgtgaagcgggagagccaggcctatgcctag

SEQ ID NO: 42078 - DNA, 1137 bp, Artificial Sequence
  Description of Artificial Sequence: Synthetic coding sequence
atggccagcagcagcccagacagcccctgcagctgtgactgctttgtgtctgtgcccccagccagcgccatcccagctgtgatctttgccaagaacagcgaccggcccagagatgaggtgcaggaggtggtgtttgtgcctgctggcacccacaccccaggcagccggctgcagtgcacctacatcgaggtggagcaggtgtccaagacccacgccgtcatcctgagccggcccagctggctgtggggcgctgagatgggcgccaatgaacatggagtgtgcattggaaatgaagctgtgtggaccaaggagcctgtgggggagggggaggccctgctgggcatggacctgctgcggctggccctggagaggagcagcagcgcccaggaggccctgcacgtgatcaccggcctgctggagcactacggccagggcggcaactgcctggaggatgctgcccccttctcctaccacagcaccttcctgctggccgacagaacagaggcctgggtgctggagacagctggccgcctgtgggccgcccagaggatccaggagggcgccaggaacatcagcaaccagctgagcattggaacagacatcagcgcccagcaccctgagctgcggacccacgcccaggccaagggctggtgggatggccagggcgcctttgattttgcccagatcttcagcctgacccagcagcctgtgaggatggaggccgccaaggcccgcttccaggccggccgggagctgctgcggcagaggcagggcggcatcacagctgaggtgatgatgggcatcctgcgggacaaggagagcggcatctgcatggacagcggcggcttccgcaccacagcctccatggtgtctgtgctgccccaggaccccacccagccctgtgtgcacttcctgacagccaccccagaccccagccgcagcgtcttcaagcccttcatcttcggcatgggcgtggcccaggccccccaggtgctgagccccaccttcggggcccaggaccctgtgaggaccctgccccgcttccagacccaggtggaccggcggcacaccctgtaccggggccaccaggccgccctgggcctgatggagcgggaccaggtgagcccccgggagtag

SEQ ID NO: 42079 - DNA, 1275 bp, Artificial Sequence
  Description of Artificial Sequence: Synthetic coding sequence
atggagcccttcagctgtgacacctttgtggccctgcccccagccaccgtggacaaccgcatcatctttgggaagaacagcgaccggctgtatgatgaggtgcaggaggtggtgtacttccctgctgtggtgcatgacaacctgggggagcggctgaagtgcacctacattgaaattgaccaggtgcctgagacctatgctgtggtgctgagcaggcctgcctggctgtggggcgctgagatgggcgccaatgagcacggcgtgtgcattggaaatgaggccgtgtggggccgggaggaggtgtgtgatgaggaggccctgctgggcatggacctggtgcggctgggcctggagagagctgacacagctgagaaggccctgaatgtcatcgtggacctgctggagaagtatggccagggcggcaactgcacagagggccgcatggtgttctcctaccacaacagcttcctgattgctgacagaaatgaggcctggatcctggagacagctgggaagtactgggccgctgagaaggtgcaggagggcgtgaggaacatcagcaaccagctgagcatcaccaccaagatcgcccgggagcacccagacatgaggaactatgccaagaggaagggctggtgggatggcaagaaggagtttgattttgctgctgcctacagctacctggacacagccaagatgatgaccagcagcggccgctactgtgagggctacaagctgctgaacaagcacaagggcaacatcacctttgagaccatgatggagatcctgcgggacaagcccagcggcatcaacatggagggggagttcctgaccacagcctccatggtgtccatcctgccccaggacagcagcctgccctgcatccacttcttcaccggcaccccagaccctgagaggtctgtgttcaagcccttcatctttgtgccccacatcagccagctgctggacaccagcagccccacctttgagctggaggacctggtgaagaagaagagccacttcaagccagacagaagacaccccctgtaccagaagcaccagcaggccctggaggtggtgaacaacaatgaggagaaggccaagatcatgctggacaacatgaggaagctggagaaggagctgttccgggagatggagagcatcctgcagaacaagcacctggatgtggagaagatcgtgaacctcttcccccagtgcaccaaggatgagatccagatctaccagagcaacctgtctgtgaaggtgagcagctag

SEQ ID NO: 42080 - DNA, 342 bp, Artificial Sequence
  Description of Artificial Sequence: Synthetic coding sequence
atggagcccttcagctgtgacacctttgtggccctgcccccagccaccgtggacaaccgcatcatctttgggaagaacagcgaccggctgtatgatgaggtgcaggaggtggtgtacttccctgctgtggtgcatgacaacctgggggagcggctgaagtgcacctacattgaaattgaccaggtgcctgagacctatgctgtggtgctgagcaggcctgcctggctgtggggcgctgagatgggcgccaatgagcacggcgtgtgcattggaaatgaggccgtgtggggccgggaggaggtgtgtgatgaggaggccctgctgggcatggacctggtgtag

SEQ ID NO: 42081 - DNA, 408 bp, Artificial Sequence
  Description of Artificial Sequence: Synthetic coding sequence
atggagcccttcagctgtgacacctttgtggccctgcccccagccaccgtggacaaccgcatcatctttgggaagaacagcgaccggctgtatgatgaggtgcaggaggtggtgtacttccctgctgtggtgcatgacaacctgggggagcggctgaagtgcacctacattgaaattgaccaggtgcctgagacctatgctgtggtgctgagcaggcctgcctggctgtggggcgctgagatgggcgccaatgagcacggcgtgtgcattggaaatgaggccgtgtggggccgggaggaggtgtgtgatgaggaggccctgctgggcatggacctggtgcggctgggcctggagagagctgacacagctgagaaggccctgaatgtcatcgtggacctgctggagtag

SEQ ID NO: 42082 - DNA, 33 bp, Artificial Sequence
  Description of Artificial Sequence: Synthetic coding sequence
atggagcccttcagctgtgacacctttgtgtag

SEQ ID NO: 42083 - DNA, 651 bp, Artificial Sequence
  Description of Artificial Sequence: Synthetic coding sequence
atggagcccttcagctgtgacacctttgtggccctgcccccagccaccgtggacaaccgcatcatctttgggaagaacagcgaccggctgtatgatgaggtgcaggaggtggtgtacttccctgctgtggtgcatgacaacctgggggagcggctgaagtgcacctacattgaaattgaccaggtgcctgagacctatgctgtggtgctgagcaggcctgcctggctgtggggcgctgagatgggcgccaatgagcacggcgtgtgcattggaaatgaggccgtgtggggccgggaggaggtgtgtgatgaggaggccctgctgggcatggacctggtgcggctgggcctggagagagctgacacagctgagaaggccctgaatgtcatcgtggacctgctggagaagtatggccagggcggcaactgcacagagggccgcatggtgttctcctaccacaacagcttcctgattgctgacagaaatgaggcctggatcctggagacagctgggaagtactgggccgctgagaaggtgcaggagggcgtgaggaacatcagcaaccagctgagcatcaccaccaagatcgcccgggagcacccagacatgaggaactatgccaagaggaagggctggtgggatggcaagtag

SEQ ID NO: 42084 - DNA, 630 bp, Artificial Sequence
  Description of Artificial Sequence: Synthetic coding sequence
atggagcccttcagctgtgacacctttgtggccctgcccccagccaccgtggacaaccgcatcatctttgggaagaacagcgaccggctgtatgatgaggtgcaggaggtggtgtacttccctgctgtggtgcatgacaacctgggggagcggctgaagtgcacctacattgaaattgaccaggtgcctgagacctatgctgtggtgctgagcaggcctgcctggctgtggggcgctgagatgggcgccaatgagcacggcgtgtgcattggaaatgaggccgtgtggggccgggaggaggtgtgtgatgaggaggccctgctgggcatggacctggtgcggctgggcctggagagagctgacacagctgagaaggccctgaatgtcatcgtggacctgctggagaagtatggccagggcggcaactgcacagagggccgcatggtgttctcctaccacaacagcttcctgattgctgacagaaatgaggcctggatcctggagacagctgggaagtactgggccgctgagaaggtgcaggagggcgtgaggaacatcagcaaccagctgagcatcaccaccaagatcgcccgggagcacccagacatgaggaactatgccaagaggtag

SEQ ID NO: 42085 - DNA, 1254 bp, Artificial Sequence
  Description of Artificial Sequence: Synthetic coding sequence
atgccacccctggccaccccaccttctgtgcacctgagcctgcgggtggccggccgcccagaccggctgtatgatgaggtgcaggaggtggtgtacttccctgctgtggtgcatgacaacctgggggagcggctgaagtgcacctacatcgagattgaccaggtgcctgagacctatgctgtggtgctgagcaggcctgcctggctgtggggcgctgagatgggcgccaatgaacatggagtgtgcattggaaatgaagctgtgtggggccgggaggaggtgtgtgatgaggaggccctgctgggcatggacctggtgcggctgggcctggagagagctgacacagctgagaaggccctgaatgtgattgtggacctgctggagaagtatggccagggcggcaactgcacagagggccgcatggtgttctcctaccacaacagcttcctgattgctgacagaaatgaggcctggatcctggagacagctgggaagtactgggccgctgagaaggtgcaggagggcgtgaggaacatcagcaaccagctgagcatcaccaccaagatcgcccgggagcacccagacatgagaaattatgccaagaggaagggctggtgggatggcaagaaggagtttgattttgctgctgcctacagctacctggacacagccaagatgatgaccagcagcggccgctactgtgagggctacaagctgctgaacaagcacaagggcaacatcacctttgagaccatgatggagatcctgcgggacaagcccagcggcatcaacatggagggggagttcctgaccacagcctccatggtgtccatcctgccccaggacagcagcctgccctgcatccacttcttcaccggcaccccagaccctgagaggagcgtcttcaagcccttcatctttgtgccccacatcagccagctgctggacaccagcagccccacctttgagctggaggacctggtgaagaagaagagccacttcaagccagaccggcggcaccccctgtaccagaagcaccagcaggccctggaggtggtgaacaacaatgaggagaaggccaagatcatgctggacaacatgaggaagctggagaaggagctgttccgggagatggagagcatcctgcagaacaagcacctggatgtggagaagatcgtgaacctcttcccccagtgcaccaaggatgagatccagatctaccagagcaacctgtctgtgaaggtgagcagctag

SEQ ID NO: 42086 - DNA, 3171 bp, Artificial Sequence
  Description of Artificial Sequence: Synthetic coding sequence
atggaccgggcccccacagagcagaatgtgaagctgtctgctgaggtggagcccttcatcccccagaagaagagcccagacaccttcatgatccccatggccctgcccaatgacaatggatctgtgtctggagtggagcccacccccatccccagctacctgatcacctgctacccctttgtgcaggagaaccagagcaaccggcagttccccctgtacaacaatgacatccgctggcagcagcccaaccccaaccccaccggcccctactttgcctaccccatcatcagcgcccagccccctgtgtccacagagtacacctactaccagctgatgcctgccccctgtgcccaggtgatgggcttctaccaccccttccccaccccctacagcaacaccttccaggccgccaacacagtgaatgccatcaccacagagtgcacagagcggcccagccagctgggccaggtgttccccctgagcagccacaggagcaggaacagcaacagaggctctgtggtgcccaagcagcagctgctgcagcagcacatcaagagcaagaggcccctggtgaagaatgtggccacccagaaggagaccaatgctgctggccctgacagccgcagcaagatcgtgctgctggtggatgccagccagcagacagacttccccagcgacatcgccaacaagagcctgtctgagaccacagccaccatgctgtggaagagcaagggcagaagaagaagagccagccaccccacagctgagagcagcagcgagcagggcgccagcgaggccgacatcgacagcgacagcggctactgcagccccaagcacagcaacaaccagcctgctgctggggccctgaggaacccagacagcggcaccatgaaccacgtggagagctccatgtgtgccggcggcgtgaactggagcaatgtgacctgccaggccacccagaagaagccctggatggagaagaaccagaccttcagccggggcggccggcagacagagcagaggaacaacagccaggatgaagatggcttccaggagctgaatgaaaatggaaatgccaaggatgagaacatccagcagaagctgagcagcaaggtgctggatgacctgcctgagaacagccccatcaacatcgtgcagacccccatccccatcaccacctctgtgcccaagagggccaagagccagaagaagaaggccctggccgccgccctggccacagcccaggagtacagcgagatctccatggagcagaagaagctgcaggaggccctgagcaaggctgctgggaagaagaacaagacccctgtgcagctggacctgggggacatgctggccgccctggagaagcagcagcaggccatgaaggcccggcagatcaccaacacccggcccctgagctacacagtggtgacagctgccagcttccacaccaaggacagcaccaacaggaagcccctgaccaagagccagccctgcctgaccagcttcaacagcgtggacatcgccagcagcaaggccaagaagggcaaggagaaggagatcgccaagctgaagaggcccacagccctgaagaaggtgatcctgaaggagcgggaggagaagaagggccgcctgactgtggaccacaacctgctgggcagcgaggagcccacagagatgcacctggacttcattgatgacctgccccaggagatcgtgtcccaggaggacaccggcctgtccatgcccagcgacaccagcctgagccctgccagccagaacagcccctactgcatgacccctgtgtcccagggcagccctgccagcagcggcatcggcagccccatggccagcagcaccatcaccaagatccacagcaagcgcttccgggagtactgcaaccaggtgctgtgcaaggagattgatgaatgtgtgaccctgctgctgcaggagctggtgtccttccaggagcgcatctaccagaaggaccctgtgcgggccaaggcccggcggcggctggtgatgggcctgcgggaggtgaccaagcacatgaagctgaacaagatcaagtgtgtgatcatcagccccaactgtgagaagatccagagcaagggcggcctggatgaggccctgtacaacgtgattgccatggcccgggagcaggagatcccctttgtgtttgccctgggcaggaaggccctgggccgctgtgtgaacaagctggtgcctgtgtctgtggtgggcatcttcaactactttggagctgagagcctcttcaacaagctggtggagctgacagaggaggccaggaaggcctacaaggacatggtggccgccatggagcaggagcaggccgaggaggccctgaagaatgtgaagaaggtgccccaccacatgggccacagcaggaaccccagcgctgccagcgccatctccttctgcagcgtcatcagcgagcccatcagcgaggtgaatgagaaggagtatgagaccaactggaggaacatggtggagaccagtgatggcctggaggcctctgaaaatgagaaggaggtgtcctgcaagcacagcaccagcgagaagcccagcaagctgccctttgacaccccacccatcggcaagcagcccagcctggtggccaccggcagcaccaccagcgccaccagcgctgggaagagcacagccagtgacaaggaggaggtgaagccagatgacctggagtgggccagccagcagagcacagagaccggcagcctggatggcagctgccgggacctgctgaacagcagcatcaccagcaccaccagcaccctggtgcccggcatgctggaggaggaggaggatgaagatgaggaggaggaggaggactacacccatgagcccatctctgtggaggtgcagctgaacagccgcatcgagagctgggtgtctgagacccagaggaccatggagaccctgcagctgggcaagaccctgaatggaagtgaagaagataatgtggagcagagcggggaggaggaggccgaggcccctgaggtgctggagcccggcatggacagcgaggcctggacagctgaccagcaggccagccctggccagcagaagagcagcaactgcagcagcctgaacaaggagcacagcgacagcaactacaccacccagaccacctag

SEQ ID NO: 42087 - DNA, 3306 bp, Artificial Sequence
  Description of Artificial Sequence: Synthetic coding sequence
atggaccgggcccccacagagcagaatgtgaagctgtctgctgaggtggagcccttcatcccccagaagaagagcccagacaccttcatgatccccatggccctgcccaatgacaatggatctgtgtctggagtggagcccacccccatccccagctacctgatcacctgctacccctttgtgcaggagaaccagagcaaccggcagttccccctgtacaacaatgacatccgctggcagcagcccaaccccaaccccaccggcccctactttgcctaccccatcatcagcgcccagccccctgtgtccacagagtacacctactaccagctgatgcctgccccctgtgcccaggtgatgggcttctaccaccccttccccaccccctacagcaacaccttccaggccgccaacacagtgaatgccatcaccacagagtgcacagagcggcccagccagctgggccaggtgttccccctgagcagccacaggagcaggaacagcaacagaggctctgtggtgcccaagcagcagctgctgcagcagcacatcaagagcaagaggcccctggtgaagaatgtggccacccagaaggagaccaatgctgctggccctgacagccgcagcaagatcgtgctgctggtggatgccagccagcagacagacttccccagcgacatcgccaacaagagcctgtctgagaccacagccaccatgctgtggaagagcaagggcagaagaagaagagccagccaccccacagctgagagcagcagcgagcagggcgccagcgaggccgacatcgacagcgacagcggctactgcagccccaagcacagcaacaaccagcctgctgctggggccctgaggaacccagacagcggcaccatgaaccacgtggagagctccatgtgtgccggcggcgtgaactggagcaatgtgacctgccaggccacccagaagaagccctggatggagaagaaccagaccttcagccggggcggccggcagacagagcagaggaacaacagccaggtgggcttccgctgccggggccacagcaccagcagcgagcggcggcagaacctgcagaagaggccagacaacaagcacctgagcagcagccagagccacagaagtgaccccaacagcgagagcctgtactttgaagatgaagatggcttccaggagctgaatgaaaatggaaatgccaaggatgagaacatccagcagaagctgagcagcaaggtgctggatgacctgcctgagaacagccccatcaacatcgtgcagacccccatccccatcaccacctctgtgcccaagagggccaagagccagaagaagaaggccctggccgccgccctggccacagcccaggagtacagcgagatctccatggagcagaagaagctgcaggaggccctgagcaaggccgccggcaagaagaacaagacccctgtgcagctggacctgggggacatgctggccgccctggagaagcagcagcaggccatgaaggcccggcagatcaccaacacccggcccctgagctacacagtggtgacagctgccagcttccacaccaaggacagcaccaacaggaagcccctgaccaagagccagccctgcctgaccagcttcaacagcgtggacatcgccagcagcaaggccaagaagggcaaggagaaggagatcgccaagctgaagaggcccacagccctgaagaaggtgatcctgaaggagcgggaggagaagaagggccgcctgactgtggaccacaacctgctgggcagcgaggagcccacagagatgcacctggacttcattgatgacctgccccaggagatcgtgtcccaggaggacaccggcctgtccatgcccagcgacaccagcctgagccctgccagccagaacagcccctactgcatgacccctgtgtcccagggcagccctgccagcagcggcatcggcagccccatggccagcagcaccatcaccaagatccacagcaagcgcttccgggagtactgcaaccaggtgctgtgcaaggagattgatgaatgtgtgaccctgctgctgcaggagctggtgtccttccaggagcgcatctaccagaaggaccctgtgcgggccaaggcccggcggcggctggtgatgggcctgcgggaggtgaccaagcacatgaagctgaacaagatcaagtgtgtgatcatcagccccaactgtgagaagatccagagcaaaggaggcctggatgaggccctgtacaacgtcatcgccatggcccgggagcaggagatcccctttgtgtttgccctgggcaggaaggccctgggccgctgtgtgaacaagctggtgcctgtgtctgtggtgggcatcttcaactactttggagctgagagcctcttcaacaagctggtggagctgacagaggaggccaggaaggcctacaaggacatggtggccgccatggagcaggagcaggccgaggaggccctgaagaatgtgaagaaggtgccccaccacatgggccacagcaggaaccccagcgctgccagcgccatctccttctgcagcgtcatcagcgagcccatcagcgaggtgaatgagaaggagtatgagaccaactggaggaacatggtggagaccagtgatggcctggaggcctctgaaaatgagaaggaggtgtcctgcaagcacagcaccagcgagaagcccagcaagctgccctttgacaccccacccatcggcaagcagcccagcctggtggccaccggcagcaccaccagcgccaccagcgctgggaagagcacagccagtgacaaggaggaggtgaagccagatgacctggagtgggccagccagcagagcacagaaacaggcagcctggatggcagctgccgggacctgctgaacagcagcatcaccagcaccaccagcaccctggtgcccggcatgctggaggaggaggaggatgaagatgaggaggaggaggaggactacacccatgagcccatctctgtggaggtgcagctgaacagcagaattgaatcctgggtgtctgagacccagaggaccatggagaccctgcagctgggcaagaccctgaatggcagcgaggaggacaacgtggagcagagcggggaggaggaggccgaggcccctgaggtgctggagcccggcatggattctgaggcctggacagctgaccagcaggccagccctggccagcagaagagcagcaactgcagcagcctgaacaaggagcacagcgacagcaactacaccacccagaccacctag

SEQ ID NO: 42088 - DNA, 288 bp, Artificial Sequence
  Description of Artificial Sequence: Synthetic coding sequence
atgaagggcagccgggccctgctgctggtggccctgaccctcttctgcatctgcaggatggccaccggggaggacaatgatgagttcttcatggacttcctgcagaccctgctggtgggcaccccagaggagctgtatgagggcaccctgggcaagtacaacgtgaatgaagatgccaaggccgccatgacagagctgaagagctgcagagatggcctgcagcccatgcacaaggccgagctggtgaagctgctggtgcaggtgctgggcagccaggatggagcctag

SEQ ID NO: 42089 - DNA, 543 bp, Artificial Sequence
  Description of Artificial Sequence: Synthetic coding sequence
atggccagcgagaggcctgagcctgaggtggaggaggccggccaggtgttcctgctgatgaagaaggactaccgcatcagcagaaatgtgcggctggcctggttcctgagccacctgcaccagacagtgcaggccaccccccaggagatgctgctgcagagcgagcaggagctggaggtgctgtctgtgctgcccccaggctggcagccagatgagcctgtggtgccccggcccttcctgctggtgcccagcaccagggtgaccttcctggcctggcagtaccgcttcgtcatcgagctggacctgagccccagcacaggcatcgtggatgacagcactggagagatcctgtttgatgaggtgttccacgccctgagccgctgcctgggcggcctgctgcggcccttccgggtgcccggcagctgcatcgacttccagcctgagatctacgtgaccatccaggcctacagcagcatcatcggcctgcagagccaccagaggcagggcttcaccatgctggcccggctgcccagcaacttctag

SEQ ID NO: 42090 - DNA, 507 bp, Artificial Sequence
  Description of Artificial Sequence: Synthetic coding sequence
atggccagcgagaggcctgagcctgaggtggaggaggccggccaggtgttcctgctgatgaagaaggactaccgcatcagcagaaatgtgcggctggcctggttcctgagccacctgcaccagacagtgcaggccaccccccaggagatgctgctgcagagcgagcaggagctggaggtgctgtctgtgctgcccccaggctggcagccagatgagcctgtggtgccccggcccttcctgctggtgcccagcaccagggtgaccttcctggcctggcagtaccgcttcgtcatcgagctggacctgagccccagcacaggcatcgtggatgacagcactggagagatcctgtttgatgaggtgttccacgccctgagccgctgcctgggcggcctgctgcggcccttccgggtgcccggcagctgcatcgacttccagcctgagatctacgtgaccatccaggcctacagcagcatcatcggcctgcagagccaccagatgatctag

SEQ ID NO: 42091 - DNA, 7602 bp, Artificial Sequence
  Description of Artificial Sequence: Synthetic coding sequence
atggtgctggagctgcccatccagaatgaacctcctggccaggccgctgctgaggagaagcacacctgtgtggtgcagtacatcctcttccccccccacagcaccagcaccaaggacagcttcagcacagatgatgacaatgatgtggaggtggaggccctggagggggacagcgagctgaacctggtgacagaggtgtgggtggagccccagtatggccgggtgggccctggccctggcatctggaagcacctgcaggacctgacctacagcgagatcccccaggccctgcaccccagagatgctgcctgcatcggctccatgctgagctttgagtacctgatccagctgtgccagagcaaggagtggggccccctgcccccagagccccgggtgtctgatggcctggaccagggcggggacacctgtgtgcatgagatccccttccactttgacctgatgggcctgctgccccagtgccagcagctgcagatgttcttcctgctgctggcccggggagctgagggccccctgctgggcgtgcacggcatccccaaggagcaggccgtgggcagcacccaggccaccggggacagcgccttcaccagcctgtctgtgggcctgcctgagaccctgaagcccctcatcagcgcccagcccccccagtggcgctgctacgcccggctggtgaacccccagcacgtgttcctgaccttcctgcctgccaccttcagtgatgtgcagaggctggccgcctgtggcctggagggccccccccaggaggagaccaagcccaagtttggagactggagcggggcccccagcctgaaggacctgggcggcaccggcatcaaggccaccaagagccacgtgcctgtgctgtctgtgaccctggccagtgacaatgcccagaaccagggcgagctgagcccccccttccggcgggacctgcaggcctatgccggccggcaggccagccagacagagagcgcagatggccccaggacccgctgccctgtgtacatctacagctgcagcctggaggccctgcgggagcagatggtgggcatgcagcccccccaggccccccgggacctgatcttccgcacccagttcctggaccaccccagccccagcagcgcctggatggagccccgctacaaggaggccgccaaccactgtgccctgctgcaggagcacgcccagcgctgctacgtgcggggcctcttccgcagcctgcagcaggcccagagcgtgaccagccaggacctgctgacagctgtggatgcctgtgaggagctgctgcaggagattgacatcacccccttcctgctggccctgtgtggccacacctggggcctgccccacgccccacccagccctggccccctgagccctggccccttcagcagctccatggaggagggcgctgagccccgggagcgggccatcctggccagcgagagcagcattgaaacagaggacctgtctgagcctgagttccagagcaccagggtgcccggcatcccagaccccggccctgagatcagcctgacagatgtgtgccagctgcggggggaggcccatggagccctgcacagcgtcatccaggagaagttcctggagatcagccggctgcacttcagaacagtgcccagcaacccccactacttcttctactgcccccccagcagccggcgggaggatgagggcccccgggacacagtggacaggaagatcagtgacctggagttcagcgaggccgagctgatgggagaggagggggacaccagcgcctgctgcgtggtgacagaaagtgaccctgagctggaggtggagtaccgggagagccgggagagtgacctgggccctgctggcctggacagcgccagcctgagtgatgtggacacagtgaacccagatgaggacagcttcagcatcctgggcggggacagccccaccggccctgagagcttcctgcatgacctgcccccactcttcctgcacctgacctgcagcgtgcggctgcggggccagcacagctctgtgcctgtgtgcagcctgcccacctgcctgggccaggtgctgagcagcctggagggcccccctgtgggcggccgggtgcccctgcgggacctgtctgtgaccctggatgtgttcatgctgaccctgcccctggaggtggagctgcccacagccagtgacccccagcaccacaggagcaccagcgagagcagcgccagcttccccaggagccctggccagcccagcagcctgcggagtgatgatggcctgggcccccccctgcccccacctgaggaggagcggcaccctggcctgagcaacctggccaccccccaccggctggccatcgagaccaccatgaatgagatccgctggctgctggaggatgagatggtgggcgccctgcggcggggcggcatcccccagagccctgccctgcacagagctgctgcccacatccacagcagccctggccgcagcacctgcctgcggcagaccctgcccctgagctttgtgtttggacctgagaggagcctgacccagttcaaggaggagttccggcggctgcacctgcccggccacgtgctgctggaggaccctgattctggcttcttctttgtggccgccggccagcagcccggcggcagccacggggagcccagcagcgctgcctgggcctggcacagccatgaggacagagctgagggcatcgagggggagaccctgacagccagcccccaggcccctggcagccctgaggacagcgagggcgtgcccctcatcagcctgccccgggtgccccagggcggcagccagcccggccccagccggggcctgagcctgatgagcagccagggctctgtggacagcgaccacctgggctatgatggcggcagcagcggcagtgacagcgagggccccaatgacaccctgggggagaaggcccccttcaccctgcggaccccacctggccctgccccaccccagcccagcctgagcggcctgcccggcccctgcctgcctgacttctggctgattgtgcgggtgctgcaggacagagtggaggtgtatgcccacgcccggagcctcatcagagaagatggcggccctggaacagagtgccgccacctgcagcagctgctggtgcggcgggtgggggagatctgccgggaggtgaaccagaggctgctgctgcaggacctgcatgacagccacgtgtgcaacagcctgctggtggccgagagcgaggaggacctgtggaggtctgagacccccttccacagccggcagagggcccccctgcccagtgatgattatgctgctgatgagagctgtgccccccggggctacctggccgccaccatgcagtttgtgcccggccacttcagctgtgatgtggtgtggggcaccgtcatccgggtgcacagccggctgaagatgggccccagcatgggcgtgtcccgggccatccaggccctgcggtctgtgctgaatgccttctctgtggtgaacaggaagaacatgtttgtgtaccaggagcgggccaccaaggctgtgtactacctgcggctgctggagaccagctgcagcgaccggccctggaagggagatgccctgccccccagcctggccctgagccgcagccaggagcccatctacagcgaggaggccagcggccccaggagccccctggacatggtgagcagccgcagcagtgatgctgcccggcctgtgggccaggtggacagacacatccagctgctggtgcatggagtgggccaggccggccctgagatcacagatgagctggtgcgggtgctgtgccggcggctggatgaggccaccctggatgtgatcaccgtgatgctggtgaggaactgcaagctgaccccagcagatgtggagttcatccagcccccaggcagcctgcccagcgaggtgctgcacctggccctgcccaccagctgccggccctggctgcctgccctggcctggtacctgcggcagaacctgctgatcttcctgcacagccccaagtacacagacagcaacagcaggaaccacttccagcaccccctgcccccccagggcggcctgcctgacctggacatctacctgtacaacaagccaggcggccagggcaccggcggcaaaggagtggcctgcatcaccctggcctttgtggatgagggcggggcccccctgagcctggccctgtggccacccagcagccctggccccccagaccccctgcgggaggaggagtttgagcagctgacccaggtgatccgctgccctgtggtggtggacagcagcagcgcccagaatggagccccccggctgcggctggatgtgtgggagaagggcaacatcagcatcgtgcagctggaggagaagctgcggggggccgcccggcaggccctggctgatgccatcatcgagctgcagctgctgcctgccagcctgtgcacagaggacacccccaccggcagcctgagaaatggcagcctggagaccaagagcagcgctggccgggccagcaccttccccccagcccctgtgcctggagagcctgtgaccccacccagcaaggccggccgccgctccttctgggacatgctgagcaagacagaatgtggggacctgggcagccccaagaccacagatgacatcgtgctggacaggcctgaggacacccggggcagaagaagacacaagacagagagcgtgaggacccctgggggcgctgagcgggcccctggcagtgacagcggggcccagaggcagaagaggaggaccacccagctggaggagggggaggtgggcaccctgcaccctgtgtttgcccgggtggcccagcgctggatggagttcatggtgcagatcggctgtgcctctgtgagccgcagcagcgcccacatggtgagccgcttcctgctgcccagcatcctgtctgagttcaccgccctggtgacctccatggccggggacacctctgtgcgcatctttgagcagcacctgggcagcgagcctgagatcttcggcccctgcagccctggccagctgggccccagccccaggcctgctgctgagcggcacctgctgctgctgggcaggaacttcctgcagtggaggcggcccacccagcaggccgccaaggccatgcagagatttgagcctggaggagatggcagcagtggaagaaatgccccccggcagaggctgctgctgctggaggtggtggacaagaagctgcagctgctgacctacaactgggccccagacctgggcgccgccctgggccgggccctggtgcggctggtgcagtggcagaatgcccgggcccacctgatcttctgcctgctgagccagaagctgggcctcttccaccactacggccagctggacttccctgtgagagatgagaaggagcccaaccccttcctgctgcccaccatggaggtggagaccctcatccgcagcgccagcccccccctgagccgggagcagggccgcctgagcggcagcagccggggcggcggccccctgcccctggacaccttcccctttgatgaggccctgcgggacatcacagctgcccggcccagctctgtgctgggccctgtgccccggcccccagaccctgtgacctaccacggccagcagttcctggagatcaagatggccgagcggcgggagctggagcggcagatgaagatggagaacctgtttgtgacctggcagcagaggagcaccccagccaccatgcccatctctgctggggagctggagaccctgaagcagagcagccggctggtgcactactgtgccacagccatgctgtttgatcctgctgcctggctgcacggccccccagagaccagcggccccccagatggccagaggaggcacaggcctgagagcggcagcggcagccgggaggcccccaccagctgtgagagcctggatgtgtccccacctggggcccgggaggagccctggctgaaggagctgagcctggccttcctgcagcagtatgtgcagtacctgcagagcatcggctttgtgctggtgcccctgcggccccccagccctgcccggagcaccagccggccccgggccatggccatcctgggcacagagggccggggcagcttcagctgccccaagaccaagacagatggcagccccaagagcaccagcagccctgtgaccacctaccacctgcagagggccctgcccggcggcatcatcctgatggagctggccttccagggctgctacttctgtgtgaagcagtttgccctggagtgcagccgcatccccatgggccaggccgtgaacagccagctgtccatgctgttcacagaagaatgtgacaaggtgcgggacctgatgcacgtgcacagcttctcctatgacttccacctgcggctggtgcaccagcacgtgctgggcgcccacctggtgctgcggcacggctaccacctgaccaccttcctgcggcacttcctggcccaccacccagatggcccccactttggaagaaaccacatctaccagggcaccctggagctgcccacccccctgattgctgcccaccagctgtacaactacgtggccgaccacgccagcagctaccacatgaagcccctgaggatggcccggcctgggggccctgagcacaatgaatatgccctggtgtctgcctggcacagcagcggcagctacctggacagcgagggcctgcggcaccaggatgactttgatgtgtccctgctggtgtgccactgtgccgccccctttgaggagcagggcgaggccgagcggcacgtgctgcggctgcagttctttgtggtgctgaccagccagcgggagctgttcccccggctgacagctgacatgaggcgcttcaggaagccaccccggctgcccccagagcctgaggcccctggcagcagcgctggcagccctggagaggccagcggcctcatcctggcccctggccctgcccccctcttcccccccctggccgctgaggtgggcatggcccgggcccggctggcccagctggtgcggctggccggcggccactgcagaagagacaccctgtggaagaggctcttcctgctggagcccccaggccctgaccggctgcggctgggcggccgcctggccctggccgagctggaggagctgctggaggccgtgcacgccaagagcattggagacatcgacccccagctggactgcttcctgtccatgacagtgtcctggtaccagagcctcatcaaggtgctgctgagccgcttcccccagagctgccgccacttccagagcccagacctgggcacccagtacctggtggtgctgaaccagaagttcacagactgctttgtgctggtgttcctggacagccacctgggcaagaccagcctgactgtggtgttccgggagcccttccctgtgcagccccaggacagcgagagccccccagcccagctggtgtccacctaccaccacctggagagcgtcatcaacacagcctgcttcaccctgtggacccggctgctgtag

SEQ ID NO: 42092 - DNA, 537 bp, Artificial Sequence
  Description of Artificial Sequence: Synthetic coding sequence
atggccagcgagaggcctgagcctgaggtggaggaggccggccaggtgttcctgctgatgaagaaggactaccgcatcagcagaaatgtgcggctggcctggttcctgagccacctgcaccagacagtgcaggccaccccccaggagatgctgtctgagcaggagctggaggtgctgtctgtgctgcccccaggctggcagccagatgagcctgtggtgccccggcccttcctgctggtgcccagcaccagggtgaccttcctggcctggcagtaccgcttcgtcatcgagctggacctgagccccagcacaggcatcgtggatgacagcactggagagatcctgtttgatgaggtgttccacgccctgagccgctgcctgggcggcctgctgcggcccttccgggtgcccggcagctgcatcgacttccagcctgagatctacgtgaccatccaggcctacagcagcatcatcggcctgcagagccaccagaggcagggcttcaccatgctggcccggctgcccagcaacttctag

SEQ ID NO: 42093 - DNA, 10128 bp, Artificial Sequence
  Description of Artificial Sequence: Synthetic coding sequence
atggccagcgagaggcctgagcctgaggtggaggaggccggccaggtgttcctgctgatgaagaaggactaccgcatcagcagaaatgtgcggctggcctggttcctgagccacctgcaccagacagtgcaggccaccccccaggagatgctgctgcagagcgagcaggagctggaggtgctgtctgtgctgcccccaggctggcagccagatgagcctgtggtgccccggcccttcctgctggtgcccagcaccagggtgaccttcctggcctggcagtaccgcttcgtcatcgagctggacctgagccccagcacaggcatcgtggatgacagcactggagagatcctgtttgatgaggtgttccacgccctgagccgctgcctgggcggcctgctgcggcccttccgggtgcccggcagctgcatcgacttccagcctgagatctacgtgaccatccaggcctacagcagcatcatcggcctgcagagccaccaggtgctggtgcagggctgcctgctggaccccagccagcgggaggtgttcctgcagcagatctatgagcagctgtgcctgtttgaggacaaggtggccaccatgctgcagcagcagtatgacccccagagccaggccgaggaccagagcccagacagcggggacctgctgggcaggaaggtgggcgtgtccatggtgacagctgacctgggcctggtgtccatgatccggcagggcatcctggccctgcagctgctgcccagcaacagcagcgctggcatcatcgtcatcacagatggagtgacctctgtgcctgatgtggccgtgtgtgagaccctgctgaaccagctgcggagcggcaccgtggcctgcagctttgtgcaggtgggcggcgtgtacagctatgactgcagctttggccacgtgcccaacgtggagctgatgaagttcatcgccatggccaccttcggcagctacctgagcacctgcccagagcctgagcccggcaacctgggcctgactgtgtaccaccgggccttcctgctgtacagcttcctgcggtctggagaggccctgaaccctgagtactactgcggcagccagcacaggctcttcaatgagcacctggtgtctgccagcagcaacccagccctggccctgcggaggaagaagcacacagagaaggaggtgcctgctgacctggtgtccacagtgtctgtgcggctgcgggagggctacagcgtgcgggaggtgaccctggccaagggcggcagccagctggaggtgaagctggtgctgctgtggaagcacaacatgagaattgaatatgtggccatggccccctggcccctggagcctgagggcccccgggtgaccagggtggaggtgaccatggagggcggctatgacatcctgcatgatgtgtcctgtgccctgcggcagcccatccgcagcctgtaccgcacccacgtgatccgccgcttctggaacaccctgcagagcatcaaccagacagaccagatgctggcccacctgcagagcttcagctctgtgcctgagcacttcaccctgcctgacagcaccaagagcggcgtgcccctcttctacatccccccaggcagcaccacccctgtgctgagcctgcagcccagcggcagtgacagcagccacgcccagtttgctgcctactggaagcctgtgctgtccatggatgccaacagctggcagcgctggctgcacatgcaccggctggtgctgatcctggagcatgacacccccatccccaagcacctgcacaccccaggcagcaatggccgctacagcaccatccagtgccgcatcagccacagcagcctgaccagcctgctgcgggactggagcagctttgtgctggtggagggctacagctatgtgaagctgctgagcagcgccccagaccagccccccaacagcttctacatggtgcgcatcatcagcaaggccccctgcatggtgctgcggctgggcttccccatcggcaccccagccccagcccggcacaagatcgtgtctggcctgcgggaggagatcctgcggctgcgcttcccccaccgggtgcagagcaaggagcccacccccaaggtgaagaggaagggcctgggcggggccggcggcggcagcagccccagcaagagcccccctgtgctgggcccccagcaggccctgagtgaccggccctgcctggtggtgctgcacaagcccctggacaagctgctgatccgctatgagaagctgcccctggactaccgggcccccttcctgctgaccctggagcccccaggccccctgcccctggtgtctggccgcagcgccagcagcagcctggccagcctgagccgctacctgtaccaccagcgctggctgtggagcgtgcccagcggcctggccccagccctgcccctgagcgccatcgcccagctgctgagcatcctgacagaggtgcggctgtctgagggcttccactttgcctgcagcggggagggcatcatcaacatggtgctggagctgcccatccagaatgaacctcctggccaggccgctgctgaggagaagcacacctgtgtggtgcagtacatcctcttccccccccacagcaccagcaccaaggacagcttcagcacagatgatgacaatgatgtggaggtggaggccctggagggggacagcgagctgaacctggtgacagaggtgtgggtggagccccagtatggccgggtgggccctggccctggcatctggaagcacctgcaggacctgacctacagcgagatcccccaggccctgcaccccagagatgctgcctgcatcggctccatgctgagctttgagtacctgatccagctgtgccagagcaaggagtggggccccctgcccccagagccccgggtgtctgatggcctggaccagggcggggacacctgtgtgcatgagatccccttccactttgacctgatgggcctgctgccccagtgccagcagctgcagatgttcttcctgctgctggcccggggagctgagggccccctgctgggcgtgcacggcatccccaaggagcaggccgtgggcagcacccaggccaccggggacagcgccttcaccagcctgtctgtgggcctgcctgagaccctgaagcccctcatcagcgcccagcccccccagtggcgctgctacgcccggctggtgaacccccagcacgtgttcctgaccttcctgcctgccaccttcagtgatgtgcagaggctggccgcctgtggcctggagggccccccccaggaggagaccaagcccaagtttggagactggagcggggcccccagcctgaaggacctgggcggcaccggcatcaaggccaccaagagccacgtgcctgtgctgtctgtgaccctggccagtgacaatgcccagaaccagggcgagctgagcccccccttccggcgggacctgcaggcctatgccggccggcaggccagccagacagagagcgcagatggccccaggacccgctgccctgtgtacatctacagctgcagcctggaggccctgcgggagcagatggtgggcatgcagcccccccaggccccccgggacctgatcttccgcacccagttcctggaccaccccagccccagcagcgcctggatggagccccgctacaaggaggccgccaaccactgtgccctgctgcaggagcacgcccagcgctgctacgtgcggggcctcttccgcagcctgcagcaggcccagagcgtgaccagccaggacctgctgacagctgtggatgcctgtgaggagctgctgcaggagattgacatcacccccttcctgctggccctgtgtggccacacctggggcctgccccacgccccacccagccctggccccctgagccctggccccttcagcagctccatggaggagggcgctgagccccgggagcgggccatcctggccagcgagagcagcattgaaacagaggacctgtctgagcctgagttccagagcaccagggtgcccggcatcccagaccccggccctgagatcagcctgacagatgtgtgccagctgcggggggaggcccatggagccctgcacagcgtcatccaggagaagttcctggagatcagccggctgcacttcagaacagtgcccagcaacccccactacttcttctactgcccccccagcagccggcgggaggatgagggcccccgggacacagtggacaggaagatcagtgacctggagttcagcgaggccgagctgatgggagaggagggggacaccagcgcctgctgcgtggtgacagaaagtgaccctgagctggaggtggagtaccgggagagccgggagagtgacctgggccctgctggcctggacagcgccagcctgagtgatgtggacacagtgaacccagatgaggacagcttcagcatcctgggcggggacagccccaccggccctgagagcttcctgcatgacctgcccccactcttcctgcacctgacctgcagcgtgcggctgcggggccagcacagctctgtgcctgtgtgcagcctgcccacctgcctgggccaggtgctgagcagcctggagggcccccctgtgggcggccgggtgcccctgcgggacctgtctgtgaccctggatgtgttcatgctgaccctgcccctggaggtggagctgcccacagccagtgacccccagcaccacaggagcaccagcgagagcagcgccagcttccccaggagccctggccagcccagcagcctgcggagtgatgatggcctgggcccccccctgcccccacctgaggaggagcggcaccctggcctgagcaacctggccaccccccaccggctggccatcgagaccaccatgaatgagatccgctggctgctggaggatgagatggtgggcgccctgcggcggggcggcatcccccagagccctgccctgcacagagctgctgcccacatccacagcagccctggccgcagcacctgcctgcggcagaccctgcccctgagctttgtgtttggacctgagaggagcctgacccagttcaaggaggagttccggcggctgcacctgcccggccacgtgctgctggaggaccctgattctggcttcttctttgtggccgccggccagcagcccggcggcagccacggggagcccagcagcgctgcctgggcctggcacagccatgaggacagagctgagggcatcgagggggagaccctgacagccagcccccaggcccctggcagccctgaggacagcgagggcgtgcccctcatcagcctgccccgggtgccccagggcggcagccagcccggccccagccggggcctgagcctgatgagcagccagggctctgtggacagcgaccacctgggctatgatggcggcagcagcggcagtgacagcgagggccccaatgacaccctgggggagaaggcccccttcaccctgcggaccccacctggccctgccccaccccagcccagcctgagcggcctgcccggcccctgcctgcctgacttctggctgattgtgcgggtgctgcaggacagagtggaggtgtatgcccacgcccggagcctcatcagagaagatggcggccctggaacagagtgccgccacctgcagcagctgctggtgcggcgggtgggggagatctgccgggaggtgaaccagaggctgctgctgcaggacctgcatgacagccacgtgtgcaacagcctgctggtggccgagagcgaggaggacctgtggaggtctgagacccccttccacagccggcagagggcccccctgcccagtgatgattatgctgctgatgagagctgtgccccccggggctacctggccgccaccatgcagtttgtgcccggccacttcagctgtgatgtggtgtggggcaccgtcatccgggtgcacagccggctgaagatgggccccagcatgggcgtgtcccgggccatccaggccctgcggtctgtgctgaatgccttctctgtggtgaacaggaagaacatgtttgtgtaccaggagcgggccaccaaggctgtgtactacctgcggctgctggagaccagctgcagcgaccggccctggaagggagatgccctgccccccagcctggccctgagccgcagccaggagcccatctacagcgaggaggccagcggccccaggagccccctggacatggtgagcagccgcagcagtgatgctgcccggcctgtgggccaggtggacagacacatccagctgctggtgcatggagtgggccaggccggccctgagatcacagatgagctggtgcgggtgctgtgccggcggctggatgaggccaccctggatgtgatcaccgtgatgctggtgaggaactgcaagctgaccccagcagatgtggagttcatccagcccccaggcagcctgcccagcgaggtgctgcacctggccctgcccaccagctgccggccctggctgcctgccctggcctggtacctgcggcagaacctgctgatcttcctgcacagccccaagtacacagacagcaacagcaggaaccacttccagcaccccctgcccccccagggcggcctgcctgacctggacatctacctgtacaacaagccaggcggccagggcaccggcggcaaaggagtggcctgcatcaccctggcctttgtggatgagggcggggcccccctgagcctggccctgtggccacccagcagccctggccccccagaccccctgcgggaggaggagtttgagcagctgacccaggtgatccgctgccctgtggtggtggacagcagcagcgcccagaatggagccccccggctgcggctggatgtgtgggagaagggcaacatcagcatcgtgcagctggaggagaagctgcggggggccgcccggcaggccctggctgatgccatcatcgagctgcagctgctgcctgccagcctgtgcacagaggacacccccaccggcagcctgagaaatggcagcctggagaccaagagcagcgctggccgggccagcaccttccccccagcccctgtgcctggagagcctgtgaccccacccagcaaggccggccgccgctccttctgggacatgctgagcaagacagaatgtggggacctgggcagccccaagaccacagatgacatcgtgctggacaggcctgaggacacccggggcagaagaagacacaagacagagagcgtgaggacccctgggggcgctgagcgggcccctggcagtgacagcggggcccagaggcagaagaggaggaccacccagctggaggagggggaggtgggcaccctgcaccctgtgtttgcccgggtggcccagcgctggatggagttcatggtgcagatcggctgtgcctctgtgagccgcagcagcgcccacatggtgagccgcttcctgctgcccagcatcctgtctgagttcaccgccctggtgacctccatggccggggacacctctgtgcgcatctttgagcagcacctgggcagcgagcctgagatcttcggcccctgcagccctggccagctgggccccagccccaggcctgctgctgagcggcacctgctgctgctgggcaggaacttcctgcagtggaggcggcccacccagcaggccgccaaggccatgcagagatttgagcctggaggagatggcagcagtggaagaaatgccccccggcagaggctgctgctgctggaggtggtggacaagaagctgcagctgctgacctacaactgggccccagacctgggcgccgccctgggccgggccctggtgcggctggtgcagtggcagaatgcccgggcccacctgatcttctgcctgctgagccagaagctgggcctcttccaccactacggccagctggacttccctgtgagagatgagaaggagcccaaccccttcctgctgcccaccatggaggtggagaccctcatccgcagcgccagcccccccctgagccgggagcagggccgcctgagcggcagcagccggggcggcggccccctgcccctggacaccttcccctttgatgaggccctgcgggacatcacagctgcccggcccagctctgtgctgggccctgtgccccggcccccagaccctgtgacctaccacggccagcagttcctggagatcaagatggccgagcggcgggagctggagcggcagatgaagatggagaacctgtttgtgacctggcagcagaggagcaccccagccaccatgcccatctctgctggggagctggagaccctgaagcagagcagccggctggtgcactactgtgccacagccatgctgtttgatcctgctgcctggctgcacggccccccagagaccagcggccccccagatggccagaggaggcacaggcctgagagcggcagcggcagccgggaggcccccaccagctgtgagagcctggatgtgtccccacctggggcccgggaggagccctggctgaaggagctgagcctggccttcctgcagcagtatgtgcagtacctgcagagcatcggctttgtgctggtgcccctgcggccccccagccctgcccggagcaccagccggccccgggccatggccatcctgggcacagagggccggggcagcttcagctgccccaagaccaagacagatggcagccccaagagcaccagcagccctgtgaccacctaccacctgcagagggccctgcccggcggcatcatcctgatggagctggccttccagggctgctacttctgtgtgaagcagtttgccctggagtgcagccgcatccccatgggccaggccgtgaacagccagctgtccatgctgttcacagaagaatgtgacaaggtgcgggacctgatgcacgtgcacagcttctcctatgacttccacctgcggctggtgcaccagcacgtgctgggcgcccacctggtgctgcggcacggctaccacctgaccaccttcctgcggcacttcctggcccaccacccagatggcccccactttggaagaaaccacatctaccagggcaccctggagctgcccacccccctgattgctgcccaccagctgtacaactacgtggccgaccacgccagcagctaccacatgaagcccctgaggatggcccggcctgggggccctgagcacaatgaatatgccctggtgtctgcctggcacagcagcggcagctacctggacagcgagggcctgcggcaccaggatgactttgatgtgtccctgctggtgtgccactgtgccgccccctttgaggagcagggcgaggccgagcggcacgtgctgcggctgcagttctttgtggtgctgaccagccagcgggagctgttcccccggctgacagctgacatgaggcgcttcaggaagccaccccggctgcccccagagcctgaggcccctggcagcagcgctggcagccctggagaggccagcggcctcatcctggcccctggccctgcccccctcttcccccccctggccgctgaggtgggcatggcccgggcccggctggcccagctggtgcggctggccggcggccactgcagaagagacaccctgtggaagaggctcttcctgctggagcccccaggccctgaccggctgcggctgggcggccgcctggccctggccgagctggaggagctgctggaggccgtgcacgccaagagcattggagacatcgacccccagctggactgcttcctgtccatgacagtgtcctggtaccagagcctcatcaaggtgctgctgagccgcttcccccagagctgccgccacttccagagcccagacctgggcacccagtacctggtggtgctgaaccagaagttcacagactgctttgtgctggtgttcctggacagccacctgggcaagaccagcctgactgtggtgttccgggagcccttccctgtgcagccccaggacagcgagagccccccagcccagctggtgtccacctaccaccacctggagagcgtcatcaacacagcctgcttcaccctgtggacccggctgctgtag

SEQ ID NO: 42094 - DNA, 696 bp, Artificial Sequence
  Description of Artificial Sequence: Synthetic coding sequence
atggccggcatggtggacttccaggatgaggagcaggtgaagagcttcctggagaacatggaggtggagtgcaactaccactgctaccacgagaaggaccctgatggctgctaccgcctggtggactacctggagggcatcaggaagaactttgatgaggccgccaaggtgctgaagttcaactgtgaggagaaccagcacagcgacagctgctacaagctgggcgcctactacgtgacaggcaagggcggcctgacccaggacctgaaggccgccgcccgctgcttcctgatggcctgtgagaagccaggcaagaagagcattgctgcctgccacaacgtgggcctgctggcccatgatggccaggtgaatgaagatggccagcctgacctgggcaaggcccgggactactacacccgggcctgtgatggcggctacaccagcagctgcttcaacctgagcgccatgttcctgcagggcgcccctggcttccccaaggacatggacctggcctgcaagtacagcatgaaggcctgtgacctgggccacatctgggcctgtgccaatgccagcaggatgtacaagctgggagatggagtggacaaggatgaggccaaggccgaggtgctgaagaacagagcccagcagctgcacaaggagcagcagaagggcgtgcagcccctgaccttcggctag

SEQ ID NO: 42095 - DNA, 279 bp, Artificial Sequence
  Description of Artificial Sequence: Synthetic coding sequence
atggtgtacatcagcaatggccaggtgctggacagccgcagccagagcccctggaggctgagcctcatcacagacttcttctggggcattgctgagtttgtggtgctcttcttcaagaccctgctgcagcaggatgtgaagaagagaagaagctatggcaacagcagtgacagccgctatgatgatggccggggccccccaggcaacccccccaggaggatgggccgcatcaaccacctgcggggccccagccccccacccatggccggcggccgctag

SEQ ID NO: 42096 - DNA, 276 bp, Artificial Sequence
  Description of Artificial Sequence: Synthetic coding sequence
atggtgtacatcagcaatggccaggtgctggacagccgcagccagagcccctggaggctgagcctcatcacagacttcttctggggcattgctgagtttgtggtgctcttcttcaagaccctgctgcagcaggatgtgaagaagagaagaagctatggcaacagcagtgacagccgctatgatgatggccggggccccccaggcaacccccccaggaggatgggccgcatcaaccacctgcggggccccagccccccacccatggccggcggctag

SEQ ID NO: 42097 - DNA, 432 bp, Artificial Sequence
  Description of Artificial Sequence: Synthetic coding sequence
atgagcctgctgctgccccccctggccctgctgctgctgctggccgccctggtggccccagccacagctgccacagcctacagaccagactggaaccggctgagcggcctgacccgggcccgggtggagacctgtggccagctgaaccggctgaaggaggtgaaggcctttgtgacccaggacatccccttctaccacaacctggtgatgaagcacctgcccggggctgaccctgagctggtgctgctgggcagaagatatgaggagctggagcgcatccccctgtctgagatgacccgggaggagatcaatgccctggtgcaggagctgggcttctacaggaaggccgccccagatgcccaggtgcccccagaatatgtgtgggccccagccaagcccccagaggagaccagtgaccatgctgacctgtag

SEQ ID NO: 42098 - DNA, 432 bp, Artificial Sequence; identical to SEQ ID NO: 42097
  Description of Artificial Sequence: Synthetic coding sequence

SEQ ID NO: 42099 - DNA, 2004 bp, Artificial Sequence
  Description of Artificial Sequence: Synthetic coding sequence
atggctgtgtaccgggccgccctgggcgccagcctggccgccgcccggctgctgcccctgggccgctgcagccccagccctgcccccaggagcaccctgagcggggccgccatggagcccgccccccgctggctggccggcctgcgctttgacaacagagccctgcgggccctgcctgtggaggcccctcctcctggccctgagggcgcccccagcgcccccaggcctgtgcctggggcctgcttcaccagggtgcagcccacccccctgcggcagccccggctggtggccctgtctgagcccgccctggccctgctgggcctgggcgcccccccagcccgggaggccgaggccgaggccgccctcttcttctctggaaatgccctgctgcctggagctgagcctgctgcccactgctactgcggccaccagtttggccagtttgctggccagctgggagatggagctgccatgtacctgggggaggtgtgcacagccactggagagcgctgggagctgcagctgaagggggccggccccacccccttcagccggcaggctgatggcaggaaggtgctgcggagcagcatccgggagttcctgtgcagcgaggccatgttccacctgggcgtgcccaccacccgggccggggcctgtgtgaccagcgagagcacagtggtgagagatgtgttctatgatggcaaccccaagtatgagcagtgcaccgtggtgctgcgggtggccagcaccttcatccgcttcggcagctttgagatcttcaagtctgcagatgagcacacaggccgggccggccccagcgtgggcagaaatgacatccgggtgcagctgctggactatgtgatcagcagcttctacccagagatccaggccgcccacgccagtgacagcgtgcagagaaatgctgccttcttccgggaggtgaccaggagaacagccaggatggtggccgagtggcagtgtgtgggcttctgccacggcgtgctgaacacagacaacatgagcatcctgggcctgaccattgattatggccccttcggcttcctggacagatatgaccctgaccacgtgtgcaatgccagtgacaacacaggccgctatgcctacagcaagcagcctgaggtgtgccgctggaacctgaggaagctggccgaggccctgcagcctgagctgcccctggagctgggggaggccatcctggccgaggagtttgatgctgagttccagaggcactacctgcagaagatgaggaggaagctgggcctggtgcaggtggagctggaggaggatggagccctggtgtccaagctgctggagaccatgcacctgaccggggctgacttcaccaacaccttctacctgctgagcagcttccctgtggagctggagagccctggcctggccgagttcctggcccggctgatggagcagtgtgccagcctggaggagctgcggctggccttccggccccagatggacccccggcagctgtccatgatgctgatgctggcccagagcaacccccagctgtttgccctgatgggcacccgggccggcatcgcccgggagctggagcgggtggagcagcagagccggctggagcagctgtctgctgctgagctgcagagcaggaaccagggccactgggccgactggctgcaggcctaccgggcccggctggacaaggacctggagggcgctggagatgctgctgcctggcaggccgagcacgtgcgggtgatgcacgccaacaaccccaagtatgtgctgaggaactacatcgcccagaatgccattgaagctgctgagcggggggacttcagcgaggtgagaagagtgctgaagctgctggagaccccctaccactgtgaggccggggccgccacagatgctgaggccacagaagcagatggagcagatggccggcagaggagctacagcagcaagccacccctgtgggccgctgagctgtgtgtgaccagctag

SEQ ID NO: 42100 - DNA, 582 bp, Artificial Sequence
  Description of Artificial Sequence: Synthetic coding sequence
atgaggctgctgctgctgctgctggtggccgccagcgccatggtgcgctctgaggccagcgccaacctgggcggcgtgcccagcaagaggctgaagatgcagtatgccaccggccccctgctgaagttccagatctgtgtgtcctaccgccgggtgtttgaggagtacatgagggtcatcagccagcgctacccagacatcagaattgaaggagagaactacctgccccagcccatctaccgccacatcgccagcttcctgagcgtcttcaagctggtgctgattggcctcatcatcgtgggcaaggacccctttgccttcttcggcatgcaggcccccagcatctggcagtggggccaggagaacaaggtgtatgcctgcatgatggtgttcttcctgagcaacatgattgagaaccagtgcatgagcactggagcctttgagatcaccctgaatgatgtgcctgtgtggagcaagctggagagcggccacctgcccagcatgcagcagctggtgcagatcctggacaatgagatgaagctgaatgtgcacatggacagcatcccccaccacaggagctag

SEQ ID NO: 42101 - DNA, 1035 bp, Artificial Sequence
  Description of Artificial Sequence: Synthetic coding sequence
atgaacaaccaggcccggaccccagcccccagcagcgcccggaccagcacctctgtgcgggccagcacccccaccaggacccccacccccctgcggacccccacccctgtgaggaccaggacccccatccgcaccctgacccctgtgctgacccccagccctgctggcaccagccccctggtgctgaccccagccccagcccagatccccaccctggtgcccaccccagccctggcccgcatcccccggctggtgcccccaccagccccagcctggatccccacccctgtgcccacccctgtgcctgtgaggaaccccacccctgtgcccaccccagcccggaccctgaccccacctgtgcgggtgcctgccccagccccagcccagctgctggccggcatccgggccgccctgcctgtgctggacagctacctggccccagccctgcccctggaccccccacctgagcccgcccctgagctgcccctgctgcctgaagaagatcctgagcccgcccccagcctgaagctgatccccagcgtgtcctctgaggccggccctgcccctggccccctgcccaccaggacccccctggccgccaacagccctggccccaccctggacttcaccttccgggctgaccccagcgccatcggcctggccgacccccccatccccagccctgtgcccagccccatcctgggcaccatccccagcgccatcagcctgcagaactgcacagagaccttccccagcagcagtgaaaattttgccctggacaagagggtgctgatccgggtgacctactgcggcctgtacagcctgcgctacatcctgctgaagaagagcctggagcagcagttccccaaccacctgctgtttgaggaggacagagctgcccaggccactggagaatttgaggtgtttgtgaatggccgcctggtgcacagcaagaagagaggagatggctttgtgaatgaaagccggctgcagaagatcgtgtctgtgattgatgaggagatcaagaagaggtag

SEQ ID NO: 42102 - DNA, 1041 bp, Artificial Sequence
  Description of Artificial Sequence: Synthetic coding sequence
atgaacaaccaggcccggaccccagcccccagcagcgcccggaccagcacctctgtgcgggccagcacccccaccaggacccccacccccctgcggacccccacccctgtgaggaccaggacccccatccgcaccctgacccctgtgctgacccccagccctgctggcaccagccccctggtgctgaccccagccccagcccagatccccaccctggtgcccaccccagccctggcccgcatcccccggctggtgcccccaccagccccagcctggatccccacccctgtgcccacccctgtgcctgtgaggaaccccacccctgtgcccaccccagcccggaccctgaccccacctgtgcgggtgcctgccccagccccagcccagctgctggccggcatccgggccgccctgcctgtgctggacagctacctggccccagccctgcccctggaccccccacctgagcccgcccctgagctgcccctgctgcctgaagaagatcctgagcccgcccccagcctgaagctgatccccagcgtgtcctctgaggccggccctgcccctggccccctgcccaccaggacccccctggccgccaacagccctggccccaccctggacttcaccttccgggctgaccccagcgccatcggcctggccgacccccccatccccagccctgtgcccagccccatcctgggcaccatccccagcgccatcagcctgcagaactgcacagagaccttccccagcagcagtgaaaattttgccctggacaagagggtgctgatccgggtgacctactgcttcatccacagctacagcctgcgctacatcctgctgaagaagagcctggagcagcagttccccaaccacctgctgtttgaggaggacagagctgcccaggccactggagaatttgaggtgtttgtgaatggccgcctggtgcacagcaagaagagaggagatggctttgtgaatgaaagccggctgcagaagatcgtgtctgtgattgatgaggagatcaagaagaggtag

SEQ ID NO: 42103 - DNA, 2250 bp, Artificial Sequence
  Description of Artificial Sequence: Synthetic coding sequence
atgggccgggccggggctgctgctgtgattcctggcctggccctgctgtgggccgtgggcctgggcagcgctgcccccagccccccccggctgcggctgtccttccaggagctgcaggcctggcacggcctgcagaccttcagcctggagaggacctgctgctaccaggccctgctggtggatgaggagcggggccgcctgtttgtgggcgctgagaaccacgtggccagcctgaacctggacaacatcagcaagagggccaagaagctggcctggccagcccctgtggagtggagggaggagtgcaactgggccggcaaggacattggaacagagtgcatgaactttgtgaagctgctgcacgcctacaacagaacccacctgctggcctgtggcactggagccttccaccccacctgtgcctttgtggaggtgggccacagagctgaggagcctgtgctgcggctggaccccggcagaattgaagatggcaagggcaagagcccctatgaccccaggcaccgggccgcctctgtgctggtgggggaggagctgtacagcggcgtggccgctgacctgatgggccgggacttcaccatcttccgcagcctgggccagaggcccagcctgaggacagagccccatgacagccgctggctgaatgagcccaagtttgtgaaggtgttctggatccctgagagtgaaaatccagatgatgacaagatctacttcttcttccgggagacagctgtggaggccgccccagccctgggccgcctgtctgtgtcccgggtgggccagatctgcagaaatgatgtgggcggccagaggagcctggtgaacaagtggaccaccttcctgaaggcccggctggtgtgcagcgtgcctggggtggagggggacacccactttgaccagctgcaggatgtgttcctgctgagcagccgggaccacaggacccccctgctgtatgctgtgttcagcaccagcagcagcatcttccagggcagcgctgtgtgtgtgtacagcatgaatgatgtgcggcgggccttcctgggcccctttgcccacaaggagggccccatgcaccagtgggtgtcctaccagggccgggtgccctaccccaggcctggcatgtgccccagcaagaccttcggcaccttcagcagcaccaaggacttcccagatgatgtgatccagtttgccaggaaccaccccctgatgtacaacagcgtgctgcccactggaggccggcccctcttcctgcaggtgggcgccaactacaccttcacccagattgctgctgacagagtggccgctgctgatggccactatgatgtgctcttcatcggcacagatgtgggcaccgtgctgaaggtgatctctgtgcccaagggcagccggcccagcgctgagggcctgctgctggaggagctgcacgtgtttgaagattctgctgctgtgacctccatgcagatcagcagcaagaggcaccagctgtatgtggccagccgctctgctgtggcccagatcgccctgcaccgctgtgccgcccacggccgggtgtgcacagagtgctgcctggcccgggacccctactgtgcctgggatggagtggcctgcacccgcttccagcccagcgccaagaggcgcttccggcggcaggatgtgagaaatggagaccccagcaccctgtgcagcggggacagcagcaggcctgccctgctggagcacaaggtgtttggagtggagggcagcagcgccttcctggagtgtgagcccaggagcctgcaggcccgggtggagtggaccttccagagagctggggtgacagcccacacccaggtgctggccgaggagaggacagagaggacagcccggggcctgctgctgcggcggctgcggcggcgggacagcggcgtgtacctgtgtgccgctgtggagcagggcttcacccagcccctgcggcggctgagcctgcacgtgctgagcgccacccaggccgagcggctggcccgggcagaggaggccgccccagctgcccctcctggccccaagctgtggtacagagacttcctgcagctggtggagcccggcggcggcggcagcgccaacagcctgaggatgtgccggccccagcctgccctgcagagcctgcccctggagagcaggaggaagggcaggaacagaaggacccacgcccctgagcccagggctgagcggggccccaggtctgccacccactggtag

SEQ ID NO: 42104 - DNA, 444 bp, Artificial Sequence
  Description of Artificial Sequence: Synthetic coding sequence
atgggcggctgcatgcacagcacccaggacaagagcctgcacctggagggggaccccaaccccagcgctgcccccaccagcacctgtgcccccaggaagatgcccaagaggatcagcatcagcaagcagctggcctctgtgaaggccctgaggaagtgcagcgacctggagaaggccatcgccaccacagccctgatcttcaggaacagcagtgacagtgatggcaagctggagaaggccatcgccaaggacctgctgcagacccagttcaggaactttgctgagggccaggagaccaagcccaagtaccgggagatcctgtctgagctggatgagcacacagagaacaagctggactttgaggacttcatgatcctgctgctgagcatcaccgtgatgtctgacctgctgcagaacatcagaaatgtgaagatcatgaagtag

SEQ ID NO: 42105 - DNA, 279 bp, Artificial Sequence
  Description of Artificial Sequence: Synthetic coding sequence
atggagcagagcaaggtgctgatcaaggagggcggcgtgcagctgctgctgaccatcgtggacaccccaggctttggagatgctgtggacaacagcaactgctggcagcctgccatcaactacatcgacagcaagtttgaggactacctgaatgctgagagccgggtgaaccgctgccagatgcctggcaacagagtgcagtgctgcctgtacttcatcgcccccagcggccacggctggcagaccaggaacatggactactgtgtggagttccactag

SEQ ID NO: 42106 - DNA, 279 bp, Artificial Sequence; identical to SEQ ID NO: 42105
  Description of Artificial Sequence: Synthetic coding sequence

SEQ ID NO: 42107 - DNA, 1269 bp, Artificial Sequence
  Description of Artificial Sequence: Synthetic coding sequence
atggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 42108 - DNA, 1269 bp, Artificial Sequence; identical to SEQ ID NO: 42107
  Description of Artificial Sequence: Synthetic coding sequence

SEQ ID NO: 42109 - DNA, 1008 bp, Artificial Sequence
  Description of Artificial Sequence: Synthetic coding sequence
atggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgaccgtcatcgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaagattctgaggaccggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 42110 - DNA, 1707 bp, Artificial Sequence
  Description of Artificial Sequence: Synthetic coding sequence
atggagcgggaccgcatcagcgccctgaagaggagctttgaggtggaggaggtggagacccccaacagcaccccaccaagaagagtgcagacccccctgctgcgggccaccgtggccagcagcacccagaagttccaggacctgggcgtgaagaacagcgagcccagcgcccggcacgtggacagcctgagccagaggagccccaaggccagcctgcggcgggtggagctgagcggccccaaggctgctgagcctgtgtccagaagaacagagctgagcattgacatcagcagcaagcaggtggagaatgctggggccatcggccccagccgcttcggcctgaagagagctgaggtgctgggccacaagaccccagagcccgcccccaggagaacagagatcaccatcgtgaagccccaggagagcgcccacaggaggatggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 42111 - DNA, 1368 bp, Artificial Sequence
  Description of Artificial Sequence: Synthetic coding sequence
atgggcgcctgcctgggcgcctgcagcctgctgagctgtgccagctgcctgtgtggcagcgccccctgcatcctgtgcagctgctgcccagccagcaggaacagcacagtgtcccggctcatcttcaccttcttcctgttcctgggcgtgctggtgtccatcatcatgctgagccctggggtggagagccagctgtacaagctgccctgggtgtgtgaggagggcgccggcatccccaccgtgctgcagggccacatcgactgtggcagcctgctgggctacagagctgtgtacaggatgtgctttgccacagctgccttcttcttcttcttcaccctgctgatgctgtgtgtgagcagcagccgggacccccgggccgccatccagaatggcttctggttcttcaagttcctgatcctggtgggcctgactgtgggcgccttctacatcccagatggcagcttcaccaacatctggttctactttggagtggtgggcagcttcctgttcatcctgatccagctggtgctgctgattgactttgcccacagctggaaccagcgctggctgggcaaggccgaggagtgtgacagccgggcctggtacgccggcctcttcttcttcaccctgctcttctacctgctgagcattgctgctgtggccctgatgttcatgtactacacagagcccagcggctgccacgagggcaaggtgttcatcagcctgaacctgaccttctgtgtgtgtgtgtccattgctgctgtgctgcccaaggtgcaggatgcccagcccaacagcggcctgctgcaggccagcgtcatcaccctgtacaccatgtttgtgacctggagcgccctgagcagcatccctgagcagaagtgcaacccccacctgcccacccagctgggcaatgagaccgtggtggccggccctgagggctatgagacccagtggtgggatgcccccagcatcgtgggcctcatcatcttcctgctgtgcaccctcttcatcagcctgcggagcagtgaccaccggcaggtgaacagcctgatgcagacagaagaatgtcctcccatgctggatgccacccagcagcagcagcaggtggccgcctgtgagggccgggcctttgacaatgagcaggatggagtgacctacagctacagcttcttccacttctgcctggtgctggccagcctgcacgtgatgatgaccctgaccaactggtacaagccaggagagaccaggaagatgatcagcacctggacagctgtgtgggtgaagatctgtgcctcctgggccggcctgctgctgtacctgtggaccctggtggcccccctgctgctgaggaacagagacttctcctag

SEQ ID NO: 42112 - DNA, 294 bp, Artificial Sequence
  Description of Artificial Sequence: Synthetic coding sequence
atgaagggcatctgcagtgatgccatcctggtgctggccacctccatgtggatggcctttgccatcgacttccccctgcccatggccagcgagcggggccagctggacaagaccatcgtggagtgcctgaagaatgtgaacaagtgctggttcctgagctacatcaagcccagcgagcccatctgtggcagtgaccaggtgacctacagcagtgactgccacctgtgcagcaagatcctgtttgagggcctgaacatcaccaagctgtatgatggccagtgtgagaacagctag

SEQ ID NO: 42113 - DNA, 1794 bp, Artificial Sequence
  Description of Artificial Sequence: Synthetic coding sequence
atgagcagcacagtgaacaatggagctgcctccatgcagagcaccccagatgctgccaacggcttcccccagcccagcagcagcagcggcacctggcccagggctgaggaggagctgcgggctgctgagcccggcctggtgaagagggcccaccgggagatcctggaccacgagaggaagagaagagtggagctgaagtgcatggagctgcaggagatgatggaggagcagggctacagcgaggaggagatccggcagaaggtgggcaccttccggcagatgctgatggagaaggagggcgtgctgaccagagaagatagacctgggggccacatcgtggccgagaccccccggctgacagagggcgctgagcccggcctggagtatgccccctttgatgatgatgatggccctgtggactgtgactgcccagccagctgctaccggggccaccggggctaccgcaccaagcactggagcagcagcagcgccagccccccacccaagaagaagaagaagaagaagggcggccacagaagaagcaggaagaagaggcggctggagagcgagtgcagctgtggcagcagcagccccctgaggaagaagaagaagtctgtgaagaagcaccggcgggacagaagtgacagcggcagcaggaggaagaggaggcacaggagccgcagcagcaagtgcaagaggaaggagaagaacaaggagaagaagaggccccacacagagagccctggccgccgcagccaccgccacagcagcggcagcagccacagccccagcctgagcagccactacagcgacagccgcagccccagccggctgagccccaagcacagagatgagggcaggaagacaggcagccagaggagcagcggcagccgcagccccagccccagcggcggcagcggctggggcagcccccagagaaatggaggcagcggccagaggtctggggcccacggcggccggcccggcagcgcccacagccccccagacaagcccagcagccccagcccccgggtgcgggacaaggctgctgctgctgcccccaccccaccagcccggggcaaggagagccccagccccaggtctgcccccagcagccagggccggggcggccgggccgccggcggggccggcagaagaagaagaagaagaagaagaagaagaagaagccgcagcagcgccagcgcccccaggagaagaggaagaagaagacccaggcctgccccaccccggggcagcagccgcagcctgagccgggcccggagcagcagtgacagcggcagcggccgcggggcccctggccctggccctgagcccggcagcgagcggggccatggaggccacggcaagagggccaaggagcggcccccccgggcccggcctgccagcaccagccccagccctggggcccatggaagaagaggaggccctgagggcaagagcagcagccgcagccctggcccccaccccaggtcctggagcagcagccgcagccccagcaagagccgcagccgctctgctgagaagaggccccacagccccagccgcagccccagccccaagaagcccctgagccgggacaaggatggagagggccgggcccggcacagcgaggccgaggccacccgggcccggcggcgcagccgcagctacagccccatcaggaagagaagaagagacagccccagcttcatggagccccggcgcatcaccagcgctgcctctgtgctcttccacaccactggacctgcccccctgcccccacctgctgcctag

SEQ ID NO: 42114 - DNA, 1962 bp, Artificial Sequence
  Description of Artificial Sequence: Synthetic coding sequence
atgagcagcacagtgaacaatggagctgcctccatgcagagcaccccagatgctgccaacggcttcccccagcccagcagcagcagcggcacctggcccagggctgaggaggagctgcgggctgctgagcccggcctggtgaagagggcccaccgggagatcctggaccacgagaggaagagaagagtggagctgaagtgcatggagctgcaggagatgatggaggagcagggctacagcgaggaggagatccggcagaaggtgggcaccttccggcagatgctgatggagaaggagggcgtgctgaccagagaagatagacctgggggccacatcgtggccgagaccccccggctgacagagggcgctgagcccggcctggagtatgccccctttgatgatgatgatggccctgtggactgtgactgcccagccagctgctaccggggccaccggggctaccgcaccaagcactggagcagcagcagcgccagccccccacccaagaagaagaagaagaagaagggcggccacagaagaagcaggaagaagaggcggctggagagcgagtgcagctgtggcagcagcagccccctgaggaagaagaagaagtctgtgaagaagcaccggcgggacagaagtgacagcggcagcaggaggaagaggaggcacaggagccgcagcagcaagtgcaagaggaaggagaagaacaaggagaagaagaggccccacacagagagccctggccgccgcagccaccgccacagcagcggcagcagccacagccccagcctgagcagccactacagcgacagccgcagccccagccggctgagccccaagcacagagatgagggcaggaagacaggcagccagaggagcagcggcagccgcagccccagccccagcggcggcagcggctggggcagcccccagagaaatggaggcagcggccagaggtctggggcccacggcggccggcccggcagcgcccacagccccccagacaagcccagcagccccagcccccgggtgcgggacaaggctgctgctgctgcccccaccccaccagcccggggcaaggagagccccagccccaggtctgcccccagcagccagggccggggcggccgggccgccggcggggccggcagaagaagaagaagaagaagaagaagaagaagaagccgcagcagcgccagcgcccccaggagaagaggaagaagaagacccaggcctgccccaccccggggcagcagccgcagcctgagccgggcccggagcagcagtgacagcggcagcggccgcggggcccctggccctggccctgagcccggcagcgagcggggccatggaggccacggcaagagggccaaggagcggcccccccgggcccggcctgccagcaccagccccagccctggggcccatggaagaagaggaggccctgagggcaagagcagcagccgcagccctggcccccaccccaggtcctggagcagcagccgcagccccagcaagagccgcagccgctctgctgagaagaggccccacagccccagccgcagccccagccccaagaagcccctgagccgggacaaggatggagagggccgggcccggcacagcgaggccgaggccacccgggcccggcggcgcagccgcagctacagccccatcaggaagagaagaagagacagccccagcttcatggagccccggcgcatcaccaggaggaggaagaggcccatcccctactaccggcccagccccagcagcagcagcagctgcctgagcagtgactacagcaccaggagccacagccgcagccccagccctggccacagccacggcagctacagcagccgcagccacggcaccaggagcaggaccaggagccccagcaggacccccagccccagctaccacagccgcagcagcagcgagagcggcggcttctag

SEQ ID NO: 42115 - DNA, 1794 bp, Artificial Sequence; identical to SEQ ID NO: 42113
  Description of Artificial Sequence: Synthetic coding sequence

SEQ ID NO: 42116 - DNA, 1962 bp, Artificial Sequence; identical to SEQ ID NO: 42114
  Description of Artificial Sequence: Synthetic coding sequence

SEQ ID NO: 42117 - DNA, 2148 bp, Artificial Sequence
  Description of Artificial Sequence: Synthetic coding sequence
atgagcagccccaagaggagcagcaagcccagcatgagcctggcccccagcggcagctccatgcccacagctgaccccaagcccccagccagcctgaagagcaccaagagcgccacccccaacagaagcctggtgcccaccaagccagccaccagcagaaattctgtgatgagccccagcagcagcaagagcaccaagagcaccagcaccaagagggcccccagcaaccggcccagcagccgcagccgggtgcgcagcaaggcccggacccccagccgggtgtccacagacaccaggaccagcaaggccagcaaggccagtgatgtgcgctgccaccagaggcggggcacccacagccggggccgcaccccaggccggcggggcagccgcagcagcaagaggagccccagccgggccagcaccccaggccgcatccgcacccacggggcccggcccggcatggccagccgggtgaggacccccaccagccagcagaagggcagccggggcaagagctatggccggcccaggaccagcaaccgggagaggagtgacagccagcccaggaacctgagcaagaagagctaccggcccccaggcggcagcggcatcggccgcagcagcgagctggccgtgacccccagcacagccaagtgccagacccccaccggcatccccagcaaggagaagagtgacaaccccagccccagcagcagcaggaaggtgaagagctatggccagatgatcatccccagccgggagaagagctacagccccacagagatgagcagccgggtgaagagctacaaccaggccagcaccaggagccggccccagagccacagccagagccgcagcccccggcgcagccgcagcggcagccagaagaggacccacagccgggtgcgcagccacagctggaagaggaaccacagccgggcccggagcaggaccaggaagggcatcctgagccagatgggccgccacagccagagccgcagccacagcaagggcaagagccagaaccagagcaggaccccccggcggggccgcagccacaactggagcaggaaccccagcaaggagaggagccacagccacagccgcagcagcagcaaggagcgggaccaccggggcagcagcagccccaggaaggagagcggccgcagccagagcggcagccccaacaagcagagggaccacagccgcagccgcagccccaacaaggcccgggacaggagccgcagccgcagcccctacaaggcccgggacaggagccgcagccgcagccccaacaaggcccgggactgcagccgcagccgcagcccctacaaggcccgggacaggagccgcagccgcagccccaacaaggcccgggaccacagccgcagccgcagccccaacaaggcccgggacaggagccgcagccgcagccccagcaaggagcgggaccacagccagctgggcagccccagcaaggagcgggaccaccggcgcagccgcagccccagcaaggagcggcagtgccggcagagccgcagcagcagcaaggagcgggaccaccggcgcagccgcagccccagcaaggagcggcagaggcggcagagccgcagccccaacaaggagcgggacaggagccagagccgcagccccagcgaggagcgggagcaccggcagagccgcagccccagcaaggagcgggacagaagacgctggaggagccccagcaaggagcgggagcggcggcagagccgcagcagcagcgaggagcgggaccacagccgcagccgcagccccaacaagcagagcggctacagccggccccgggccagcagcaaggagaaggcccacagccgcagcaggacccccagcaaggagggcaaccacagccagagcaggaccagcagcaaggagagtgaccccagccagagcacagtgcccaggagcccagactggaagaggagccccaccaggaccagcagcctgagccagaacagaacacccagcaagaccagcagccacagccccagcaccttccccagcggcggccagaccctgagccaggatgacagccaggctgatgccaccaccagcaaggccaccctgcctggagagaggagcagcagcagcagcagcaagctggcctag

SEQ ID NO: 42118 - DNA, 2193 bp, Artificial Sequence
  Description of Artificial Sequence: Synthetic coding sequence
atgagcacagtgaccagcaggaccaccagcccctttgcccccaccatgagcagccccaagaggagcagcaagcccagcatgagcctggcccccagcggcagctccatgcccacagctgaccccaagcccccagccagcctgaagagcaccaagagcgccacccccaacagaagcctggtgcccaccaagccagccaccagcaggaacagcgtgatgagccccagcagcagcaagagcaccaagagcaccagcaccaagagggcccccagcaaccggcccagcagccgcagccgggtgcgcagcaaggcccggacccccagccgggtgtccacagacaccaggaccagcaaggccagcaaggccagtgatgtgcgctgccaccagaggcggggcacccacagccggggccgcaccccaggaagaagaggcagccgcagcagcaagaggagccccagccgggccagcaccccaggccgcatccgcacccatggagcccggcccggcatggccagccgggtgaggacccccaccagccagcagaagggcagccggggcaagagctatggccggcccaggaccagcaaccgggagaggagtgacagccagcccaggaacctgagcaagaagagctacagacctcctgggggcagcggcatcggccgcagcagcgagctggccgtgacccccagcacagccaagtgccagacccccaccggcatccccagcaaggagaagagtgacaaccccagccccagcagcagcaggaaggtgaagagctatggccagatgatcatccccagccgggagaagagctacagccccacagagatgagcagccgggtgaagagctacaaccaggccagcaccaggagccggccccagagccacagccagagccgcagccccaggaggagccgcagcggcagccagaagaggacccacagccgggtgcgcagccacagctggaagaggaaccacagccgggcccggagcaggaccaggaagggcatcctgagccagatgggccgccacagccagagccgcagccacagcaagggcaagagccagaaccagagcaggaccccaagaagaggccgcagccacaactggagcaggaaccccagcaaggagaggagccacagccacagccgcagcagcagcaaggagcgggaccaccggggcagcagcagccccaggaaggagagcggccgcagccagagcggcagccccaacaagcagagggaccacagccgcagccgcagccccaacaaggcccgggacaggagccgcagccgcagcccctacaaggcccgggacaggagccgcagccgcagccccaacaaggcccgggactgcagccgcagccgcagcccctacaaggcccgggacaggagccgcagccgcagccccaacaaggcccgggaccacagccgcagccgcagccccaacaaggcccgggacaggagccgcagccgcagccccagcaaggagcgggaccacagccagctgggcagccccagcaaggagcgggaccacagaagaagccgcagccccagcaaggagcggcagtgccggcagagccgcagcagcagcaaggagcgggaccacagaagaagccgcagccccagcaaggagcggcagaggcggcagagccgcagccccaacaaggagcgggacaggagccagagccgcagccccagcgaggagcgggagcaccggcagagccgcagccccagcaaggagcgggacagaagacgctggaggagccccagcaaggagcgggagcggcggcagagccgcagcagcagcgaggagcgggaccacagccgcagccgcagccccaacaagcagagcggctacagccggccccgggccagcagcaaggagaaggcccacagccgcagcaggacccccagcaaggagggcaaccacagccagagcaggaccagcagcaaggagagtgaccccagccagagcacagtgcccaggagcccagactggaagaggagccccaccaggaccagcagcctgagccagaacagaacacccagcaagaccagcagccacagccccagcaccttccccagcggcggccagaccctgagccaggatgacagccaggctgatgccaccaccagcaaggccaccctgcccggggagaggagcagcagcagcagcagcaagctggcctag

SEQ ID NO: 42119 - DNA, 1191 bp, Artificial Sequence
  Description of Artificial Sequence: Synthetic coding sequence
atgggcgccaacaccagcaggaagccccctgtgtttgatgaaaatgaagatgtgaactttgaccactttgagatcctgcgggccatcggcaagggcagctttgggaaggtgtgcatcgtgcagaagaatgacaccaagaagatgtatgccatgaagtacatgaacaagcagaagtgtgtggagagaaatgaggtgagaaatgtgttcaaggagctgcagatcatgcagggcctggagcaccccttcctggtgaacctgtggtacagcttccaggatgaggaggacatgttcatggtggtggacctgctgctgggcggggacctgcgctaccacctgcagcagaatgtgcacttcaaggaggagaccgtgaagctgttcatctgtgagctggtgatggccctggactacctgcagaaccagaggatcatccaccgggacatgaagccagacaacatcctgctggatgaacatggccacgtgcacatcacagacttcaacattgctgccatgctgccccgggagacccagatcaccaccatggccggcaccaagccctacatggcccctgagatgttcagcagcaggaagggggccggctacagctttgctgtggactggtggagcctgggcgtgacagcctatgagctgctgcggggccggcggccctaccacatccgcagcagcaccagcagcaaggagatcgtgcacacctttgagaccaccgtggtgacctaccccagcgcctggagccaggagatggtgtccctgctgaagaagctgctggagcccaacccagaccagcgcttcagccagctgagtgatgtgcagaacttcccctacatgaatgacatcaactgggatgctgtgttccagaagaggctcatccctggcttcatccccaacaagggccgcctgaactgtgaccccacctttgagctggaggagatgatcctggagagcaagcccctgcacaagaagaagaagaggctggccaagaaggagaaggacatgaggaaatgtgacagcagccagacctgcctgctgcaggagcacctggacagcgtgcagaaggagttcatcatcttcaaccgggagaaggtgaacagagacttcaacaagaggcagcccaacctggccctggagcagaccaaggacccccagggagaagatggccagaacaacaacctgtag

SEQ ID NO: 42120 - DNA, 501 bp, Artificial Sequence
  Description of Artificial Sequence: Synthetic coding sequence
atgggcgccaacaccagcaggaagccccctgtgtttgatgaaaatgaagatgtgaactttgaccactttgagatcctgcgggccatcggcaagggcagctttgggaaggtgtgcatcgtgcagaagaatgacaccaagaagatgtatgccatgaagtacatgaacaagcagaagtgtgtggagagaaatgaggtgagaaatgtgttcaaggagctgcagatcatgcagggcctggagcaccccttcctggtgaacctgtggtacagcttccaggatgaggaggacatgttcatggtggtggacctgctgctgggcggggacctgcgctaccacctgcagcagaatgtgcacttcaaggaggagaccgtgaagctgttcatctgtgagctggtgatggccctggactacctgcagaaccagaggatcatccaccgggacatgaagccagacaacatcctgctggatgaacatgtgcagcagtacaccctgaagagccactag

SEQ ID NO: 42121 - DNA, 501 bp, Artificial Sequence
  Description of Artificial Sequence: Synthetic coding sequence
atgggcgccaacaccagcaggaagccccctgtgtttgatgaaaatgaagatgtgaactttgaccactttgagatcctgcgggccatcggcaagggcagctttgggaaggtgtgcatcgtgcagaagaatgacaccaagaagatgtatgccatgaagtacatgaacaagcagaagtgtgtggagagaaatgaggtgagaaatgtgttcaaggagctgcagatcatgcagggcctggagcaccccttcctggtgaacctgtggtacagcttccaggatgaggaggacatgttcatggtggtggacctgctgctgggcggggacctgcgctaccacctgcagcagaatgtgcacttcaaggaggagaccgtgaagctgttcatctgtgagctggtgatggccctggactacctgcagaaccagaggatcatccaccgggacatgaagccagacaacatcctgctggatgaacatgacacctggctgagctacaagagccactag

SEQ ID NO: 42122 - DNA, 1245 bp, Artificial Sequence
  Description of Artificial Sequence: Synthetic coding sequence
atgggcggcaaccacagccacaagccccctgtgtttgatgaaaatgaggaggtgaactttgaccacttccagatcctgcgggccatcggcaagggcagctttgggaaggtgtgcatcgtgcagaagagggacaccaagaagatgtatgccatgaagtacatgaacaagcagaagtgcatcgagagagatgaggtgagaaatgtgttccgggagctgcagatcatgcagggcctggagcaccccttcctggtgaacctgtggtacagcttccaggatgaggaggacatgttcatggtggtggacctgctgctgggcggggacctgcgctaccacctgcagcagaatgtgcacttcacagagggcaccgtgaagctgtacatctgtgagctggccctggccctggagtacctgcagcgctaccacatcatccaccgggacatcaagccagacaacatcctgctggatgaacatggccacgtgcacatcacagacttcaacatcgccaccgtggtgaagggagctgagcgggccagctccatggccggcaccaagccctacatggcccctgaggtgttccaggtgtacatggaccggggccctggctacagctaccctgtggactggtggagcctgggcatcacagcctatgagctgctgcggggctggaggccctatgagatccacagcgtgacccccattgatgagatcctgaacatgttcaaggtggagcgggtgcactacagcagcacctggtgcaagggcatggtggccctgctgaggaagctgctgaccaaggaccctgagagccgggtgagcagcctgcatgacatccagagcgtgccctacctggccgacatgaactgggatgctgtgttcaagaaggccctgatgcctggctttgtgcccaacaagggccgcctgaactgtgaccccacctttgagctggaggagatgatcctggagagcaagcccctgcacaagaagaagaagaggctggccaagaacagaagcagagatggcaccaaggacagctgccccctgaatggccacctgcagcactgcctggagaccgtgcgggaggagttcatcatcttcaaccgggagaagctgcggcggcagcagggccagggcagccagctgctggacacagacagcagaggaggcggccaggcccagagcaagctgcaggacggctgcaacaacaacctgctgacccacacctgcacccggggctgcagcagctag
